United States Patent 7,868,149 (PLANT GENOME SEQUENCE AND USES THEREOF) - sequence listing, part 35

SEQ ID NO: 18017 - DNA, 8882 bp, Oryza sativa
gtaagaagggaggaatccacagagtgtggcctgctgggagtagagagttgttatttgagatacgacttcgtgacaagagtggtgtcggcattgggactactgacgtcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtgccatgtgcgatttcactcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgtttcaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatagccttgtaattttcattttgaactgcactgcacttttaatatcgtcatgtatttgtattggaattgtaatttaaatttcgaactgcactgcacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtatgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggccagtagttggcccaacaatggtgaatgctggatgggcggatgaccttctggccagttttggtggtgtgctgcctgttgcactggaggatctcacagatgggcatgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcagtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcaacgatcgtcccactatggaatccttgtggacacaccgtgaggtattttttgttaaattcgtttatgttatcattatgaatactagttcacaaactttccttatatgagtaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacgacttgttacctcgtggtggacgtgcacgtcgagccacacaatgtccacagggttctcaaacagttgggcatgtatcaggacttccctccgagagatggtcgtcctttggctgatagtcttcataggttagttcacatcacagttgtctaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagcatttataaatgatgtgcaactggttcattatttctaacaaatgtgcatcttgttaaatactcttaataaatgtgcaactggttaaataattttaattaccttgattatttgtggaacaggcggaatttgttgagcacgttcacgtggagtccgacaccatgctgcaaagactagaggcgagacctccggtcgtcaggcctgacgacgtggcgagcatccttcgcaacttccgtgcacgtgctgccgcactactacgtcgtgtctcctgtcggagcgcagcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacattagggggtcagccggatcaggggtacccacgtcgagcacggcaccaccacgtccacaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcattcattgaggacttcttttccactgatcctccccagggggaagtagggatggattactggcacgcagcacctcaggtcacacagccgacgcaggagacggaggtcggtcaggggccagacgtgacaccacagcaggcagctagagataggcaccccccctgataatttgacatatcccactgagcagattaggcgtaggaagaagggaggacctagcaagcgtgcgaagggcactaatcgtccttgacttatctatttgtattaaacttttagtcatttctattctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaataacttattacaaataaatggagaacgcgaccctgtcgaacgcgccagttcgacggatatcctgtcgaacaggggcagttcgacagccccctgtcgaacaggggcagttcgacagccctgcctggggctgttcgacaggtcctatcgaacggcagccttccgatctcctcaccagtcgcgctctggccgttcgataggcgccctatcgaactgcacccgttcgacagggacctactttcgcgattttccccggttgaccactacttttgcgattttccataaaaataatattaattctcaaaaaaattcgctttcttttgttttcttctcttttatttgcggggcattagagatcgcggtcacgcttccgcttcgcggatcagctgcataatatcgagtggaccgatgctttaataacggatgaaaaaattaaccgaagtcttacttaatttttaccgatgctttaataacggatgaaaaaagtcttacttaatttttagttagatatagaaaaaaaagtgccatgcgttgcaacgaaaaataaagaaatatttattcacatctgtggcttagaaatcaacacattaattgaaacaaaaatatacaccgttgatcatagtggatctaaaaaaattttatgaatgtttagatataatgatgtagatttatcaaatataagctatatttttataattagatttaatccaaatcatgatcttataccggccagcaaaccgaactattttctttctgccatacagctgggccccggaaacatgaacgcaaaataaatgaaagatcatttcagcaattatttaattagaaaaatgaatcaaaatccgcgctttcaggtttgggccaaatatgaaaaaatccagattccctccttttgttttgtctcttctctgtttctggcatgtttcctttcttcggtaaatcttgcttgcgtcctcctcaattgggtctagtaaaataagtcctaacagaagtctaatttatgtccctattgctacagtagtttcttcaagttccagtcgagcccggcctacgggggctcctggttagaacagacgcgctagataattttgtagcgcgcacttccataacttcctcctgtttcatcgttttgtatatttttcctgttccgcaccgcgtccggggaggttaagcgcgtgggtccactacggccacgcgtcattagcgctaataacagcgctagccatatggattaatctagttatagtttttattatcaaaataatacataaatagttaagttgaaagtttcgaaaatatgatgaaaaatttcaaaatctgagttgaaagtttcaaaaaaaaatcttgagagtttcaatttcgagttgacagtttttaaatttgagttggaagctttcaaactcgagttggaagttttcaaacttaggttgaaagttttcaaatttgggttgaaagtttttaaatttgacttgaaacttttcaaattttgagtcgaaagtcttcaaattcgggtcgaaagttttcaaaactcgagatgaaagttttcaaaattgatttaaaagtttaaattttgagttgaaagtttttaaattttaaattgaaagtttaaattttgagttgtgacttttaatttttcatctatagaaagtttcaaatttcacgtatagatttttaaatctttagttaaaaaaataggacctcatgaaaaaaaggaaagattaattaaagaaacataattatcggaaactaattccgtcaactaatctaatcttgattattttctccgaatctggcgcacttgcgcacgcttcccagcgatccctcgcgcaaaaaaacagaaacaaaagtggaccggaagagaaatcacgtacgaggacatgggcctaaaacgcgcgctagatggctagttagcgcgtctgcgctaattaggaaattcgccggcctacacctgacgccaccctaatcccgcgtccgattcaaccaaacccgtggagttaatctcaaattagtcgagggcttttgatctatcttttctctcagaaattgagtaatcccctgaaaaatgcttccgtattgaactcaaactccagtttattttttcaatgaaccctagttttatctctccggcgaagtcaagtctgattcaaccaaattagcacgttgacggacaaaaatgcagaaaaaaaagtgacgaacggaaggttacagatttttcttttctaattagttaagataaaatatgatatagatagtccggcgacgactacctcctcttctgatattctcacatacacccgtcgccgccatgcacacacactctcgagctgcgtgtacatttatagttgtacgtataagtgtactgatacacgtataatatacgcagtgacgtgatggaggagttccacaaggagatccgacggtgccgacgagctgctggagttgttcctcagggcgggcactgggtctcaccggagtcgaggtggaagaagatgacggcgactatgcactggtacccgaggtgcccggacctgcggcgagcgctgggactcagtgcacacagcgactccggcttctgctctagagcatcgtgccagggctgcagctgttccggcggggaccagaccggtgggtggcagtgccggcggtcgttcctggcgccttcgtcctcaacgtcggcgacctcatccatatgcatgctcaccaacggccgcttccacagcgtctaccaccgcgccgttgtcaaccgcaaccgcgataggatatcgctcggatacttcctcggcctaccagccgaacgtcaaggttgccggaggccgtgtgccgcccggctggagcgccgcctaccgcgccgtcacgtggccggagtacaaggccgtccgcaagaaggccttcaccacaggcggctccaccctcgagatggtctccacccccaccgccactgacgaacacaacgacgtaaccgacgtcgtccgggatgtcatataatatttacccctaatctgtcttactactttactattgtaccctcaagaataaatggttcagattagttctactggtagtataatactttcggtagaaagcacaatacttgcgtcttgctctgtgttttttcttccgtgcacggtgattatggcagaggcctccagctgttcataaacgcatgacgttttgacctcttcacagttcacgtgctgacaaaactaggataaaattaaagcagctctgatcacagctcgtctcaaagcagaaagaaatagaaaagagatgttgttattgttcaggtgaacaagataggttagagataatcctgctcacacatatgctcttccaaagatattccggtccctgctgacgaaaaaactaatcagcaaaaagtcatcaaaagtgttgcataatcttcataatactacttaggcttgatttaaaacatcattgaacggattgttgatgcgggttatctactttattatattgataaattaaatattatgagaaataaagttaacatgtatcttaagtaggtaagcagtacgggtagaggatttttacataaaatttattcttcaggcaagtatcctgtttgaacgatttggtaaataatttggaaaagtaaacctaaaaatacagtgggacgacgtcacactaaaatacagtactatatctgatgattggtgttcaaattttcatgggccatgtgttacaatttcaaatacaagttacacagctcaaattagttttgaaatgtaattaaactacagcttgtggtggtaatttatcaccatcgtcgttattcgagctatcacaaacgattctgtccttattgcttggccaatgtccttgttagttgttacggagctggccgccatcatgggcgtggctcccggctctttgccgatcgtgcactgtgggcttgtggctaggcgtggctcatagggccagaggccagtctggcagggcaggggccaggatgggaacagagttggatgggctcagcctgcaccgaactgttggcatgttaccaatggtaggaataagttcactttagatgcctcaatatgttaccgagtctaaaattcttccctgactacaataccacgtatagcttgtcccgaactcgcaaaaccgtttcaactttcgtcctaaggcagtatggctcccagtttcatccaacgtggcattttcactccggtcagctatgttgaatcagcatagtagctacacggggccctacatgttagcagccaactcctctccttctccccttctctctccatctgccctctcaacagtggcgctatgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcag

SEQ ID NO: 18018 - DNA, 7183 bp, Oryza sativa
ccgggagagagagggggggaaatggagctgggccgagaggggaggaggcccaagaggagggagagaaggagagggagagaaagagagggaggagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacaaatccaccccccttacaagaatctcgtccccgagattcgaggaggctagcaagaagataggttgggcggtcttctcttcttgtccgacttcttccgctctgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgaccttggtcactaagtactcttcactccgagagttgtggatgcttctggtggcgatgaggtcctttggtctgctacctttcagtgaaaccttgaagtgtttcgccaaaagctacactgactgtcattgcctttgatccggaaaaaacacatctgaaactcttagtccaaacatatgtctctttggttaatcacttgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggaaggtgcttaacatcggtacattgtttctactatgggttagaattaacatgaggcctcacaggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacgtggagttggaattggcggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggtcactaatggggccagaaccatggttgttggtggtatcatcagcattagtattgctattgtggttgtctgcgttgcgttcatctccttggggcaggaactcttgatacacaacagaagatccggtgatctgaagtggctcagtgcgctgtctttggttgccacctggaaatactgggttgttaaccatccttctcttgcagttcgtcatccgactatgctcactttcgagttgcatggctttgtccacaagtttctcaaaatcttcataatcctctaaaagtagttgcactgcgagctcatcttttaacccctggaggaacttctcttgtttgtcttcatccgtttccacatcttctggtgcatagtgagccgaacgatagaactcatgcaggtactctgtgacggtcaaatctccttgcttcaggtagcgaactctcgttttcttagtgtgatcattccggcgggaacatgtgatctccggaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgtcggttgcccctgctgggttgttccgattctgtaatagttgaaaggctgttgccaacatgttggtttggttaaccacaacttggattagctctggtgaggtttcgttgatgcttttctcattcccattggcttgggttcttgagtcatcggatccatcattcccatagcctttgttaccagtactatccatctgtcacaaggtagaggttgagagggaaagcatacaagggaagaatagaccagaactagggacaagaccttaaaggaactaactcttcttattgatgtgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttccctccttcacagctggcttcactacttcctccatttcgctagcggatcctgcagtcttccggagcttcggcaaacaactgacgatgtcttcttcttcactgacctgaccatctagtactagttgaaaatccgaagaaggaagaacggagtaaaccttttgcaaatagcattaggggaaggagaaaaaggaactttcgcaaataatttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaaggcacatctttattatatcgataatatttacattattacaaaggcacttaaggcctgacaatcaaaaataaacagcagcggactagcggcctacggctccatcttcacaggcgctcaactggggtataagccaggacttcacctaagacatcttctccaaagcttctcttactgaagggggaaaagatagagcaagaatgagtacaaccacagtactcagcaagccacaccggcagatgcatgattaatgcaagggaggtacaagggaataataatatagggattaagttttgcggtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaagttttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgtcctggagaatgtccatcgacccccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaccataattcaacaattccatagtgtccaaatgatatgagaactcccaaagtctaaagttataaaaccacctaatgttgcctaattattcagcgaagcatctacctaaatttatactagtggaaccatgaatagagtacccactagttgaggttttgtttaatctagggtgaacaaggtaataataataacaatagcaataataatgtcataacaaaggtaaataggcttggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttatagcaaacattaggagactttgaacgggtcgattcagagttcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccgacaaacggactccactagacaccacacgggttgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggaggcgaggacgaagacgatgacgggggctgcagcgaccttgacgaagcgaggacgacgaacgggaacggcttgacggaggggcgaacgccacgacgaccgggaacgacgagaggacgacgacgacgacgacgaccgggaccggcgagggggcgacgagggcagccggcagtggctgcacagagacggggacgacgcggaacacgccgcagcgatgacgatgacggaggcggcgccgcgagacgacgagccgagcgaggatgaacgggacgtcgacgacgagaacgatcggagacgacgatgatggaccgcggaggggtttggatggaggggaaacgatgccgaggacgaccttgccgctgcgatgccgaagatggtggtggaggtggccgaccgatgcacggcgaggagggacgggcggccgaacaactccggtgaggcggacggagaggttcgcggcgacgttccggcgaaaccgagggcaggccggggtggagggcgatgcggcgacgccgagggaggagacggcgacgtcggccgacgctctggcgcggcgaccggggcagccggaggagatgccgccgaggaggaaggagaaaccggcgcgggcgacggtgttccggcgaagttcgggcgaggcggaggtgatgccggggatgagagcggcgtcgtggagccgaggaaggtggtggcgacgtcggccggcgctccggggacgtggcagaggcggccggaggcggagaagtggtggcgacgccactggacgccggcgagggcgcgtctccggtgatttccccgcgaaacggagggctgaccgagggagagggggcagctgcgaggccgagggagaagacggcgcggccgggcggcgttcgggcgaggagaggaaggcggctggaggtggccggcgcgagggaaaggggagggcgacggcgggaacgtagttccgggggtctcctcgcgaaacggagggcaggccggcgtggaggaggtggcggcgatgctgtaggaggcgacgacgcgaccggacggcgctcgggcgaggcgggagaggcggctggaggcggccggcggcacgggagagagaggaggacggcggggagaggtgctgcggccgtgggggagctcgggaaggggctaaaacgagagaacgcacggagggggttgcattttatatgatgggggagggagccggccacgggaggagcgggaacggcggcgggaaccacggccggcggcaatggttggtggccggacttggcgcgtccgttcccgaggattgaaagcaccattcaaggggaaaaacgggggaaatcgaagaggaatcaatggggattaattgcccccaatcaatttggtaagagccggcttgaatagagcggatttagaggaggaatggcgctagggctcgctcgggagggagagaggaggacggccggcgcgggaggaggaagacgacgctggcgcgtgggccccacgcggtcgggcggcggcgtcagcgcgcgcacgcgcgcgcacgtgcgcggcacggggcgggggcgcggctagggttgggccgggcgaccggcccaggaggagaggaggggaagcggcttgggccgagggaggccgggaggaaggaggggggggggaaaaaaaa

SEQ ID NO: 18019 - DNA, 790 bp, Oryza sativa
gagagggagacttatttttagattttcttttttaataaacttcgataattgttgttgtggcttaataaatatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagaagatgatttttattttcgggatgaatttatcaggacgtgacacgctagcagctagcccacgagccacgtgtgccaagccatcctcattcggtgggcaacgaggacaggatcatcgacgcagacgaggtgactggcgtagctgttggcggcaaggagatggcgcgcggtgaggaagagggagctgagtcggagtaggccggagccgaggaaggtgaggcaagagggtggtgggctatggaaaccttgagttaccctcagcattggccaccgcccaccgaatgccggcgacctgccgcttttgtccccgtcgccagccggatgcctcaagcgctcaagctcacctcatggaaggcttcttgtcacgccctgaagtttcccctttttcttgccttcaaaaaaaatggttaaataaattgcccgaagaaatagtttaattaacctagagttgaatccctaattaataaatgcaattaataatcggaaatagtgtggtggaatttttcttgagttccccatgccctaatgcattaacaggatttttagtggaattttcagagc

SEQ ID NO: 18020 - DNA, 1413 bp, Oryza sativa
tatagcatgttttgcttgtgtgctttgtttgtcgcgtagatttcggtcgtttcgtcgacccgcggtttctcgaagaccttgctgaggtctcatcagtgcgagagcaaggcaagtcatgcattataattgatcatattgtacccaatttacaaatatcccgcatttctatcaaatgttgcattcttttacaatgtcatgtgggatgggtcctaccactcagccatttattgtttaccctatgccattaataatttgggtatcaaaatgattagatgttggtttaggaaatgctcagccatgcctagttcaactattacacaaatggggatcacattattacatagactttgactattagcatagctttggattggtgccaccgtaatggtgttagttaattaaaatacactgaatggtgggctgtgggtgcatggtttagctggtcgcacccatggcagttaaggactggttcacaggaaaccctaggagacttaccgtgcttaccacaagcgggagtggataactgcttgatctgaagtatagctcgaccctttcctaggcaccggtggcgagggtgggcgtgatggagttgggtcggccggggtgtctggttgtccagctgccggattcaccgcggcgtaagagggaccgcccattgcctgttggggtgggggtgaaacctttgcgtggtgtggatggttaggagagagttatgcggagggtcttgacacgatttccccctttgcagtatcatggtgatactttggggcatggcgacatgtgtggaatcgtgtcttgtgggtacagttgtacacctctggccagagaaaaactattcgaatagccgtgcccgcggttatgggcgatcaaccagattcaccgtgattagtctcacccctagtttagcttaatgaactggtgtagttcaggtggttggttgggcctgttgcaacgtggtatagcgttggacagtgattggttaatattgcttaattactacaattgttttactgctttcaactgctgcttttaaatgctagctttgtgcaaatgaacccatagcctcctttggttatatcctgcatcatacattctcatccggtatgacttgctgagtacagtgggtagtactcagtcttgctttcttttcccccacaccagagctgaagatcttcctagtgggagctgttctgttgaagttggtttcgtcgatgccgtcaaggattgcctgtggagtggagtcgcccgctgcagaagtcaagaatccaagtttagttcgttttatcttttccgctgcatttgtaatcttttatatttttgtaagacgtggatctgtatgtcaacaattatcgtttgtgtaccctggctggtccttgtcacaccccgaagttttcctcccaagccaaattgtaa

SEQ ID NO: 18021 - DNA, 15846 bp, Oryza sativa
cagcgttacccgtcgtggtttgagcatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgattctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgctagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaacctgcagctcaagaaggacctcgacgcgttggaggcgcagccgcaccagctcaaggtcgcccagggagagatcagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggctcgcgtgtgtttttcctcgtttgtctttttgagttgtgtggggcatggttacgccggtgtgtggtgtaactatgtcggagcctgtcttattttatttgcctaagcaacttgaaccttaatgaaccaatttaatagcagtgataaatttaagaataatagtagtcgtgggtggttagttttaatcgtcagctctctctctctgtttgctggttctgtgtggggttttcagatggtgtcgaccaggagaaatgttaacaccggtgaaggcaaccaacccgagggcagcaaccccaacccccaaggcaatccacctccaccaccaccaccagacaccaacgccattctcacccagatcctcgcccagcaagccaacatgatgaatgctttcctccaccacctccaaaatccaccacaacagaatgctccaccacctcctccccaacactccaaactcgccgaattcctccgcatccgcccacccaccttctctagctccaacaatcctgtagatgcgttggattggttgcatgccgtggggaagaagctagacacggtgcagtgcagcgacgaagagaaagtcatcttcgccgcccatcagctgcaaggacccgcatctctctggtgggaccatttccaggctgcgcagccagaagggcaaccgatcacttggactcgcttcaccgccgctttccggagaacccatgtgcccgctggagtcgtggctcttaagaaaaaggaattccgggagttgaagcaaggcaaccgctccgtgatggagtacttgcatgagttcaacaatctggcccgttacgcccctgaggatgtgcgggaagatgaggagaagcaagagaagttcctggcaggaatggaccccgagctgtccgttcgtctagtctctggggactacccggacttccaacgactggtggacaagagcatccgcttggaagccaagcacaaggagctggagtcgcacaagcgccgcttggcgaacatccgcaatcaacagggtgctaaccagagggtccgctacaccaatccctacccagggggatcctcctcgcagcagcagcagcagcagcagcagcaacctcgctccgcgcctcgacctcaattcgtggtgcgcgtcccacagcagcaaccgcagcagaatcagcaagggactcgtgcaccccgtcctcctacgccagctgggcagcccgttcaaggccgcagggacgcttcaggtccgcagcggctgtgcttcaactgcttcgagcccgggcactttgcggataaatgcccaaagccaaggcgtcagcaaggccaagcgcctccccgccccaacaacggtggcaaggatgtcatccgtggtcgcgtgaaccacgtgacggccgaggacgtgctgacaactccggacgtcatcgttggtacgttcctcgtccattccatccccgctacaattttgttcgactctggagcttcccactcgtttatatctgtgccattcgtggggaaaaatcagttgggggtagaaaggcttagaaaccctctgctcatcaccacccctggaggggttatgacagcaaagtattatagccccgccgttcctatagaaattcagggaattccttttccctcggatctgattctgttagacacaaagaacttggatgtgattcttgggatgaattggttggctcaattccaaggagtagtggattgcgcgagacgcactgtcactctgtaccgaggaccggaacagccggttgttttctttgcacctccaacctctgtccgaagttcagaactgcatcagataggtctgtcagaaatccccatcgtcagagagttcggagatatttccggaagaactacctggtatgccgcctaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaaaacgaagaggatgtgcgttgactacagagctctcaatgaagttaccatcaaaaacaagtaccctcttcctcgaatcgatgatctgttcgaccagcttaaaggtgccactgtattctccaagattgatcttcgttccggatatcaccaattacgtattcgtgaagaagatattccgaagaccgcattcaccacgcgatatgggctgtatgaattcacggtgatgtcgttcggtttgaccaatgctcctgccttcttcatgaacttgatgaacaaagtgttcatggaatacttggataagttcgttgtggttttcatcgacgacattctgatatactcacaaacagaagaagaccatcagcaccatctccgtctggtattgggaaagctgcgggaacatcaattgtatgccaagcttagcaagtgtgagttctggttgtccgaagtcaaattcttggggcacgtgatatctgctaaaggagttgctgtggatcccgaaacagtgaccgccgtcaccgaatggaagcaacccaagacagtcactcaaattcgcagtttcttgggtttggcaggatactaccggagattcatcgagaacttctccaagatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcctcacgtcagctacgtcctcatgaaggcaactaccctacgcatgacttggagctagcagcggtggttcatgctctaaaaatttggcggcactatctcattgggaaccgctgtgaaatatatactgaccataagagtttgaaatacatcttcacccagtcggatctgaatcttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgcaggtttcacagaggatgaacacggaactctatggaacggaaagcgggtgtgcgttcccgataacagagaacttaaacagctgatacttcaggaagctcacgaaagtccttattccattcacccgggcagtaccaagatgtacttagacttgaaggagaaatactggtgggtcagcatgaagcgggaaattgcagagtttgtggctctatgtgatgtgtgccagcgtgtcaaggcagaacaccaacgaccggccggacttctccaacctctccaagtgccggaatggaaatgggatgaaattgggatggatttcatcaccggacttccaaaaacccaaggaggatatgattccatatgggtagttgtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcgtatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccctatgaagcgttgtacgggcgcaaatgccggacaccgctattgtgggaccaagtcggagaaagccaagtgttcgggactgatatcctgagagaagctgaagctaaagtcagaatcattcgggataatctaaaggtggcacaatctcggcagaaaagttatgcagataaccgtcgtcgtgacttggaattcgcagtggatgattttgtgtaccttcgggtcacgccattgcgaggcgtgcacaggtttcagacgaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtctccgagtgccatccgagcaggccaactcagagcaaattgaagtccgcgaagacctgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcctgatctcttcgccagttcttccgaatctcggggtcgagattccgtttaaggggggtaggtttgtcgcgtcccaaatcgactctaaaatctatcctcgaaattgtgcaaaagaataattaaaattcaatgtgaaagcctccaacaattaaaatgtgcaaagatgaaagtcaaatgaggcttggaggatttttgtatatttcctaaaagcctaaaatgcttaaataaattttagtggaattttcagagcacaaataataatagaaaagaaataaacaaagtggaaaaggttttataaaaagaaaaccctaaaaaaagttcgcttcccccccccttttccctcttgggccggctcggcccattccctccctctctctctcctctcccgcggcccatcggctccccgcgcgcgcgcgccgctgacaggcgggcccgcccgccgctctcgctgacgggtgggtcccacctgtcatcttcctcctcccgccgcgtccgccgccgcgcccgtgccctagcgccgccgccgccgcgaatcccgccgctcccgtccgccccgcgtgcaatcaagaggggggatttactccccgcgtttccctcccccgtttccccctctttcccctctctctctccctcggattcgttcgaatcaagcccgtaatcgtcgccggcgcaatcaatggcggccgagatccccgcgcccgtttcctctcttccggccgctctttccttcctccggcgctatttaaaccctccccgagctccgcccttccgtttctgccactcgccgctctttctccccgtcggaatcgagctcgcgccgtcgccctctttctccgccgtcgctgccgagctccggtcgccgccgccgtcgccccggacctcctcccgcttcggcatcgcctccttcggcttcgccgcgtcctcgccgacctcgtccactcctccgtttcgcccgccgatcaccggaacgccgccgtcctcgtcgacccgagccgcgccgccgccttcctccgctccggtcgccgtttccgtcgtcgccgtcgacccagggtgagccgtggaccgccgtttcgacttcccccttccctcccctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataaatggaatttttaattgaaaattaaatgaagaaattcgcaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgttgaagtcgaagccgtcgattgggaaaacgagcaaggcaagacacatcatcttgatcatattgaatcccagtttacaaaattatgttgatttaaattattgcattatcgctttatttaaattcccgcgttatcactgttttatttagccatgcctatttacctttgttatgaccatattattattgttattgttattattactaccttgttcaccctagacaaacaaaacctcaactagtggacactctactcatagtaccactagtataattctaggtagatgcttcgcaagttaattaggcaacattaggtggttttacaactctagacttgggaaattctcatatcacttggacactctggaattgttggattattgtggaattggcttcacaccgccccctctattcaaaattccctaaaatggttttaggctgggctcggggtgcatggtttggatggtagcaccttggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcggaattgggtcggtactcttgtctaaggctaggatgggttggaaactatgtcacgtcttccgtctgtataccgtggtggtatgtggcacgtggtaacacgtgaggaagccgtgtcttgtgggtaaagatgtacacctctgatcagagtataatctattcgaatagccgagccctcggatatgggcaagccgagcaatgtacccaagttagtgttttaattcttaaaacttgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattgtatagttctagcttcgtgtttacaaaatagccttgagcaactaaattcctttaaatgctgtttactgcaaccctaaccctttatattataattcctttgtactcccttgcatttattctgcatttgtgggtgtgtcttgttgagtacggtggttgtactcagtcttgcttaattttcccaagcccagatgaggagttccctgaagatgaaggctttggtgtctagctcgtgcctgccgtcaagcgcctgtggtcgtcgccctagtcttccgctgtctttcgttgtctttgagtgtgctgggccttcgttgcccgtgtaataattttatatacgcttccgcttgttaaactctgtattgtatcaacttttggtgtaccttgcctcctgggacaaggaataatacacgcacgtcaggaacgcccgttgggtgatttccggtcgtgacatccatggtgcgtcatagatctatgggctgggatggtggatcgattcagatcaggaaaaaaaaaggaaaaaatgaagtgggggtgagagtggttggttgggtacaggaaaaatataatatataccagaagcaaagaagttgtttttatcgaagtaaatcatttactccattagtggtgggagcgggatgacaggacgtgtggtgggatcggaagcagggaagttgtttttatcgaagtaaatcatttactctgataatggtgggagcaggatgatgggacgtgaggtgaggtaggccttggctgatatatgtttggcgctcggaatactagaagctcctagtagtatctctataataagatgttttaaaaaatcaatggtcaacaatacaaatatttaatttaggacaaaattaaattgaaactgagggaatacatagaacgaaattaatgtgatttggagaagtggtttcctttatatgaagaggattatgtcttgcagatgcattcaggagattcaaaggagaggatggcaggttcatcaatactggaatagctgatgaaccgagggggttattaagtttatataatgcagcacatctcctcatccatgatgagccggaacttgaagaagcaatctctcttgcaagacaccatcttgaattaatgaggggtggaggtgggctcaaaccccctctagctgatcaaatcaaccgtgccctagatttaccattaccaagagcctacaagagaatagaaacattgcattatatgctggagtatgggcaggaagaagggcacaatgtggatcttctggatcttgcaaagctagaatttaacctgctgcagcatgtccacttgaaggagctcagaaatttttctcagtaagcatgtgtttatttgttgtacggggtatatatatatatatatatatatatatatcatctaagtaaatggatatgataaaagtaattaactctgcgctttcaaaaagtagctaatcatgataataatatcaaatgatatgcatgtctcaatgatgttctactttggtattaccagaaaaaccttgttttggcaattcatctaaacaatcagccgttataaagtctactggccctgcatagagctggtatacaaatattttttatggaatatttgtatacgatcgatggacagtttgttcaaatggtctctattggtagtagaatcgatatctagactgcccatcgatcgtttatgttccaacagtttgtatctatttatactgccatctcaactactaagtagttctataatatgttttatactggtattaaaactgacaaattaacggttgctatcactccactagtgataatactagtatagtagtagagaccaccgtaaaggtattctcagtgaaatggatcttcacattggtagtattttaggtctgcttgataggtatacacgtccacattattactatcataactaaacacaatgctactctatcttaaatacagtattaaacatgcacctgaatcacttaattttcaggtggtggaaaaatatctatggatatgtgcaactaagttacgccagggatcgtgcggtggaaagttacctttggtcctatgtcgtgttctacgagaaagatttagtgctttcacggatgatctttgcgaagatatttgcactgcttgtaactatggatgacacgtatgatgactatgccaccatcgaggaaagcaggaagctgaatgaagcgatacaaaggttggattaatatgaaaaaaaaacagggcaaatatccttgagatgaaaccacctgtgcggtagtattgcgaaaaccactccacaaccgcaaactatacttacaagtttccaaaagttcccaaacaaattctctcaaaaaacctgagttacgaatacttttttgtcaagttggtgagacaatattttttaaaaaatatgtaaatttcaagatcttgaccaatttggttcaaaaaattacaaaatttggaggtttgaaaagctttggaaaacaaaaataaatcaacatccaactgttttatacacctcttcattcttctatttgtcaatcgataaaactgaatcaattacaattcttgtattttacattattgtttgatatgcaaagtaaattttttgaaggttttatgtatattgtatctttcgtgatgtgccaaaaactgacagggaaataggaaaaacctttatgttcttgtcggtttttaccatctggctcatcacgatttgcatcatagcacttctaattctatacctgattttttctgaagtaccacatgcaaggatcaggaagaacaacctatgcatacacactagtatcatggctcatgaaatcgaaaaggcaaacattaagtaagagatgtgcaactatgtgatacaggcacccttgagggttagggtttgaaccatgaaatttgtccattgtttcgccactaaaaaataaaaagaggcaacattgatgccaccatcattatccttgttaccgtcttttctcaagtaatagatgaaccaacaatttgcaagatgttgacacaccgtttagagctataatttagaaatcatttgtccaagagtttatatttttatagtacaagccattataagggtgtatttggttcccagtaaagattagatatgatatggccattcatattttcaaagatatagttcatgattcaattttttatctagttggatggatgggatgatccactttctttcttagatggacgaggatggattgaatgaaaacaatgatctattattaacaataaaatatgttaattcattagtattaacataatttttactaattaagaaaaaaaagaataattatatataatcaactctaaccttgataagttaattatcactaatcagttagtaatttttatcaagattagcaagggacattatcctcaatccgtcaattttgcaggatgagatcattcaacatattcgtcgaatgttccgtctcacagcctccgtgttcactactgcccactcactataaacgtgcacaaaatttgccacccttccatttaaatataatttaatgtgttcccttttttgcttagtggccgttacaacctgatacctccctaccaaaccaatgtgcttatgcttgccaattgccaaagtaatttcatgcaaattgccaatttgcttattggacagctgggatgaaagtgctatatctttactaccagagtacatgacaaagttctacaatacattgctgaacaacttcaaggagtttgaggctcaagtagatgtcagtggtcagtacagggttctgcgcataaaaaaagaggtatacctattatatgtactttgttggtccacaattatttcaagtgttttgatttgtccaagaaattacacattgaccatgaatagttcataaaaaatatatttttgatagcttcaaaacaatcatcatatcaataatatttgtcgcatgaatcaattggtataatgttttcacatcagtttatatatatatatatatatatatatatatatatatatatatatatatataaaagtaaataatggccgaaatttgtgatgtttgatttttttaatgtagatgcacactgtacataagtgggtggttggatggagtactagttcattataattcttagcacacatttatataacagatagttaaagtactgaagtacctacgttttgacttgtagtttccatcaaactaattttttttttgattgtataagtattttgactatggcttgtccaaatcgacaattagcatgcctggatcatgtacctttgtgttgagtactttcgtagtgcagccgaacaacaatattgcaaaatttgtatgactaattaattttattcacatgcgtgtagttccaaaagttatctgcatattatctccaagaagctgaatggtctcatcaaaattacaagccaagctttaaggagcaggtggctttgtctactttatcatcatcaatgccactactttgtgcaattactacagttggccaggatgatgtagtaacgcgggaagcatttgagttggcaacacaacataatagtgcagtattagcttgtggaaagatattacgcttcatgaacgacatcgctgcattcaaggtacaaatgagtaactcaactgggcttaatttgagtacatgccttgtacttccctgatttctcttgcggctgaatttttccatatccatcatatacacactagcaaaatgcagcctacctagtaaaggatattgatatcatactacttaattatctcttcaccaatattaatttaatggtggatagtttaatttgtcacataatgctagctacctgcagaacattgaaacaaggaattccaagaaaacctagatatgtataatgtaactgaatcatatttctctttcacaaacatgcagtctggaagaaagaacaagggagatgccacaagcaccgtggagtgctacatgaatgagcacaaggtaacaggcgaggaagccatagccagaatcgattcaataatagaagatgaatggaaaaccctaaatgaagttcggtgtgagcatcctcagctactccctgcggtgcaacgagttatgaatttagctatttctgtgcccttcttttacaacaagaggagcgatgcatacacatcctctaaatatcttcataagattgttgaatgtctctttgttactcccattcccatatagaccatagtttatcagctaccagcaatgtggccatatgtctatgtacttttatgatgtcggtggctatgtaccacctgtaataattcttatgcgtgtatactgcacgtacattggtaaacaattaaaagtaaataaaaataccatgctcaaaagtgtataaccatttctgatgtggctaaagaattcgtgcaagatggtttacatgggtcattggagattcctcgggttaacataagtgttaggaaaagctttaatagtaagagtgagcgaggtacaactcattcgaatttgtcagaaattgaggtatataacattgttattggtatttgttacgatcacagataagttcacaagcgcccagttatcattgtagcaattcacctcagagtattccaaagatattgaatcttagggaacttgtgtgtataatctaagaagccggattcaaccaagaacaacaactaatggcaggcttaggttagagaggattcctatggattaattaactataccaaattaaggtaaaactctattgattgcttcgggcgccggatctcccttgatctgccgagttaaaccgacctgccgatcgaatttcgctcccatctaccgtagtaattggcgtttaaccaaagcagaagataacatcagagagtatcaaagctataaattagtcatttgcctaaatcatgccaccgccattgaatcgaataaccgatggcaacatcgcaacaaggacgctgcaccaaccggtaacctccaatgcgacaccgttaagaacatttcaacatttgggatgtcaccatcgataatttggatacccagaacagggatttaacttggaatgtccacccgtggaacaagtgaggaagtgggtgttgggacatcacatccagtaaggtgtgtggggcccatgtttatcaccattgtatgtccttgagaagcccacgatgatgatgctggagtggcccatgatgatgatggcgtctactgaccaagagcggcaacacagaagctcggctgccagaaaggttaatggaagatgggctagagggttattagccctcctgcggcattttaaccattgccacacatatttctcccgccgtcagttctcgttgcaaccacgttcatcacaatcattgtcacgccctacagaccaggcccaaccagatccagatttagacaatgtggccctcctatcctgccgcttcatcatccatagttgcagggtaccccatcgcagccatcattcaggagttgaggtgagccaatataccacaatgccgcagccggatctattctcggagacccagatatttggactccccacgcacctatccctacctacaagtgcccaccaccgctccgcagcatggcaccactcccacaaagccgctgccacctcaaatcacggccgtgcttgaatgccttgtgctaccatggagattgccttgctgccggcgggcctctgatggctcgtacaggcggcggcgaggcaaggagggagaggggaggttggttggtggctagggtttgaagtaggtgtatatatctctaacgtccaacacaacatcccgtatgttatagttaggtcgtcaacattttatccataaattgtagttctctcaactatttggaagatcgtttgatcctacagtatcgtcgatgaacaacgtgcctagacagctttaatttttaatccacatagctccacatggaacccaaccacaacctacatctactctttgatctggaaactggaattctagcgagtaccttctcttctccttgtctaactccaagttgatagtctgcgtcaccctccgcctgcggagagtgtcgggcatggctgatatttctggttcttccttgctagtggagccacagtctgtcacgtccctacatgtatatatgtggaaacgagctcatctagctacatcgttgtcaaaatcgagaaaattgcactattgggactgcaaacatgggggcttcgctattttgacactctaagtaaatgacaaatgggctcatctgtgtctatgaaatgtgggtccagtgtccttatagcaaaggttaatgtttgcaatgtcataattgcaaatccaccgtcaaaatgaagtgtacaaaatacagactagtctttttgtaggcctcaacacagggatgtcctcatctgaaggtcagtgtatgaatgtggtcaaaagtgtcaaaagtgttaatcaaaagtagtacttcctccgtttctggttataagactttctagcattgcccacattcttatagatgctaataaatctagacagatagcatctatatgtagatgatgtagtcgtcaagactaagcagaaggatgatttaatctcaactcaaattg

SEQ ID NO: 18022 - DNA, 1944 bp, Oryza sativa
  unsure (1)..(1944): unsure at all n locations
ctcaaattgggcgcaacatcgaagcttacgtagatgatgtagtcgtcaagactaagtagaaggatgatttaatctcggacctagaagaaaccttcgcgagcatccgtgctttcaggatgaaactaaaccctgaaaaatgcaccttcggagtaccgtcagggaagctgcttggttttatggtgtctcatagaggcatacaagccaacccggagaaagtcaccgctatcctcaacatgaaaccgccgagctcccagaaagacgtccagaagctgactggatgcatggcggtgctcagccgattcgtctcacgacttggcgagcgggggatgcccttcttcaagttattaaagaaaacagacaatttccagtggggatctgaagcacagaaggccttcgaagacttcaagaaacttctcaccgagccaccagtcttagcctcaccacacccacaggagccgctgctactatatgtatcagccacctcctaggttgtgagtacagtcttggttgttgagcgtgaggaagaaggccacgtccagaaagtccagtgaccaatctacttcgtcagcgaggtcctagccgactccaagacgaggtatcctcaggttcagaagttgttatacggtatcttgatcaccgttaggaaattatcccattacttccaaggccactcggtcacggtggtcacatcgttcccgctcggcgatatactgcataatcgtgaagcaaatggacggattgccaaatgggccttagaattgatgtctttggacatatccttcaagccccgaacctcaatcaagtcccaagcattagcagattttgtctccgagtgtaccgagtgccaggaggatacccccggagaaaagatggagcactagaccatgcattttgacggatcaaaaaggctttcgggcactggagcgggagtggtcctaatttccccaactggagaaagattaagttatgtgctttggatacatttttcggcatctcacaacgtcgcagagtatgaggcgctccttcatggactacagatcgcaatctccctggggatcaagcgtctaatagttcgtggagattcacaacttgtcgtcaaccaagttatgaaagagtggtcctgcctcgacgacaacatgacggcataccgacaggaggtacgcaaactggaaaacaagttcgacggactcgagcttagtcacgttctccgacacaacaatgaagctgccaacagactagccaactttggatccaagcgcgaggtggccccctccgatgtattcgtcgaacacctttatgagccgactgtacctcagaaagaaacgactcaagttgcggacactcaagacatagccatgattgaagccgactggagagagcccctcatacgatttttaacctcccaagagctccctcaagataaagataaagccaagcggatttcaaggcgtagcaggctttatattattcatgaagccgagctatacaagaaaagcccttcaggaattctacagcgctgtgtatctctagagaaagggagacaactgctgaaagacatacattctggcatatgcggaaaccatgccgccgcacgcaccattgtcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaa

SEQ ID NO: 18023 - DNA, 1722 bp, Oryza sativa
actacccacaattgggtgaacatctggcaaaagttggtggggatcctgcaatcaataaatgggaccagccttttgtgttgggagttgttgatccgcacgattcattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaatctaattatgtcccctactgttcttaaaaaaaactctttaaaggtcattgttcagacttcggactacctgcatgtgcattgctaatttgtctatacttgcgctggtgcctactttagaatgaaccctcgaattttttccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatttgtcctgttgtttttaccactgacatttgcctcatttagatttttctaattcaactctgtgtttacaccattcatattcagcttgctgcactggaagatattaggaggactattcgggagctgcaaattgatgacaataggaagaaggaattgacaaatgccctccatgcacagttcaaagattggttatatggtaagttttcatctgtacattcagttgctaatgcattcatatctcctttatgcttgttttagtgccatttgcctatgatggttttgcctaagtcattagaattgcaccttgctttctgaaatttagtctcttcaaagaaacagtgtcaagaatcaaattgtttgctttgaccatacaaacaaatttgcatgaatggagcgctcagtaatgagtaattactgctcagcatgaggattcttatgtactgttgggtagctacaatcaaatgtgcacactaatacagtacaaacctgtcacaagaatatatgattgggtcaacctagtagcttcaataagtgttttttttccaatataggtgtagtatagagtatgacggccatacataatgaacttgaaccattattctgggcttccaattccacatgattctgaatccgttttattcagcatgtcagctggagtattaagtacaacatacctacatctatactactttaaaagcctcttgtg

SEQ ID NO: 18024 - DNA, 5013 bp, Oryza sativa
agatggctaggggcggtacgatggctattgaggatagaggagaggagagtggaatgatggtgctggaggtgaagggaggaaagaggcgcggccatgcggtgctggctaactcagttgggggagttggcgatggaggagagggtgtctgcggctgggggagtttctggggagagttgttgagatagctagtgttagcagattgtagatgggctgggcctttcccagtggagtacggcggtctggcaggttgtctggtaatgtggtatacccgtgctgtattgatggaaacgaataggagatgttaattagatggaaaatctacatcgatatggcaacagtattcagtgcttctggcaagctcaccaggctaaaatggttttctaattagataattttggacttcaaaatgtatgtgaaactttttttaggatcccattgcaacataccggcaatcacctacgtatgtgaaactaattctttgagtttcgttctactttatctttttcatgcacatcattgctgatggtatatatggcttgctcaattttggtgagctctgggttcccctaaatcacattttgttaatttttcagcttcaggcaacatccgccagctctactgcctgcaaggcgactgaacatgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgattttttttttagatttagggatgattttgtgaatgacttggggattgtggatgatttttttggatgggcaattgtagatgatttgttgtgcataatttgtgaggatttgagggtgacaataaatggaagcagaaagaaacaatgaccaatttttccaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctacaggcaaattgatcagcctccctcgtgatgcacggtcaggtcgatcgtatgcacgtacaaagccttaaacatgtaccagctagctataggcgcgttgtggggcatgcagcatatcaatgcaatgatgcagcatggcaaagggcttatgcatgcatattcgatctttggcgatcgatatgactaattacgtggataaggcgtgtacatacacgtccttaagcgtcttctaattttaacacacgcttaaattatggtttggcgaatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggacacaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgcctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggtttaagtaaaaaaaatattatattgttaatataaatggtaaaataatatagttttataaaaattattttcaaacatttgtgaatctaatttagacatatatatatgatgatatatataatctatgtttataaagttataatttcttcaaatttattaccactactaataattacaatttcgtctatacatgtagaagagaaagaagaagaaggaagcaaatgtaatttttaatgacataatttatatttttatgtttttccactttatctttttaaatgtgtgttgcagttgtatatgtattttcagcttttttacaagttgtaagtacgtacctttctcgtcggtgcgctgagagagattaggagagagattataaataggatttaatctaatggtcggagataacagatccatcaatttaattaaaaattgatggctagatattgtagttttttttctcacattttctagatttttttctaatttattagagtatattttaagtttaatacgaattttgattttgtatctcatctaacctagaagggaaaaaaaggaaagaacaaagaggagggtaggtacatatgtacgtgcacgtccatggagtgatagaggactttgggtgacgctaatgggcgatcgatcgcctggagcgatcaacctccatcccctcgtataaggtcctctcccctttcctcctccccttcttctcttcctactacaacataatttttttaaaaaaataaaaaaacaaaattaaaaaaactgggctgcaggaa

SEQ ID NO: 18025 - DNA, 2342 bp, Oryza sativa
atgttaggtgctctctaatataggccattcattttctttaaaatccatgcaaattttataagtagggtgacgtatatatacaagatattctttttggcttttttttgtcagtactatgtattcgtgtgtacgcgggattttttttgggaggaattattttttaatagatgtgatctgatgctataaaataactcgttcaccaatttaagtgataatcgaaggtcggaatttctagaatctcctattataattacataattttaatacgaagatgaatgatcaaatatacactcactcaaacaatgtcaatagcataaaaaagcagggttttaaatctcctgctatagctgtttgaaaagggttttagctatttgctctcatgtataatttagccgctatagctctatttaacccactatagctgccgctatatctgtttaagaagctaaccgctaaatgtattagcccgctatttaaaacatcctaaaaaatagaggttgtagggtaaaaaaggggtaaatggggagagtgaaagaaaggagggcacataccttacctgggtacaaacgggatgaagcaggtgtacgtacacacggtgagatgagagggagggactaactcttcttttaatctaatctaaatctaaaataaaataatagacccaccaatttatatctcacattgtaaaaatatttttattcatcagtgaataatggagtaagtacgtacacaggatgattctttttggcttttttaggtgaatagtgctatatatttatacgtacatggtttggaaggtattatttttttatagatctaatctaatgtataaaataacttgtccatctaatttaacgtgaaaatcgaggattgaatgttttattttattctcaaaattttttaatactaagatgcatataaatatacgctcaaaaatatcaacggcataaaaatgagatgatataaatactcctatattgtaaagtatttcagacaaaattaaataaaaaagtttggggggagttaaaaaaaaggtggggcacgttcaagtatgttacatgcgtgccattgggagggaggcgtacgtacgcgctcgtcagatgaggggtggactaattaactttttctttaatctaagctaatctaatggtctaaaataatggacccacctatttaagtgaaaatcgagggctagatatttctaatatattagaatactacgtggcgatctaagagtatttttaggagtcccacatggcggcttgagagcgtttgtagaaagtttaatggacctttagtatataatagatacagattatttagagacgtgtctttacaatagttgagacgataaaggctctaataattaactcaaaaaatatttcttttgttaatattatttttatttttttatcctcatgcaaccatatttccatattatagtgattaatagttgttgttaagccgttgttatgcataacaacaatgttttatctttactctttctctttcttccatgtcaacaagtattcctaattagcaatgctaagagaccactattgacaaccattgtacatgccctaatccctattttattttctggattatgtagcttagctaccgagtgacagaatatctgaacctggactatttagaagagagttgaagatagtaatcgttgtagctaatataaactcttccaaatagtgctaagtctgacaaaaattaaattactaaaagtatatatgcataaagttcaaaaaaagtatagctgcatatatacactacttaaaaataacttttgcaccgctttcttcacatgcggacctgtatataaaaagatttaggaggtgtccaataatggcccagctacaaaaatttattttcacagccagatctcttaagaggtttgcatgcgaattttggtacccagttggctcccactccttttctctcctccttgcgttaaatcatttcttctccctacttatccctcttctcctcagtcctctcgccctcttctcctcgaccgctagatccggtgatggtgaaggggtgggtaggggaggctatggatcggacgcgtcgaatttgtcgtagcggggagtgtgacggtggctagggtggtcacgacgacaacagcagccttaagggcggtgaattcgtcaatcgtgccccgatcagggtggatccagtggctatggcgactgaggggcagatccaccagcgatcttgcccctccatcgcttttccccctacctagtaaatatgactttgtaaacgtggcagagtttcatgtgagaaggacacttttccatgccggattgaagggctgcaggaat

SEQ ID NO: 18026 - DNA, 2472 bp, Oryza sativa
tcctgcagcccaatttacattcaaacttttgtatttgttgagccttttcttagtcagcttttagactatatatattaatacgtgataaattggtaagtttgaaattataaaagtgatatataaatgtgttaacgagtttaacaatttagctcgcgagctgagttgagctagacttttaacttgttaaggttagcgagctgagtgaactgacttgtgacttgtaaagataacgagttcaaacgaacctgagctggcttattatgcagccctagatgagcatcttcggatgcagccacaagagggaatatatcatcaggattttcagtaaaagaaaaggagagagagatcatcaggattacaaggtagtccaatcggcccctctactacttcaacagctgtcgttgtaaattggtctattgcatgtctacgtacacatatatacaagcaatgcattttttttaaaaaaaacacatacaagaagtacttcattagtatataggtggtcacaatccatatcctctagaatgggatcgatgtatagcacttcaccacacaaattctttctatatgttccacatgactatatgaggctctagtaggagaaggtagctaggatgtaagccatacatatatagcttaattaaggttgtacactactcctgcctgattgctgctgtattattggctagcaacatactgatgctttgcaagcacatcagctacaactaaaaaattaattttgagtaaatttcataaaactacatatattttgatcaaattatcacaaaactatatatttaaggttatatatcataaaattacagatttaaaattaaatttatcataaaactacaaatctaatatggagtattgcaaaactacagatttaataagaaagttatcacaaaactacaggtttcagagtttagatccttagcactagtgttatgtttgagttataaacatgtaagttttgtaattaaattgtcactaaacctgtagttttatgataactttattactaaatatgtagttttacgagtactgtgaaaaatttagtgttaaatctgtagttttgtgataatttgattaaagtatctgttgttttataaaatttactctttaattttagagacgattttaagtttttcatcatataagtatattttagcgttgtcttttaaatcatcaagaatacatataatttttactgataagttatttttgttaattgttttatttatttatttttaatcggtgaggcacatatatattagtcagtatcactagcacatattagaagacaacagaacagcacgcaaaatctatagaaaagtttgcaacagtatgtatgatctgtcaagagtcgctgtgatgacagcgaaatttttgtataggcatctcccggttgatggaagaatccatgcacagcattttcagagatacatgtgccctcacacgaacggctgcaacggcttcagcatgattaggcctagccaataatcaaaacgtactgtggcttcttgaatatttaatttagaactttattcgagggttttttttaatttcttcgtcatttccattgcttggctctcttttcatgattgttgagaagataaattttttttaaaaaaactcccctgaaattatatctaaaaataaaattttagaatacaaatcgctttaaattatactacaaaggtgaaataagcttgcaggcctatcgttgaaaaaaaaaacttgactagagaatattggatgataaattacgcttagtctggttacttccaaggctacaaggtcaagccactaaagaatattgaatgataaacaacacccaatctctagtagtctcggacatggaatgcaattttttttacaagaatgtccctcttttccatctcaaaatataagacattactatcttttagaaaaattattatttataacatttgtctaataattaaagtcatatgttataactagatttgtatttagaagtacctatatgacgttaattttctttttaaaaaaatatatttagaaaaaatattgtcaaagtataatgttgcattgtaaaccgtgtaaacagttaataatgtcttatatattggtaggagctatatgagaaaaagtttaactcatagtatatatatatatatatatgaatgaaaatcttttttcacatttcaaacaggccgattcattgtcgacctcaaaagtgaaagcatatatggacatatcaacaacagtactatagtcacttcaagaaagtgcgaggaggccaatacgtacgggagcatgacagtacaacatgtatacttcacatcttttcctcatttgagatctctctgatgttatttgagaggaatatttttgtatacggcttattattaattcgcagccacatgtttggcagcacatgctatatattagatgttgtattatcctgcaagctaggactgcatgctg

SEQ ID NO: 18027 - DNA, 5321 bp, Oryza sativa
ccggctaagtacagttttgtcctgatttactgtacctgctgatgagatgcttgagctcatgcaagacagctagaaacatcaccagtgcacgtgaaaaccaaaaggtatgtgggacgtcctgtggtaaataaaatttaattaacccagcacaggaaaagcaggagagttttattcttcggtgatagccaatctctccaaaaaaaagtatttgttgggtcctgtggttaataaaatttaatccgttctttctgtactattacagaaacgctacttatttgcatttttaatatatgatgccgttgatttttgacatatgttcaatcatttatcttagaaaaaaagtacgaattaccccccgaactatcgaggtcgaccgaattacacccccaaactcgaaaatcagacattctacaccctcaactattgaaaccggacaaataacccccccgactcaatccggagtggttttgggtctacgtgacaggccagtcagcaatttttcttaaaaaaaatcaatgggccccacctatcagttctcaacccacccccccccccctctctctcttctcaccagcacggcggcggccacgcgagggcgggagcaggcggcgctgccggtgacggagggcggcgggcggctgagacagaggcggagctcgtcgcgcaggttgccgtgcaagttgaggcggcggaggagcacgagtgagccgagtacggacggcacgtacccggacaggtttttcccggcgatctttcaataagtaaagccaaaaaagatcatatcaaagtacgacaagtcatggaatttaaatggaagacaaggagagaagacgattcgattttatttttcaaccagttatctttcactttaaaattttaaaacccaagatgcagcgctaagagtggttttagtggtgtttttttaccactttactaaccatcatgctattatatgccatgcatcatggtggctaatatatataggaaactgtatccacgtttcgcactgttatttccatcatttcctcgcgctaaagtgataagatagggagatgcggggaggaaagggaacaaagtgtatgatatgatgtgtccagtgttagctatttaatacaccctccattctaaattgatctacatatagtttttttaagattattactaaatgatatacatatttatgttcattcattaagtctatttgttatttgtgcattggagtaaatagacattaatgcatgcatccatgcacacaaatatttataacccacatgcaatatcttgatttgctattggctaggaaatagtggggatggtgcatgcatcgagtttgttgctaaagtaaatatagtatgagagagttattagtttttttggttttagtgtatctatgaaatatgtacatcaatttggaatggagggagtagttaattatagtggcggaaaatagtgttatatactatgaatcttaaacggagatttatgagccctattttttcacataaatgaaaatattaacatgttccatttataaccgcggaacaacgtacattattattacacaaagattaattgaagataagtattattcatacatatacaaatatctgtgacgcaatctataggatgtgatatacacctacgaatataagtacgtgaatttttttaaaaaaaaagaatcttggagtaaattattaacgtgatatagctagtttaatttgtgatagggaattaaggatacatagtcatgtcaccttcgtcatatatattaattattcactctcgatcgattgccaagtaattatattattaacacgcatgtggtaaacggtatacccacatacagtgacatggctagtctgatagagaaggatgtacagtcaagtcaccttcattgtcgattttgccaagtagagtaatttttttaacgcatggtaaaatggtagcttagacgtagacacatgtacagtgatagctagtctgatagagaaggatatgtacagtcttgtcaccttcagatttggcattggccattttgccatacacttgtacgtgccgattcacacgcttgtcgatctgtgactgtagtagtgtggcaagtctcggtctctctggcaatgaccctgcttcaattcatactccactggtaattttacatctatatatatccagccgtttattgagatagagacgtgtaacggggagagcaggccggtctaatccatatatgcatatttgtgtgaacgatatataggcacgaatttacaaaaaaatatcgggtattctgacttttaatttctaatgtttgtttttagagtaaactttataaaacgatgatttgaccaaactatcacaaaacaaatatgcgttttttttaaccaaaactacatatttagtgtcaaatttatcacatatctgcatatttaaggcatctacagattatgaggatattaagaactatacattttatagtttatatccatagcagaagtttagtttgtgataaaactgatgttaaatctatgtgattttctaatacaaatctattattttgtaaatgaaaattatgttaaatccataatttttgtgatacaaatttttaaatatatagttttgtgatatacaaagttgaaattaatttaatcttgtttttaatgcaaaaatttataaatactaaaaaagattacgtattacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttttttcaaattcattctgaaaagttttttttttccggatggagtacgttttaactttgcttgcgtagtacctatagtagatatttcggtttttgattttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccaccatgattcaccccaaccagccgctggcgctgtccgcggcgaagaacgcgagcaccgtcgtcgtcggctcgccgctcctcgcggcgtcgccggcctcctcccccgcggcggcgtgctgtagcagccagctgcagcagcggcgagccgccgggcccgggaggaggggcgccggtaggctcgcggcgccgaggtgcagcaccatcgagcaggccgccggcgtgtcgtcggccgtgacggtggacaggacgctgacggtgaccgccacggtgaccgtgcagccgcccatcggcgtcgtctacgccgcccgcggcatcgacgacctcaccgacctcatcggcaagacgctcctcctcgagctcgtcagctccgagctcgacccaagtgagcagcacaacatatccatggcttagccgaagctccatggatgcatggacaaacacatgtagtagtaattaacaccatgtctatgcatgcagggacggggaaggagaaggagacggtgagcgcgttcgcgcacaggacgatgaagcaggacacgtacgaggcggagttcgccgtgccggcgacgttcgggccggtgggcgccgtgctggtggagaacgagcaccaccgcgagatgttcgtcaaggagatctgcctcgtcaccggcgccgacgactcctccgccgtcaccttcgactgcaactcctgggtccactccaagttcgacaaccccgaccgccgcatcttcttcaccgtcaaggtactacaaacatcgatcgatctcaccatcacaccatccatgaacacttggaagcatcatatcaacgacgtctagcgcggccatggatcgatgcagtcgtacctgccggcgcagacgcccaaggggatcgaggcgctgaggaagaaggagctggagacgctgcgcggcgacggcaccggcgagcgcaagttcttcgaccgcgtctacgactacgacgtctacaacgacctcggcgaccccgacttcaagatcgagcacctccgccccgtcctcggcggcgacgaacacccctaccctcgccgctgccgcaccggccgcccccacaccgagatcggtaaccccacctcacctcccagaaatttacatcattttcacatcaaattaatcacctat

SEQ ID NO: 18028 - DNA, 8190 bp, Oryza sativa
caaatataataatatttataatattaaattagtttcatcaaatcaataattaaatatattttcataataaatttgtcctaggttaaaaatataactacttttctctacaaatttggtcaaagttaaaacagtttgactttgaccaaaatcaaaacgccttataacttaaaacgaagggagtaataatgatcgaagacaaacctaggacagcttagacctgagcctatgtttatctccataatcatgctcaaaaaatttctggctcagccactgctaatggattaaatgtatatgtaattaattagatccgcggacggagaagaggagggggccggtgtacgtgcctcgggacgagcagttctcggacgtgaaggggatgacgttcagcgcgacgacgctgaggtcggggctgcacgcgatgctgccggcgctggagccgctgctggcgaaccaggagctgaggttcccgcacttcccggccatcgacggcctctacagcgtcggcatcccgctgccggcgcagctcgccgccgccggcgccgccactgccacggccggcggcgccgcggcctcctcctccacctccaccaacatcgtcggcggcgtcatcccccgcctcgtccgcatgatcgaggacaccaccgaccacgtcctccgcttcgacgtccccgagatgttcgagcgtacgtgataattaattaattacgtgccatgattaaaggctaatcggtagtactaattagtactccctccgaatgtattttaatgtataaccgtcgctgactttttaactaatatttaaacattcgttttattcaaacttttttataaatatgaaaaaatttatgtcatgcttaaagaatatttgatgattaattaagtcacaataaaataaatgataattatataatttttttaataagacaactggttaaatattgaaaaaaacttaacgacgacatatattaaaatataaatatcgaggtagtaacatgttgattaagctatcgaggtagtaacatgttgattaagcaatggatcaattggatttggctttgcattgcgcaggagataggttctcgtggttcagagacgaggagttcgcgaggcaggtgctggctggcgtcaaccccatctgcatccagctcctaacggtagcaccgccattcccaaccacatacactattcacctgaggacgacgtcacttttcgatgacgtcatcccccaaaaagaatgaattttcgctcgtcccgtcctggtcatcctttaatgtgtagtggcgaacccagaatttttatactaataaatatttcaaaaaatatacatatgttgatgtctttaggagagaaaagatatatagcagtagaaaaataaacaaggggtacagtggcagatggaaaattttttacaatgggtattaaaaattatgtagtatttaaaaaacatgttagagactttatatgacaaaaaaatgaaacagtacaatatttgggtaaaagctgggtggctgagactaggaatcgaacccaagatccataatgggtatattaaaaatcacgtactccagtatttaaaaacatgttagtgtctttagcagaaaaaggattcaataataaaaagaaaatatgcatcctatatgttagcatcatactcccttcctcaatttatggcatgaagttatacccatcttaaactctcaactgagttttttgctgatgtggttttgaaatttaaaaatatatatataactaacaagttgtaaatgatacaaacaattcttttaattaaaaataatcatatattaaccatacggtaaaattttaatgtttatataatcataaaagtagcccatgaattaaatgcacaggtttcctaaaatttatatgcagaaacttttataatacatactattttatattaaaaacaattgaattcgaatctaaattaaaatctggcataaacttttggtgtaaaaattttaggggtataaactttagttatataaacttaacaaaaaaataaaaatcgcgtgacaaaaaagaaagtgtggccgttcacagtgtgcaaacattagcccttttcgctagataatttccctctcaatatttagctaaaaggttttaatggctttaaataaatgacactattgctttttctaatttctaggactatttgtcatttgttagcatcatattcccttcttcctcaatttatggcatgaagttatacccatcttaaactctcaacttagtattatgttgatgtagtttagaatttaaaaatgtatatataactaacaagctgtaaatgatacaaaaaatattttaattgaaaaatagccatatattaaccatatggtaaaaatttagtatttatataatcataaaaatagcccatgcaatgcataggttttaaaatttatatgtagaaacttttaatacatactcattttatatattaaaaaaacatttgaattcgaatccaaattaaaatcggacataaacttttgtggtaaaaattttaggtgtataaactttagttatataattaaacttagcagaaaataaagtgtggccgctcgcagtgcgcaaacattagccctttcgctagataatttccctctcaatatttagctaaaaagttttaaatggctttaaataaatggcgccattattggcttttctagtttgtatgactatttttcatttgtagaaatatttgtgcaaatagacaaacatacgagtcgtaaagtattattgatgacaaatctagtggtatccctttttttctattttgcttaacattgaacgaatgtctgtttttaaaagttttgaggaaaaaagtctcaaatggtgtgagtagcaactaaggaaaaccgaactcaccaattaattaatggcgatcgatcgacgtgtgcaggagtttcccatcgtgagcaagctggacccggaggtgtacgggccaccggagtcggcgctgacgaaggagttgctggagagccagatcgtggagtcggtgacggtggaggaggcgatggcgcagcggcggctcttcatcctggactaccacgacgtgttcctcccctacgtgcaccgcgtccgcgagcggccggagacgacgctctacggctcccgcacggtgttcttcctcaccggcgccggcacgctgtcgccgctcgccatcgagctggcgcggccgcagtcgccaacgaggccgcagtggaggcgcgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaactccatcaagcagtgggcgtcggattacatcgacttctactacaagtccgacgaggaggtcgcctgcgacgaggaggtgcgggcgtggtgggaggaggtgcgcaccaaggggcacgccgacaagaaggacgagccgtggtggccggcggtggacacccgggacgggctcatcggcgtcttgaccaccatcatgtgggtgacctccggccaccacgccgccgtcaacttcgggcagtaccactacggcggctacttcccgaaccggccgacggtgatgaggaagaaaatgccggtggaggagaacaaggaggaggagatgaagaagttcatggagatgccggagcacgtgctgctggacaccatgccgtccaagatgcaggccatcacgatcatggcgacgctggacatcctgtcgtcgcactcccccgacgaggagtacatgggggagcacgccgagccggcgtggctggcggagccgagggtcaaggcggcgttcgagaggttcgcagggaggatgaaggagatcgagggcatcgtcgacgagcggaacaacgacccggagctcaggaacaggtgcggcgccggcatcgtgccgtacgagctgctcaagccgttctccacgcccggggtcaccgggaggggcatcccaaacagcatctccatctgagtttcgctagctaagatagctagctgcatttgggacaagattggagatggttaagatttgtacactaagatcatgtaccaacactaatagctcccgtgtatgcctgcctgccacgggagaggcatttgctagtgtgtttgagttactagaatgccacaaattagtaaagaggttattgaactaaagctcagttcgctgagttttctagaaattggcagtatgtcatgcggacggatgggatctgctggattcagcacatatcatccaagaaaaattactcacagcagaacaggcatgtcatgcatgtgactgaatcgagcagcattgtgagttgatcaggaccagcatggcatcgtgtttatagttcattggtcactggctaacgaacatcgttacccccggggttccagacaacgaactatacagctaagctgagacactgccaggatgcgtatctttttagaatgcaagacggttaggaaagataagggtattggagccgaccacaaaggcacaaagtgattagtcaggggaagataaggctggacctgcctgttagagttcactagaaagagcattccgagcagcatctccatgctcacgccggctcatttgagtccaaacttgtggagttaaacggttcctaatacatctagccacgcgtgacttggatgtaaaagagtccacttcgctcggttctctgaggtcaagtgatcaaccatgaaaaatttcaagtcttgtgcagtccacttagcacagcagctttgggtttctccgtttgaaactgacagggtgtgcagaaagtgatgcggcgcttgaaatacttgagtaccgctcctcgagtacagaaattgggggggtggagggaagggctttatctctgggagatgcagcctccggttgcactttgacttactaaattagagcaatgaaaataaggcttcgaaatgaagaatataagaacaaaaatggaagtgtgtgttatcgagtgaggtacctgtaaaggatggctcgaaatacggtctggttgttttgaaagagggttcctgagcatcaacctccaagtgttgtgtcgtcgtgctggtcttttgaagacctgtcgactggacaagcttcagtagtttgtctgttatgactgtcattggcggacggagctctggtgatttctgcattgaaggaagaaatacagccagtaatgatcacaaatatagggtgctgaaattcattcgatgaattcataaatcattaggaccgcagtaattagacatttttcagctataatccccttcaattcccatttaggagcagagtctaagcattaaggagtagtgcatgcggtgtttcaatttgcagcttggcttctatcctcaaggtagcatagttcaactaagtaatgtgtaccagaaaaaggtaacggacagttaccttgatgcagagtaagatgatgttgcctaacgtagagatagcttgaggtggcatagatgcatgtattcttggatcagttattctttccaaagaatcaaggttatggagatgaggagatgcccaatcaactagaaactgctcattctgccttcttgaactgaagaggaaaaagaacttcattagagaaccagactacagctgtacaagattaagtgagcatatacctgtcaaaggccttctgcccagtcaaaagcacgagcaaaatcacaccgaaactgtaaatgtcagccttgatgctatctgttgctgggtcagtaagctcaggtgcaacatagcctttaccactgttgagagcttctgagtcctgttttttcaggtgaggaactgttaacggtcaacggattatacagaagatatatcattgactttgaaaaacaccagtatccccttaatatgtgtgtgatttttctacccacttctgaagggaccacggttgatcctagtagggacacacacatatacatctttcaaatatttcaagggagagtagcttgttttgatataacactataatgtataggagtctatccagcgacctacctttgattttggttgagatgcaactgtaagcaatcgtgacaaaattccaaaagtatgggtctaaactggcttattattaatttagtctttcttccttttggaaaatagttcaagagctatagcgttcaccaaaggacataagcaccagcccggtgccttggtcttaggacttgaacccaagcagatggggaggttaaacagcctcaccatcaacaggacaaacccttttccctaaaaagctaactttatggatcgttttttctcaatgcatccttctctgtctaaacttaaaattccttatcgttaagtatgcagtaagaactccaagagattggcaatccatgacaacaattagatcctagaattgttcaagtaaaacattaactatatcaccatcactaatgattatgtacagaagtaagaacactatccaatataacatggaaaactagtgagcactgaccgttcttatggcactgacaaattggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtgatatgaaagaatgtaagtctatccaataatgcaacatgcaggaatgg

SEQ ID NO: 18029 - DNA, 10063 bp, Oryza sativa
ttcctgcagcccagaacaagtatatatatacatgattggatattacatacagatcctaacataaggatgaatattaagtgatgaacaagaatatatagaatatgtctagccatcaactacaattgcataagccggttatgcttaaactaataaagttccagtgctacctttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagtggaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgacggtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacgggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccaga

SEQ ID NO: 18030 - DNA, 5013 bp, Oryza sativa
tgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctcaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaa

SEQ ID NO: 18031 - DNA, 5488 bp, Oryza sativa
  unsure (1)..(5488): unsure at all n locations
gctttcaaatccgcgcctcccctctcctcctccgccggttgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaactgatgccacacaggaaccccgagaacatcccctgcgccgaagatcatgaccaggctgatccaccggagctatgcgcgcaaagaacacctatcaggaagctcacccggaaccggggcctggtgatgcagcaggaccagatggtggtcgcggagacgcccgaggagaagcagccaacctccaagcggaggcgcctcttcagagaccaacaatcttgaagcgaaaccccccctgccctgctcgtcggctgctgtagtttttagcactttagcgtgtgcgcctacctgctctcgtgttgtatgtagagggagagatctattataagttataatagcccgctgtggttttgcctagtgtctgtacaacagtcgggcgacatagctcatctcgtgctagctcgtgtaacagcttagatgtaactaatgttcttcttttaactctattagaatttagatcaggcagcttcgatttttccaaagatcggtggaattgtactcttgtagtgtgacgaaagatcgctagaatttgctccttagaggaatgtagcaccagtggctgctgcaatccttccgaggttttacaaggagcaccagtggatacagcaatctttctggagtgctttgattgccaggtacgcaagttagccttgacccataattctgagctacgactaaaaagattatctaaccaacatggtaatagtttcacattgaggtagaaaaatgaaagtgaagacacattggggtagaaaaatgaaagtgaaaacacatcgaggtacgaggtagcagtttagcaacaggaagcgcagacagcagatcatccttgtttgggtagttccaacaatcaacgagactgctcactttgccagagaaacagtcacagtagcattaattttatgaaaagcatagtaatcatcaaccacagtaggctttaacatcgcaggagaaaagggataacataatcacataaccaggcgtacgagaaatagctcaaaaataaaatgcaataaagaatccagaggtaaaacaagacagcacataagcctaaacggtcagaaaattcagcatcagccctcaaagtttcgagttacaatgactaatcgctacaaaccacaatggatctcaagcagcagctgatttccgaagctcattttcaccatgggcaaaatggcacctgtcgccaaaagtgcacgaccctttggtgaagttctcgcacagcttggtcttgaagttgcttccggggcctcccccgcggtgggatcctcccacaggtttcttgccttgtggaggggcaccgccaccgatgctgacaatcagctccctcaccattgcactagcgttcttgatctgatcaaatgtgccctcaagctcaatgtttttcaagttggtgtctgattcatgatcacggatggccagcttggcccctgtgactctggatatctgctttgtgttaaccccacccctcccgattatgccacctgcaagagatgcatcaacactgatcttggctgtggccgaagcgccaaagcttgctggagtggacatggcagggctaggcattggtggaggtgcaaagtgaccagtgggccttggtcccattgggggaggcattgagctatccatcaacataggcttgccgagctccctctcaccgtgcgcaaagtggcacttatccccccatttgcatccctctgcagtgttatacttgttgcacaggcgagtcttaacagtgggtgttggtggcccatcaggaacagcatttcccattggcattcttcctggaggcggcgcaatagctggaccaccaagattggtcatctttgcaacagcttggtagccaccagggaagtggtggaggaagtggcaaccctcaccaaaggggcaaccagaggtactgcacaataagaatatcatgagtgcaagcaaaaagatgctgcaaataatgtcctaattgaagaactacaccaaaagatttcattgtaaatgcaactgatgtttacttggaagattctaatatgtgaactttaataggtcaacatctcataaacaatgattggaaatgatattaacaagtgaagaacaaatgttaagatgcagtatggactggaggagatttctggaaccaccaccacatttaaaaacaacatggcagtaaactacattctaaatgttgagcttgacaatgggtgctaataagagatgtagaccatatgcacaaattttggtaatgactcataacatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18032 - DNA, 4147 bp, Oryza sativa
  unsure (1)..(4147): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggatagtcatgtgctacaagctcacttcctttggcaggctgatctccaagaaatacaagctgacaatgcaaaaaccagagattagttgtgtaagaatagcatatgtaccgctccaaggcaatgtgacggtatgctgcggtataagattgactagctgttcagtgtcaaggtcaataagttaatcagtctattcatttgatatattttaattttgatgatgagtttatgacaatgatgttttagcaattcagcacttgcgagcattaagttacttatattccagggtagaagtgcatcaaaaaatataaaggaaaatctttactgaatgcaaatccacattagtcacaatggatgatctgaaacatattaggagtactttatttgaaacatcaacaaaccttgcagacatgaaggccatgccaacaaagactgctttgacagcctgtttttgaccagcatagtcaaatgctagaggtaacatttcatgcaaagtgaggaaggccataaccccaccaactgcagaaaggcacatgggaggtcaacaaaatgcagaatactgataccagtttttctttttattaacagactgacctgaaccaagtaggccttcaagaacttcaggatttaagctgctcggaaacaagtaagctgaagcaatcacatttgcatcagccttcagcactcaatggatatacaccagaagaaaaatattacagagaagtgcatatgacatagcataccaacaatgatcactcctagtggctcagcgaaaccagagagggttgcaactttaaatgcttgccatttgctttgacatgtgaaaaaaggaacaagatataattactgtggtagaagaaagtgttacaaaattacaagagaactatcagaaacatgctattattgcaaattgaaaaggttaagcatcatttgccttttcgctaaagcaaaaccattagaaattattaatgctctgtaatcctccaagtgcaacaggtggaatgtagtactagcagataagagtggttcgccaatgactagttctcaaatcttacacacctatcctcaattcatgacttcaactagtacactctttttttaccagtaactagtacactctttttttaccagtaactagtacactcttttgtctatagaaaatctcaaagccataacatatattctttaatgaactcatttctgaaggctactgtgaaccatataacttaattcagttcctctctacatgggtaaaataggtacctgttggtagcaaaatagagtggtagagctacagcaaccccctgagaaggtgaaaaaaaaaacaactaattagggcttcagataaatactacagtaaatgaaccaagttctgtagaagttaaaagaagttgtccaagactctatcctgccacactcaacaatgattcagatacagctacattgacttgttgagatctagaaaatgtcataaatgttgcagcttaagggcatatataattaaccaaacttgagatttttttttccttgtcatgatttagtttgccataacgttggcgattcatattaaactgataaatgaaataccagatattttctaagaggcaaactttagatggcattcaaatctttctgcaagcacatacaacaagctagggtatcctaattagcaatatgcaacatcaaactgtagttaagaattctcatggaccagaaatgctgataagttgatttatctacctctggtatattgtgtaaagcaatagcaatagccaagttcagtcccacacgaaggccctgcagtttttcatcataacaaaacacattcagggcaagctaacaaatatccaacatgatatctattgggacacagaatgatattaaatacaactagcaactaggccaagccaactactcaaatacagtaactattggaacaccaaaactatgttatatagtgttatagaccagagctagtaaaggctttgaaaggtggttggtcccaagtaacttctattagatgaaaaaaatgcaagttacagatcccttcaacagatgaatgatgccactatattggaatgatgaatatacaaaagcaataccttcatggatcccaaaaatactgccatcccctccggaaagttatgcaagctgattcctgcaggctcataataagtatcaaatcagattgttgtagtatctcaaggaacaaggaagcaaagccacacaacatatatcaagaaacagtttgaataatggcctggtgtaagttcaataggaatgcatgtctggttgtatgcttagtgatacagaagtcttattttcttaccaacagcagtaatgatcccactgaataatacttgccgacgatgttttttcatcatatctttacccgaaccatcatcgtcagtctgctttcctcaaaccaaacatagagaactaaattctgttcagccttggtatttgaaaacagactaatatgattgtgaaaacattattaaggctgcttatttcaacctgcttcttgcctgcatcagctgttggcacaacagttggctctggaataaacttgacaaccaaaccaaagaaaagaactccagcaaaaaactgcaaaatattattattagttaacaatggttgctgcttattgtatgagatagatcggcattacattggcatggatactataagtataggcaaagcatgactgacccaaaggttgcccttcaagaaaccaatagaattcaatgcattgtgtgccaaatctagaaaggaaatgctcaacataagtccagcggcaaaaccctgtattcagtaacagcaagagatcaatctaccaagaaccaatagcaaaaccagaacttgcttaaaagatagtgaagttgctccattactatagagaacaaagcttatcacctgtagaagcccaagcatcttaagattaggcgtcggattcaaaatcacaaacagcgcacctgaaaaacagaaaattggagcttctaaagtgggaaaatggcacaaagaagccttgctggaaaccctccacatagtattagggacagttttaaaagagagtactcatcgctcaatgtcctgagatcattcacggtcgcaaattgttaaccaaacataaggaagtacaatgttgaaccctaggggttaaaagtttttgaccatgcaacgacatttattacttatcctgttatacatagtacacataagagaaaaccacaccctgccactaaacctgtccagttatgccacttatttacaaattacaacaccccattgctgaccttaaaacaaaaaaatctgatgaatcattgtgatcaattaattttcatattcagaggcctaaatagcaaaacattcatcactcacaagccaaaatggtacaaaagggagatactcactggattctgaactctctttcttaacaaaaatcctaaacactaattttcgatttgctaataaaggatgcatctgaattcgcatggaagtcacctatacgagcggtagcaagacagaattcgctatcgacacctgaaactcaccagaaacacagaaattcccaggaacgcgagattgcgagatgctcagccacttggcgattccttcaagcagcgagcccgcaagctacacaaaacggccttaaatccacccgcggaaccctaggaaaccgcgcccgaccgcaggcagagcagcatccaaacccccgaaacgaaactgttgagaggggaagaggcgcgagggggcggggccataccgatggacgtgctgaggccgccgacgagcgagagggcgagcgccaccagcacctgcgactccattggcggcgagagagagctagggcttgcagggtatcgaggcggggggaggcggggaggagaggagaggagagggag

SEQ ID NO: 18033 - DNA, 12361 bp, Oryza sativa
attcctgcagccctactcctgcgtccattctataagcttgagcggcagatggttctccatgccacaaaacgacttgtgttaaagatgtttaccgttttcgataaatctataacgatctgaatgtattttaaacaaaaaaaacaattaaaaaggaacaaatcaattcatatgctatatttaaattgccataaaataacggttacaagcttacaagtgtggatttgagcaggtacaacgtcagaaaacaaattaagcaacatgatatatatatatatatatatatatatatatatatatatatatatatatatatatatatatatatatatatatatatatatatatatattcaaccacaattcacaaacacgtagatttaaaatataaaccaaaaacaatcaaattagccaacgaattagatcatatatttttaaaaaaaaacacaaataaaccagccgcgccgccttctcccacgtgagacaccctctctctcactctctctctcctcgtcatcaatgcaggcagtaggcgaggaaggagagcacgacggcggcggcggcggcgggcgcggccgcgacggcggtggcgccgctggcggacccggggcccggcgcggacgccggggactcggaggcctcgaccgcggaggcggacgccgccacggcgagcagcacggcgcaggcgatcttcttcatctccatcccgggcggcggcggcgaagtgctgggctctgcggggtgggggaggagacgggtgatgttgtcgatcgacggcttctcgggctgcaggcgcgcggtggtggcgttgagctgcgaggcgaggcgaggcgcgcgggggattttaatggcggggcgagcggccatgagcgaagctcggggtggagcttcgccaaaaatgggggtggtgattagtgggtttgccaagataggggtggtggtgattagtggaggtgattgctcgatgaagttctaatctaatggcgtttgccaaatttcaatcgaattttgctgtttaaaccctaaaattttcaaataccattcgaacccccccccccccccttctcaaaaatatgatttctagcctatctcgaaatcacagaaaatttcgcaaaaaccaaccagtttttatcaagattgttcatgcgaattttattcgagcttcccaaaccattcagttttatgaatagttccgtttgaaatttcatcagaatttagtgaaaatagtgctgtgcctcacaattcaaccccaaaacgagattgcaaacccgcctctcgtccctgttgatgatgcattcttgtttatatcgtttacaggcgtaaaaactcaagacagctactggattaacttatacagaaactagatcacaagttcacatccaggaaacatttaagattttgattatacacatatgcagtgatgctaaagatcggccccagtttcagcaaaagagcaggaagttcagattccagcctgaacttgcaccacaacagaagcagccaatctcacatagatactagggatcagaatatcagacaatctgatctgtcaaagataggcctggttaacaaactcgatgaaacagaattgcacaagccacaagggaggctgcaaggcgaatcatttgcggttcttggaacgctttttctcgagcctctgacgagcttgctcaaactcctcttccgtgggctccgagctgctgctcccctttgggtcacatttggacatgatggatgagagcaccgagtcgaaccggtccttccgctgcgccctgcgctgtgagatcgcgaggatcagatcgttctcctcgctcttcttcttgttcttcctgtgacgaggtttgaggcaaatgcagtagtgagcaactgatggtagacaacatctcggaaggcggattacttgggagataagagaatgagagcttacttcactcttctctctaatgggtttgtgggaggttcaatctcggagatcttcttggcccatttatcatatgcttttgttgacttcagctcacctacaaaagggaaggaaatggaaaggagtttaaccattagagaagtttcagggaatagattgagttagcatgataagctaaacactttgccagcgcttcattgtagaaaaggaatagaaaaaggtattcaatattatatgataaaattatatggcaacagcatataatcatttaccttcagcaattgcctcatcaattatatctttaaagcgatgggaatcaagctttggatctgagcaaatcattgaacaaaaaagcctgcatacaagggcaccaaattaaaatagaaatggaacccaattattcacttgcaattcattgccttctgtatagaaaattaatcaacactaaattttgtaagccacctgttcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgtctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatccccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatcttcagaatgaagaaaggaaacatcaaatgagttacttgtgttataaagaaagacaaaactgaagcataacaattgtttctgattgcatatgtactttaggttcctttctacagcttcgcttaaaaataaataatttaggccgattccactgagctagctgcacctgcaccacagacaactgctgcaggaagccagcaatgccctttgctaggggtcactgctagggaggtagcagcacaataagtctcattggttgcccatattctctaataagccatataaaaattaatttataggtaaaacttttatatatttgttcatagcaacttaaaatccaacactaaaagaaactacattgaaaatatcttaaaatcaagttcgaaaattcaaattttggcttttgctttggcttattaggccaaccgatggggctcttaagttgcaggcttgcagctagctcagcctataggagccactgtttctggttgcaatcttatgatttgtggcctttttaaagtcaattacatgaatttccatgaactctttcagctcttctttggcacttcattaagcttaggtttcagcaacatttccttcagtctagaatttttttaaaacgcgctaaacagtctagtagtgtgcgccaattaattacaatttttcagcacagatcaagacaaaaaaaaaatactgatgtctgaacagctgggacatatataaggtttattgaattaagttatgcaagtaaggtaatgctattgtacttgcttttaaaactaatagtggtatagcttgagatcaaccgccaatcacaacctcttgtacctcttggctcttgcacactttacccagtcattggtgttttctgattgatcagatgatatgagaaaccctttttatttgacaatataaatttttaacgagacaagctagcaaggattgaactatgtcctcaatgtatgtgcatagtagagagttagaggccctatcacacccagccacgtaactgtttgattgtttgacatttactccagattccagaacatgataaaaattagatttaaacatcagttgaccttcataaattctgtggcagtaatacttaagaggaacaggtatagctcaaaggcaagaatgccataccatcaaagagcaattggcaggaaggccagcaagatttaaagaagattaagtcactataaaatccttggagaggtactactactgcgaagcccaaaactagagctgaaagttaaggccaaaccaataagcactctcccatatcagtcataaggcttcacaagtgaaatgtgagccttcaagcaactgcctccatgtttgggatacaaaatgtttttcctattgcataagtacgcacttcgtactttgggttcatcagtagcataatcttgcccaattgtttttgcacattgaaatggtacacacagttgcttcaattcgaggtaatctggtatgcaaatatgggttatacttgtacactagtactaacacacgatcaatccgcgcagcgaaccacgaaattccccaacgggcggaacctgacgcgacaccggataaacaagaaaacgaaagctatcccgctatcgcatcgaacaatcagatgcgctcctcaccctcgaatcccggaaaaaaaagaaaaagaacaaaaaaacatcgatccaggcatccagcacacgattcgatcagaccaacaccaccccgccgcaaaatcaaccgctacccgtacgggtaacacctcgtaagccatagacctagggtttggagttggggatttacctcgtagaggctcttgctctctgcggcgaccggcgcgggctcctcctcctcctcgccgtcgccgtcgcgggaaaccctagccctcctcttgcggcccatctggtggaagcggcggggtgaagaggactagtagtgtagaggagaaggcggctgcggcggcgagatctttataggtggagatggcgcgggtgcggggaaatttttcccgcgctttttggttcgcgccgggatttggcgttggcggcgtctcgtcgaatgaaccacccgccatggggatggagggttcgatggaaaatgcttgtacaccggaggtgagagatcacttcacggtgcagttgtaaagagcgtgtggtttccattttaaaatctcgtgtttaatttttgacatgtttatcaattcattttacaaaaaaaagtttagaggggtatctctcccttcaaatctcgtttttatacaatggatgtgtagtagagaggagagatcagccacacgagcatacataattttgcaaaattcctttagcatgtgtgctgggtagaatcggtacaatttgggtagatagaatttgtctttaaaactagggctcgaataaatgtctaagtttatttagggcacatacatagttaaaagaaatatatgcgatgtggcataagattggctagagatctccaacaccatcatatatgttacaagaaagcttggtacggttcgaccgggtagtatatcaaatgttacatactaaaccgagttttgtcctaaagaaaatgataattataacggatgagtaatgagttagagctcctccacagtagacgaagatgggaaataacatgaggaatttggttaagacagtactccctccatcccataatataagggattttgatattttgtgtgcactgttcaaccactcgtcttatttaaaaaaaattgtgcaaatataaaaacgaaaagttatacttaaaatactttggataataaagtaagtcacaaataaaataaataataattctaaatttttttaaataagacgaatggtcaaacagtacaggcaaaaagttaaaatccttatattagggacggagggagtacaatgttgtaggaatcttctttttctctacgtattaaagcttgttagttaggttttatcaacaactcaaacaataccttataaatagtttacttatgaaatttagacctaagagatcaatatcatctgctcaattgagatcccctgcagagcatgtgcggtacttcaggctgacatgtgggcccgagggctgtgggcccacatgtcagcctgcagtactgcagacgacttgtgtccatcatctgctctatactctatgctatttaaacaaaatatgtagagctaggtaacaattatctgcgcactggggcggaaaacaaacatggagcaactagggttgaaaccctatacctagctccgtaatccttattatatttttaaaaaaatgctatataatttgtgaaaaaaatagctcttatttgtttaggctgaaatcgctccgtaattcttattatattttttaaaaaaatgctatattattcgtgaaaaaatagctcttcattagtttagccctatgcgtgaaaattttcgagctctgataccgtttacacattcttctttgcaaaatagaatggaataaatggtgcatatttcaggttctatatatgcaaggatcataaaatttatcagatactctcatacatgtaattgtccatttgctgcttctcacaggagtatgctgaaatgactcataccaacatatattagttcacccgggtatctaacgttttgatgaatactactctctccgtcccataatataagggattttgagtttttgcttgtagtgtttgaccactcgtcttattcaaataatttatgcaaatataaaaaacgaaaagttatgtgtaaagtattttggataataaagtaagtcacaaaaaagtaaataatgattccaattttttttaataagacgagtggtcaaaccgtataagtaaaaactcaaaatcacttatattatgggacggagggagtacaatacaagatcttacaagcgttggttaagaaaaagacaaggagaaagtacatatgctgacatgtgagtctctttccatgtgtcagtggctcaattacacaacagttaagtcagatgatcccttttcattggagaaaattgacatttagccatcgtcaggatggggtttcgccagaatgccactccggattgtggcttcgttataatgccattttcgaacgacgccacattgctactttgccatttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagccttccccacccacgccggcgtcgtccccttccccgtccccgtccccagcttagctggcgtcgtccccgtccacagccacgccatcgagccgtgctgtgtatatgcaacggagaggaagaagagagagatgagataggataaagggtattttagtcatctcagcaagaaaaaacactacaaaaatcattaaattgagaagaaatggataaaatggcattacaacatgttgcccctgtttgaggatggcattttaacgaaaccacttttgggagtggcattctggcgaaaccccatcctgacgatggctaaatgtcaattttctcttttcattgagcacctatattactaagtgcatgtatgctatgccaaatgtttatacctagcatacctaattagctggtacgaaatcaacgacttaatccaaacccttatgattgaactaaatcctaaaaatgtattcttacccctatatcaatactaccaatcatccatagttaaaagcaagttggtctgaccatattctttatttttattgttttgtacatgataaggtatatacatgacgcaataaggtagagtgctatgtcacaataggtcgtctcttgcttaccatgagaataggtttatggtcctctagtttttcatctactccacatgtggctctcttcttctttttatttggctccgcttataaattttattgttcttaatacataggtgcgcaactcttttgtgtattaaaaaaaataattttcatgaacacaagagtgtcaagcaggcaaaaattgttttatatctaggacaacctatatgtttcatttataaggcaatatgattttatagggaatggttatgaacatgttgttcttttcatctacaaaagttagcaacaatttatacgattatcatatgaacacgttatctttttattttataccggttcatattatttcacagtattactgcaatagaaaaaaactaaattccagcactataataagaaaggatttaataattaaacacaagtatcacaccaacaataaagagaaggaaaagggacacgctctccctctcctccatcttcttccccagcaagaaagaaaaagcccctactttttataaccccacatctcccagggacccaaccgcaaaaccccacaccctccctccgattcccatccgtccaaccacgatccaacggcccacaaccccaccacgtggcgtaaatacacgtcgaggcgaggggcaaaccggtaatttccccgtcgccatcgggggctttcttttttatcagtgtctctctctccccccacccccaccttcccctgaagagagagagtgagagagagagagagagagagagaggagacgccaccacgcgcaccgagctcgcgattccaatccccgcacgcctcctccgccaccgccgcctcggcctccgccgccgccgcgaccagggttagggtttgccctcttgctccccctgcctgattccacccccccccttgagtttgtgggtgacccgtttgatctgtgggcttctttttcttttttttgtttttttcttggggtcgattcgattcgatcgatcgatccgcgtggtgctggtgttggggaggggggatcggttttgggttggtgcggggatctgatgtggggggtcgttgtttgatttggtatttgatgtggttggttattggttattgggctcgaggggaaagcgtttatgtttgattttttttttcggttgtgtattaggctatgtgatctttcaggttgaaatgattagattcgcgtgagtttcctgatctttttttggggttgatttgttgtagaaccgtgggcgattaatcattactcggggtaaatgtgagtgggtaaaacgtgttacagcagatttacggtgtttgaatttgatttcgtcgaaatggataggcgcgtttggttgataagatgaggaatccacttttgtgatggcgatttcgttgcgcctcatagaaattaggatcttgtttcataaagtgtaagctcgccgcagtgggttataggttattttaaaagtcacaattatatggaaatttcgataggaaaattgtagcaactaggtgcttcttggattatcttaccgcccgatttaattggacactagttgatttatccgtatgttaaattttaaatttgtttcttatacgcatttcggtattgagttttgcattgtttgtttgatgaacagatcacagttgcgatggaacacaaggaggctggctgccagcagcccgagggcccaatcctttgcatcaataactgcggcttctttggcagcgcggcgaccatgaacatgtgctccaagtgccacaaggagatgatcatgaaggaggagcaggccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttgggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctcacacttcttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggttttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgacaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgttcgattaatttcctggtgcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataattgcacaacattgcactgaactcagtaaaaattatcctacaatttcagaagaaacaaaacgtttcctctttggctgcatattctaaattacagtatagtaaggacaaccattattctgaattcttgattctttctactaatgagtaacctctttcaaggttcaagccccaaggttgaagtaaaccgtgtagaattcgtctctcaggctgtacaatggttcaagcaggaagttcctcttcaccccctttgcaatgaagctgataggatggtactgcctcaatggagcagcctgcacaaagctcgcggcctgctcgaaaatcccgttgatgcttggaagagaact

SEQ ID NO: 18034 - DNA, 3838 bp, Oryza sativa
ctggattcttgtgtgaaggtcaccagctgtgagttgtaggatgaagggactggagatatccagtctgaaattgcgctggtgttgccggcttctgcattccaatcaccagttgacaggccagctagaacaaatggcccgaataggattgcttgaagagatgcatattctggccgatcatctgatgtcacagcatagcagttaacattgagatgaatattctgactaaaataaatcacaatagttggtgtatgtcacatcgtcacagtttcatattcactattagcttatgattttttatgttaattgataattttcggttgaaatgtcaaacaattgtatgtgaactaagcaaaacacattgatgcatacttgaaaatagaagaaatttcctaaaagttgagttttgaccttttattgcttcagtccttagtgtaatagggaactgtagtgataaatgatcatctgaacacattgatgcatacttgaaaacagaagaaatttcctaaaagttgagttttgaccttttattgcttcagtccttagtgtaatagggaactgtagtgataaatgatcatctgagttccactgtttggagattgaaaggaaagaccctgcccacaaaacaataaagtaagaacttgtctaaaacatgatcaaggacgattgaaatggatatatttttttgttcatgcactcaaaagattgtacctggagacattaatcctaaatcgttgtcatttagagttgcttttgcgccattggcagatgtccatgatggtattctcacattcaatgtggcagactgaccatttgtctgcataagtagaatagaggaagctaactgctgcttctttcatctgattttcatgtaacatacattaaaagaaattacctttgcagaagtggagagtgaaacttgaagaaacatgtccaaagagctgattggctttagttgttgattaacagtaagcccagctgctttccagttataagcacttggtatgtactgaatgatgtttagcaccggtctatctcctttctcctcgaagtaaatggaatcgccaagtttcgaaaaggattctatccctgtaaatgaaatagaagatccataaagaaacaggccacctgataaattgcctttcaattcaaattttcacaacttcgaatgaaaacacaagcaaagtaatactaaaatcacggtattaatttgacaaactgttaccgcaatattttcatgtaaaagcagcagtgttaaataagcagaactcagaagcattttatttacctgtcccataacaacaccagaaggagtcatactttgttccccaaccatgataggaaaccgctttagaccgtccaggggcctgaggtagcatgtaaatcatcaccccgggatcagtccctctttggatgcttaaaacaccatttatcagtgccctttcataatagtctgcatatgataattcctttgtccatctgaataggttgcgagaaacctgcagtagattgcattgaacccattgagagagagagagagagagagattgaatgttcaggagagtggtttgatattgtgaaccttgagcatgttgtaggttgtgcaagattcctcattctcagtactcagagtatcagctaaacgctttggattggtcctgaataattatatagaagtagatagtcatacatcaaagagaaatatactattgactatgaattcagaatctagagtaaaattaccaaaattcaccagcagatgtgcccccagtagcatagctatgagaagaattgatggtatccatgaaaaacgttgcaatttgctgtttcatgagaattatgattacaatcagcttttctctcaaatgatgttagtgaaaagaattagaaagaaaaacagatagtataactccagtaaaaaacagcataaaaaaactccagtaaaaaaccaacacatggctttgacatacagctgacaaaaaaagggactgcatatggataactacagagctaataggtaatgaaaggtataatactgcccaaaaactatagtttacctagagaaagcatgggttagcaagaaatatactattttccccggattatgctatcacacttccaggcccatatctggaaatttaccaatatcagcaggaaatatgcataatctgtaagcagaataaagctatccttttcctttcagccaagcagccaatatgaccactaaaaaaaagtaaccaatatgataatctaaactattagcattgtacattcatatccatatccctggacagataattcatcttcatgtatgcatatggagtaaatatccagaaagaaaggtttgtgttcttttaccttgtaaagaagatcaccagtaacttcatatctcatctgtgcaccaataacaactggaatgtgtgtattggaatggaagcctgaaatactgtcggcctgaattgaagcacactcaagatttatcagtcagagacattactgcaataggaatactactattcttgtatcctctggaatcagacacccaagccaaaagttctaaacttcattttaggtagtgtctttgctatagtgggaaaaatataatgacaaaatgaacagtagaattgaaataatagatccatttggcacgcaaacatgtagttatattgattttcaaactgccaagtgccaactcaaaactggatattaggtaatccataatttttgacagttagtaaaacaggtaaattgctatatgacaaacaaggttgaagttgaatgtaagttggtctgagtcattcaccataaattgacacatgttcatagatgatacagaatataagaacaaaagcaggtaagaaaataaatcagcagacctgaactgcaagcaacccaagaaaacatggcttatcaaaaagatgggccagagtcagatgcttctgatcattctgcacatgcaagaaaactagaaaagttagcaactccactagagaaaattgcattaatcaaggcagtattcctatctcataacaaaccgacaatcaccgttatcgtgtagagctgatagagcacatcattcatcccaccactctcctcattgagtgaagcccaatgcctctcaatactgtatttctgtatgacattcttcacacggtcactgaagtaattggccatcccgaccaccaaatcaagggccttagaattcccggccaccgtatactgatcaagaagaccttgcataatctgcaaaccaagaattgcactcatgtagcaagacaatgatataatatagtgatcaagcaacactaggaactgaaattcccccatataccttgtgaattgtatagtaaggagcccaaacagccttgatggactcaaccctgtcgaagaactccgaggggaaggccgacaagtaccccgatcccatcttcttctggcaatcatggagcgcgtcgacgaccgatgacatcttcgccaggagagtgtcattgtgtgtgctcgcccacatcttggcagtagcactcaggtagtgtcctgcaaagaacaggcagcaaagcaaagccaccgcaaattcagaccaattgcgcgatttcgctgtgcaagtgatgccgagaaatggcggtggcgcaccgacgaagtgtccccggagctcgacgccggggccctcccacccgccgtagggcgccccggacgccggaaggccggcctgcgtgcggaagctccacacgaggcggtcgacgtcgaggaggagcaggtactccaggttggtctgctgggcctgccagtacacggtgcccggctgcagccgcacgtcgtgcagcgacgcctccgccaggagcgc

SEQ ID NO: 18035 - DNA, 28949 bp, Oryza sativa
ctaatcaagactcaagaacaccaccacactaccagacgcatcaaatcaatggaatcctccaagaattccacctccatttatgcccccaatgattgggcgatctcaaccaagaattgcacggaaagcaagccgcaacaactgaatttcaagaacacgaagccctccttatcccctcggacagatcactccctccgagtccgatgactagtcaccactaaccactgagccagtgattcttggggagaagaggagtagaaatcggcgcccttttcgtgggcggataagcggaaagggggcaagaaatacgcatcaatcatcgggtaggatgagagcgacggcttgtgggatttcttgcacccaaagagcagcaacgacaaggagcgacatgaaagccaagccaccattgatgcatccatccatccattcgagatccaacaaatccatttccggccatccccgtgacactagcagtgagcgccgcttgcttgcacgccggagctaccgctcgtcgtcggattacgacgccggcattgtccctgtcaaaatcgcagcaacggaagctggccgcggcgaggggcgtgtgcacttcacacaggcatttttctccaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggttgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcacaaataatcccaaatcatgcaaaagccaccgaaaaccttagtttaaggtaatcttttatcatgtatccaagctaatatacataattgctaccagaatgaatattttccatttaatgaaattctcagttttgacttttttaaatccctagtgaaggatcaattatggcttagatatagtgaaattggcgaatttaaaactttaactacttgctaaacaaatgtactctaccatggatataaataaatatataaatatactttttataaaatatgttattcatcatttgctattggaaatattcaacttttgattttatacgtggttgtatgttagaattcaattattttaaatattaaaaagttctaaggatgctttataaaatctactgttagagtaggtggggcagtaaatttactgacactaccattagtttttttaagaaatatatagaaatgaggttcacatccgctactgtaatgacactacaattacatagaaatgtgataagcggaagcaagtctcatgtttggaccaatatagtactttgtaaaaaaacggattcgtcacaagtgagcctacaataacacaagcagcaactagtaataagaagctaaccacaaaattgtagagagaaggggacagggagaaggctagcagccaataagaagcttggcagtggcgagaggcggggagaagggtgcatgtgtcgaggacgatgcgaccacaatgtggtgcaagtggagttgacctcgaagacgatgcggcggaaccgcacgtgcgcctctacggacgagaggcggagctcggggacacctgaacacatcggcttttgagcagctcgacagggggtgactatgagcttgggggataggagcttggacagcgtgatgaggtagaagcctcatcactcacgcgtgcaggtgaagacgacattgcagttgtggttgggacccgcgccgcaccccccctgcgtgcgcaagtccatgatgtgagcgctcccggccgtcgagcttttcctcgccgaccgacacccttctccccacccattggcggatgcccaggaggtttgggttgagatgggaggaggggagtgaagtggaagaagattgccggttaacttgtggggtccacgtgggactcagccaccacatcaacaaaaccgaaaagcaatactaccttgggatcaaaagtgatccgatccggttttacaggattagaggtttcatggccttttaaactcaacaagaagttagggaaccttagatgaacttttttgggagatgaaaaattccagcctcatgggcctgtgcatatgacccataggcaggcgacgacctccgcctccccaatccgtcccggccgtctcctcgcccgccggccgccgccgatctccatcctgccagctgaggtggcgccggcgtcctcctgctcccgccgcattcgctcaccggtgagcatcctaatccatcccatccggcctcggcctcggcctcggatttcgcctcctcgcccgccgcttccgccgcgagcagaggtggcgcccggcgtcctcctgcttccaccgcatcgtcgctcgccggtgagcatccttccctacccacacctcatcagctattctgcgttaagcgttatccctggttcaaccgaaacagggttagatctgcctctgctcagttccacctactttcaacttgttaattttgatttttgtttttagcggatgtaatttggttactgaatatcatccacaacccttagaatagttgcattagaaagaaaaatgtaagctcatataatttgtacttatccaaactcagtaactcacataaaaatttcttaagaagagtagtcacacacaatatctttttatcaaggtatattcttataagaagttttcaacaagatttgcttgaaaatttgagtctaatttagcaggcagaactaagagagcatggtggcgatggcgcggtggccgtggagggtgctgctgccgctgcttctccttcactcctcccccgtcttcttcgtcttcgctcaaggtactgcgacccccgtcttctctctcttgtggggcggcgcttcctcttcgccccaccacccccaaatggcaaatattggaagtgaatcatccatcatacagataagatgaacgcgagactcgtcatctcattcgaccacctcagtgctctgcatccatctgcgataccattggatcgtttctaacacaagatatttggatctagagccagccttggatcctattaactgctccatcatgggttcatctcatgaaatttaacggaaccactccatcctaaattttctattcagcatattaatttcatggatcagcaatgtcctaagtttcttttcattccaatcagcactacgtctacacaaaatggatgtttcctttatgcttcctggtagactaagtatcctttttcccctcattttttcagaaggccaagataatgatccctctactttgttcaaacgagccttagaaatgatgaacctaaggaaatatgatggatcacttggtctgctaaatgctgtgctggaggttgaaccaaatcactcagaagcttacaggcagcgtgcatctgtgcttcgtcacaagtgcaggtaaaaaaaagttgtatccgttactttagattataatccattcatgtttgattcacatctgttcctcagttcaaagttactgaccagaaaaataattacttgccaccgccagatagctaaactcccattttctcttgtcctaaaaatgtctaaactttattattaaaaaaacatccatatctgaaagactccattaaagaaccgttaagcatatgtgcctacttataacattgtcagttttacacgtatgtgtcacctttccgtatcccttactcgtttcaatgtgttttttctgaagtctaggtacaaggaagcggagggtgactatagcaaatacctggagctaaaacctgggagttcttcagtggaaaaggaattatctcaactgcttcaggctcaaaatgcattagagtctgcttatggccagtttgagtctcatgacttctcaaaagtcctggattacatcaacaaaattgtgcttgttttttctccagactgcttaaaggtatatttcagaggatagtaggaaccatggacagataaatatttcatctaattttgtctcagtaagctgcagtactaaaaatggatttttcaggcgaagcttctcaaggctaaagcattgctagcacttaaagactactcaactgttatctcagaaacaggatttattctgaaggaagatgaagataacctggatgccttgttgcttcgtggccgagcatattactaccttgctgatcatgatgttgcatccaggtaaagcgtgtctggtattttagctttgcacaagtgcatgcttgtttgtgcctgcacacacaaatgcagtactagataaatgtgctagctttaaatatttgtacagtgatgacaatattaattgtttaggcactaccagaaaggccttcgtctagaccctgaacattcagaactgaagaaagcatattttgggttgaaaaatcttgtgaagaagactaagagtgtgagtatgatttctttgtatcaacaaattaggggcttactgcatcatagtaataggatcaaatggtgtgcatgcaggctgaagataatgctgccaagggtaagctacgtgtgtctgctgaggactacaaggcatccctagcaatggatccagatcatacttcttacaatgtacatctttatcttgggctatgtaaggttctggttaaactcggaagaggcaaggaggctataagtagctgtacagaagcactcaacatagatggagaacttgttgatgcattaacacaggtgacattacttgcttggcatgcacagaaatacacatttttctaatttagagtggaaaccaaagttcttattattcaatgttgaaacttccgtgaaaaaaagaagggaatttcagtctgattgccctgcaattaatgttgaatcttggactccttccgcactctgatgccacattattgagcaagctgcgagcatgcagacatgcagtcgcattagcctgtccttctaattctgtattttaaaccacaagacttgggaaatctgcaactgctattcagaaaccacaaaaaatgtaattcagtatgcacaaataatgtgttttgactttatgagtgaataagtgatgcaaaaaaaaatagtaatgtatatttgtttggtaaactaagttatgcaccagacaatgcaattgaattagttgttatagccagatctcgctagtctcttacttcatctgcttgttgtatgttaccttctactggttgcagagaggtgaagctaagcttcttacagaagactgggaaggagcggttcaggatctaaaagaggctgcccagaaatctccccaggcaagttttatgtggacctatctcctttttcccctaccctcctaggcaaatgttagggataagtgtgctcatatatcagcatatcttctttttttgtcctttgaaaacacacatattgctatttgagttcccatcaaataatctgcttatgtggctacgcagtgtgctgatctcatttccttttagatttgggaacacaatatttttagtgtaattgtgctgcaatcaaattatcgtgaaacatagttccaaatggatgaaacatctagttttagtcaattggatagacaatatgcagaaacaattatttgttttttacggtagtcatctgatgatacttttacttccccatgatgtatttctatttggtgcccttctgccagcaatctttgttatccgctttttgcagcgtgggttcgtaggttgcatatgtttctctagcacctatgcatgcagtggatgagttgataaaactagatttgcacattactattgttagtactactaataataaagtgggccaccgaagaggaactttatgccaatgtatttatgaataagcaacaggatctcaggattttaaactagtggaaaaggtgagggcggtcagaatttcgaacatgggtgagccccgcttgacggctgccccttacagcacagttctcaaataatattgatagttacataaattgcttctcagctatattacaaataggaagttaacttgttgcttccctgtttctttaacctcaggaattgaatccaaaggtcatgtgcttttaatggaatgctttattagatttatctatcaaacagacttggtctctgccctttttctgtatttttttggtacaaatgtaacagtggtttgcactgttcatgctcaggacatgggaatccgagaagcactaatgagagctgaaaagcagcttaagttaagcaaaagaaaagattggtataagatccttggcatttcaaagacggcatcagctgcagagattaagcgtgcctacaagaagttggcactgcagtggcatccagataaaaatgtagataagcgagaagaagcagaaaacatgtttcgagaaattgctgcagcttatgaggtataaataaacaaaattgaactgtactaagtatttaatgttctatgagatgacattttctattaatatggttaatttaaaatactctcatgcattccaagtttctagccctggtgttgtactatgaataagaactagctgaagtgcatttcatccacaaaatatatcatgctagacactgcatgtgtccgagacaaaaagtgtcccaataacataaattctggtcacccatatttagctataggcatgcttgtttcgaatcagatcgacatgctgcagatgccacgcgtgtcttttaacaatgcgcaatcggcaatttgcaggttcttggggacgaagataaacgtgtaagatacgaccgaggagaggatcttgatgagatgaatatgggaggaggaggaggtggtggtttcaatccttttgggggaggtggccagcaatacacattccattacgatggtggattccatggaggaggaggattccccgggggcggctttcctggaggctttcagttcaactttggatagaaagtttactgcctgtggagttggtgtttgtatgtttgtttgtttgttttaggaacgctgataagcttaacaacaggtattgattgtaggcagtcaagccgatcgatcgagatgagcatcgtatacaagtgttgttttaagcaccatcaaattttcctcaagttgtatccttccttgggattttctgacgcatatgatccaattgaaataaacttagccttacagtggagctagctgtttcactttcactagccaaggatttgcgccgaaaccataaaaaccgaaggtccattccatgtattgtgatcggagtcggcacgtaacagaaaaactaaccaaaaaaaataacttaaatcctctgaagaaacatttgaaccactcgctggatcgtctagccatcagtcaaccatgagcgtgatgtccaacaatctccatgttaactgtaacatctgactatctatatatctacatgttgtactgtaacatgtgactatctatctacaccgatcaatctgatgatcgcttactttctctattttatattgtactagcaaaatacccgtgcttcgctacggtgtattaaaactaaaaatatttgattttaaccgaagttattttcacactgctttggtacttttgctcgctagaaaaagtctcaaatgatagaaagaaatatagttccgaggaaagggagataaaaaaacaaagccggtttgatttccacctttatacggtgcgagtcaacatggactctgaagatatgggtagatctacggggtggctcagcagcacggtcgaccagcgaataagcgagcaaactcagaccaatcgacggccgatcgatgaccgtagcacggtaggtagcagccgcatctggccgtccgcttcccttccgcgacaacaatgaccgtgactctacgctattattatttcaatatttcttatttttaattctagccttcgtcaaatttctacttcacaaaattaaacttcttttcttcggctgagggacctagaacagactttttcccagcctagctggtacttttcttcggccgagggacctagaatagactttttcccggcctgccggtcagcccacggcatattatgcgcacgtgcgggcactccctcctccccaagccgcaacctggacctgggctggggaagctgcccagcacgcgcctctacttgggccggtttcgatccagccagtgccggccgttcgatcttagggtttctatcgaatagccggccgccgacgtcggagggacaaaagcccatccctcccagccgtcggcgaaaacccaagcctctcgccagaactggagcggacggcgaaaagcagcggcgccggtgcatgcctcctcgccggtgcgcacactcgcccaagggtgagggcgccacctttgagcagccctgccccggcgccgtccccgtcgtctctctctcatcttccgcgcggcgtcatcgacggccggaggcggtggacttcccttgcgcgtcggcaacgaccggcggcgggtgggctacccgcgcacgtgggtgacgaccggcggtggcgaaggacttcccgcgtggcgtcggcgacggctggcgttgaggttttccgttcgtcattttttaatttttggagcttttcttcagggatccaagaccccctttttcctacagacaaaaaatcaccggatggatgaaacagattgtgatgaaaggaaaattatgaatattttaattagttaagataagattacagccggtgtttttttttgtttttttccagatttttttttgtgtcgtacgaatcggactttttgagcctgtttttttttccgccgttctcttctttttacggtgcgttttctttttttttttctgcctggtttttttcgctctttataaattacggacgatggaaacattttagattttttaagtagtataagtagaagtagattagcaaatatacccatgcgttgcaacgggttaactaaaatttaaagatttgcattggttttaggagtttgaggggacaaataaagggagctaaagcgaacttattccgtgtggagcgtacacgcggcctatgtggtggcccaatagtgtggtcggcctgggaacaatttggggacaacttgagggatctaaagtgaaattttttcacgcggagcgtacatgcggcccaatagtgtgggcggcctgggagtggcacccgacccgacgtgggagaagcagtagccgtccgatctgatggacggtcctgattgatcccaatctatataaaaactcataagtctaaaccctaatcctaaaatcatttccattctccccctctctctcagccgctactcccctcccctcccgtcccccaccagcgccgccgctccctctccccctcaccggtggcgccgctccatctccccctcttcctcctgtctcgccggcgcggcgacagggaaggcaccctgccggttcccctcggccactccatcccccttcctccacaacgacggggagaggatccaccgctcctgccggttcccctcggtcactctctcccccttcctccacggcgatgggaaggggatccaccgctcctatcggttcctctcggtcaccccctctcccttcctccacgacgacggggatcagcgacggggaggggaaccaccgcctcggccactccctccccccttcctccacctgctccactggcggcgctctccctactggcgtggagccagcggccctccgccccttctcgcctccctctcgcgccagatccagcggtggcggcgtcggtggctccctccgccccctctcgcctccctcccacggcagatctagcggcggtggcaatctgctcgaccacatcgccgtcgtggcactcatcagcacctccgcggtggccatgtccgaggcgcgcctcacgtccacgctcaactcgctggcatcggtggttggcatcgccatcatcgccttcgtgctggccgcggggttttccacttcgacaccagcaacctcgcgtcgcccttcttcccctcggtgctgcgggcgtgttctgtgcggcctaatccgtactcccgtcgccgtcaaggtcgccgaggggaggggaggggaggttgccattgttgtccatgaggtcgaggtcaccgttgtcgccgaggagaaatataggaaaaagtgaagaaagtgctacgaaatagaagaattcgcagtcacgatggtatattgtagaaggcgtgcggattaggtggtaaaacatataaggcatgcgtattggatggtatattatctaaattctccattatatatatatatatatatatatatatatatatatatatatatagtggaatgacaaatggccctacacatatttattttaattctaatgccacataagcgccacatcacagccacgtggaacaaagaccgggtcaatatagccatgtaggcgccacgtcagcggaactgtcttccaaaaccaccgaagaagtcaaattgcactagtttcaacagttgagggtcgagatatccggtattatggtttggggatacgaattagattcagcctccagttaaggaagccaaagtgaacttattccttgggaaaatgaaaaaaaaaagaactcagcccaagttggtttgcagcccggcccaaagcaaaaccaaaccagaccttcctcctttccgtgggccgcaggtgggccccaccttatcccctcgcgcctcgtgcctcgtgccccgctccgctctactcactgaagagcgggccccacctgccccgcctcagagcagcatccggatccggatctggaaacccgcttcccaaatccggcgcccgtacgcccgcccgccactaccgccgcggtgcccaccgcttcgcttctctcccctcctctccaatggcggaacccccaatcacagcccactcctcctcctcctcccgccgcgtccccaccgcaggcgactcccccaccctctgaccccacctcccgcctccccgccgccccgcgaccgccgcggatcgatcgaggggattcttgccacctgggatctctcctcccctcccctcccccgattcttggtctcgcgcgtctgtctgcccccccgtggtggattcttgtctggctcccggcaaaaggaacggcgtctcgccgcgggccgcggattcgaccaggtgcggtgctggaaccggcgccccgtgtgtcccagatgttaattctttttgtttttattgttctatatacagtggttgatttctgaaccgatccgttgttcgcttggttgggggaggacagagagtttgtttgcggagatagttttcgaattgcgtggtgaaatataaaatttagactagtttggcttatcttggcacctccgcacctgcattgcgccgttgagatgtaacgttgttgatgagctcaattggtcgggttgtttttttttccccagatctggatggttaggttcttcacctggctaacaagaaagatgttgcttttagctgccctggaattgttggtactttctgcgggtgcatctatctgatgaaattgagctgcattgttctggggagtgtttgcttctgctcattgcctcatagggcacacaatgacaccaaggagttatagaattaccgtctcctggaaatccttagtttaccatcctgttatgattttgctcaaatttagccatcttatcattggttatgcgtcgtggaattccaagttgtactgtcctattttacttttgtcaaatgtagttatccatcatatgttatgcacaacatatgctcaaagaagcatttttactggctaggttagcttaacacatgctgatcagtatttttcctttacagttcaatgcacctcaaccctcaacttgttgactagcttctgtgctaaactttgtgttgcaggcatctcagtgtccacggctgtaatttataaccaagcctaagaaacttacattattctagcattcattggatatggtatcggtgaatcttgggctagtacattatgtactggaccacatatatggtaccgtccttcatcgcaccaaattaggaacgccatttttctcgaaaggatggggaggcaccaaacttgatttgttagagaagatggtgaaacagttattccctgaagcacgttgccagaactggccaccaactgccgtgcaacccatgtggaaaacggtttgggagacaaagagttcttgtctgcgagagggtgttttcaggactacatgcgatccacggctaattgaagcattgcctcctgagagtcacaatgcaagagttgcttttcttacacctaagtcagtttcacctgagaagatggcctgtgtgattcatctggcaggtacaacagtttaatcctatttatttgttctatactttgatgtaccatgcatctacatgtttttttctatataagagactattttcaagcctttagatattgatgtttgtacactagctgaatgttgtttatttcatcccatcggacagaaataaaagttgactagatttgatgtttcaactttccatattgagtgatctgctttctggttctaaatattatatttcatatcatgccatgttattaactgatgagttgcaaaaatgttctttgtccagctgttgaaatttgatctgggcttctaatacaatgggtcaagttaaacttttatctaatattacaggcactggtgatcactcgtttgagagaagacttcgacttggtggacctcttttgaaggacaacattgcaactatggttcttgagaggtgaggcttgtatagaatgccagaatggttgtcttacgccacctttgataccaaagcttttttcctaacccgcaagatctgatttctcaaatgaattccagcccttattatggacaacggcgaccaagcatgcagcatgggtcaaagcttcagtgtgtgagtgacttgctactattaggaaaagctactattgatgaagctcgcagccttctgtactggttgcagaatgaggctggttatggcaagatgggcatatgcgggctcagcatgggtatgtaattctaaagttttcatctataattgaataatgtgaatgctttaagtcttaagcaacctgcagcatcccatttatcaaactcacccccattttcgtggcaacttcgtttcaagattcctttacaagtattgatgtgatacatttttccctaagactggtaactgagatgatttttctcaaggaaatatcttttatttcacctcaagtactttggccccttctattaatttctctcttgcggaagcgctcctttttctatttatttggattgcttattgacacggaaaaaaatgctatatgatagataatgaggttaactctggcatggctttttttgggaaaaaactttatcttgacagtagttaagtaccatctacatatgaaaattgctgttatttcttacaagcgtctcatgctaattacataggtggtgtacatgctgcaatggttggatccttgcacccaacaccaattgctacgctgccatttcttgctccgcattctgctgtggtgcctttctgtgacgggctctacaggcatgccacagcttgggatgcattgaggaaagatgcagcaacattggcccaagacgtaacttctttgacagaagacatggcccagaaatcaggaatcactattgagcaagtaagagagaggttgcgatcagtgctgtctttgactgacgtcactcgatttccagtgccaaagaacccacaggctgtcatttttgttggtgcaacggttagtgtcaatgttctatcatcatttctcaaacatgatttacccttcctgtgtcttatatatttcagcctagcacgtaaatttcttgataagagtaactcattatcaccttccagtactagtgcattctggtttcctactattactcatatcttatttttgcattcattcaaaatagatttattgcctgcgtcatttgcagcaacacatcatcttagttgctcctttccaataattacccacgcctctctgtagtactgttgtcatctgcttaattctgtactttcagatatcaatatgcttttttcgttatcatataatatttaatggagcttggtctgaagcaaatgttctctttattttcaggatgacggctacatccccaaacattcgataatggagctccaaaaggcatggccaggttcagaggtccggtgggtaaccggagggcacgtatcgtcgtttttcctccacaacgacgcgtttcgcaaggccattgttgatgctcttgatagactataacagcagaggaaactcatctttgtgatggcatttcttggtgtgcttgttgtgaaactcataggcatgccacatgacaagatcacatttttatgagtgggggagcctagaaataccacattctgtctgtaactcaatatatgtgttttcccaaagattgggaagatgcatgagtgtaacattgacattcgttacctgttaactaagccccccattgttaatctgtcccaaatttcacctactactaaccttgcaactgaagtaatttgcagttgagacaagaaaggaagaagatgacagtgcggcatacctaaactctctagtctctattctgtgtctgaagtctgaactctgaagcaaagtcagtcaaaccatatgccacaagacaaaaacattacagtgtcatcatcaatctcagcacttattttcatactgactagtaattatcatcagcagctactagtatacagcttagtttctgtttcttatacattatatgcacaattacagcatgctgctaccctcctaatttaaaaatgaaatcatctgatcttgtcaaagaagcaaattaaggcctgatcgattgatcatctctctatgcactgtagtattctgaaacttttgaaactaatctgttcctgtctgtctgtctgtatgtaaaactgcagtggtgtagcagtgtagatgctgggccattggatctccagggccagtggatggatgtggtctaatttctagggttgatggatggcggaggcggaggaggggcgggttggtcggggtggcgcgggcgcgagagccagagggaggtgagggcgcggaggcggtgggagtggtcggcgatggcgaggaagcaccgcgccgactgcctcgccgtcagtatctgcggcagcttgtacagcgtctgcagcctcagcgcgtccgcctggatcatacgcatgtacgtcatcagttcatcagtcagtagagtactcgtgcattatatttaaagttgtataagagcctcgtcggttggcctaataataaatccaagcaaaagcagaagctaaaatttaaatttttaaacttgattttaagatattttcactgtgatttcattttagtgcttttaaatcgctgcgaacaaatatataaaagtttgggtgaatacccaatatgatccttgaactttcgcttaaggatcaatttagtccctgtcatttcgtattgtccaaacaagtaccttaagttcattgtgtgattcaatatagtcctttaaccctctaaatatgccatgtgtacatgtcacatcatctatgcatgcaaattcaatatttaaatgtcctttacacccttatgttttcataggaaataaaggaaaactattgagaaaacacacaaaaaaaaagcttttgaccattggcaaaaatatgtagcattgatagataaaaaaaattaacatttttctttgttttatgattgcttcttcttgtttttcttttctttatttgatagaaaattgaaggttaaaatggacatttaaatgttatcttacatgcacgaatgacgtggcatgtccacgtggtgttttaagtggctctaaggactatattaagccgcatgataatttttagggtcttggttggacattataaaacatgaaggactaattcgactcatgaacaaaaattgaaggactgaactggctattcaccctaaaagttttaactataaattattttttattccctaataagccgttttggtttattagagagtatgagcaaccaatgaggttctaacaagtattttattttgttaggacaaaagtttgagcaacaatcatcctattagtgtgaatttttataacacaaaatgaatgttattagatccatattaaaagagtcactcgccattatgtttctttatcatacaaatagtatatatatacggagttattcaagtaattactatttccatcctaaaataaaatataaatattggatagaacacatcttaataatacaaatttgaacaaatgtttgactagtttcgtagtgatagaatatgcccttttcagttctagtttgttatattttaagacggtggtcgttgtattagttaaacttgtgtggtaacgaaactaaatgccttttgcaagtttagttaattagagatctagctgttaataagaaaaagattatccaatttcaggttttatttcaatcactgtaattaattaattattaaccaattgcctggctctagctagctaggtgctagctaagtatgggctcttgttgaagggaacagaacaaattaaaatgcccagctagccaataccattgatcattagtggatagggtttcttagttataggattaaaaggagacagtacaacagctatagctagctggctagataatcaattagcctaagcagccacacagttttgtacaatccaccacttaatccagagccaactaaccaacctaatgcagccatcaactgaattaaaaacaaaaatcaactacaattagcaagccgatcgaatcacgtgtggtaactacttagctccctccctttcaaaatatatggcactgttgatttttcgttcaaattcgtcttattaaaaaattagtataaatatataaaagtataagtaaagattatattttatttgaaataaaacaagtcataatattttttttgaatatgactaattgtcaaacgatgtaaaaaagttaacggcgttatacatttttgaatggatggagtaattaacaacgtacctgcctgacgaaggcttcgagggaggagagattggagatggcaagggagaggtgagccatggcgacgtcggagtatgcggtggcaccggtgccgggagggaagagcaggagtgagtccgaggagacggcatcggagagggcgtggtgggtggcgtggaggtcgcggtcaagtgcctcctccctctccctcgccgactgctgcacaccgtacacacccgccgcctgttgctccgtcaatggctccgcgtgccgcgccatcatctagtagcaacataatcattttatttcaattagttttcgacaataataatgaagaatatttatagttatgtaatcatattatatataggttcgcaagataatcaaatataactattcgagttcatgtagtatcacttaataatattatattagtatgatagagtcgtggatgcatgactatgactatgagtattaatactcacaaatattgctatgagtgtattaattagtatagagatcagaagttatacttactttatataaaaataatatcatatcggtaatgggacgacacgtaaaaataatatcttagaaataccatattgatgatggaacacgcaaagaaaattagagtacctaattaacaagggtatatctaattactaactagttagctactttttatgagatatatatgatagtactactataatataatgtagctagctagctttttatgagatttgcaagtattagatagtagctaggactctgtccatctagaagaattagcttgctaaagtatgtatacacatcctctctacatgcattattggtaaattagccatccccatctacatcgttgatcactcttatctaacttgcctccttcaccaactctccgttgtacattactgcacactactttcttccaacacagaaaataacaaccacatattagtagccatcaaagacttccaagagcctaactgttccatcaactgggacctctcacctacttaaatcaatattttaagatagatagctagctaacccatcatacatctttctttctagttggagtacctaatatatgtgtctggactctggtgtactatggaatactgtctaacaagcttctttccaattactttttttattttttgcaattatgcatgaatggaaatctatgtatgtatagggctactacacacactactaaaacttaaatatatactccatatatatatatatatatatatatatatatatatatatatatatatacttatacatttagagcactaacagatccataaatattgcacgtatatatagggtatttcaggtattttattaaatatatgtaaagctattaattgtactccctccggttttaaattaattgaagttttggacaggatctcacatacttagaaatggttagttagggtgcatattcatgttttatccatattaaatacattaggatggcacatctaacaagcacatcctcttaacctagtggctggctgctagtcccaaagcatctttttactgtcttgtgccggagttgatgcatgcatgcagccatacatgggtaaatcagtttaaattaatcacatggaagctaaaacgccaagttttatcatccaaaaggtctaagctccaaacgtcaactaatttgaaaccggagggagtacatgtttagggcgtgtttggttgcctgcatccatgtatagtgagcagcgtgtttggttgtgcactggctgatataagcaaatattatatgtatatgcatgcatgcacgaggacgaacgaagtaaccgaaggcacgcatggaatgatggaagaaacgtgctgcaaacaaacatgcatgtatatgttgctgtgcatctcggaggaagaatgatgacattttttagtcaaaatatactaaaaacgtacgtaacaaaaaagaaaaaaaatatcgggaggagcaggtagctagttagctagctatatactccctccgtttcgaaatgtttggcgccgttgactttttagcatatgtttgaccgttcgtcttattcaaaaaatttaagtaattattaattcttttcatatcatttaattcattgttaaatatatttttatgtaggcatataattttacatattttacaaaagtttttgaataagacgaatgatcaaacatatgctaaaaagtcaacggtgtcaaacattttgaaacggagggagtagtaggttaattggtgaactcaagcttatggaaacctgagctcatgcaatatatgagtaatatacagttatgtcgatctagttaattaatactccatctgaaacagatgcagtatattaacctagtatactagctagctaatatactgctacttctgtcgctctagtatattaaacagatctggttgtaagacgttttgattttggtcaaagtcaaactacttcaaatttaactaagtttatgcataaatatagtaatatatataatatcaatttagtttcattaaatcaataattgaatatatttttcataataaatttgtgttgagttaaaaatattattttttttctacaaacttagtcaaacttgaagctagcatgtattttcttggttcaccttcctctgtctctcggtccatattctacatacccatattggaacatagacaatgggttttatttttttatttttaacgtaaaccgaattttatcatattaacatatttaatttgtatatagtgatgaatgacaccatatagtctatatatgttgctattttctttaaaaattattaccatatattttgatgccatcctccccttcattagctattacattgtataaacccatctctctttatttttaagtttttatgtattatatatgtagagcgcggcatgcgcagctagccaaatacgtactccaacatgtccaataactaaacgcgtttcacaaaattatctgactatatcatgtctatcatatattgtagacgcccttaaaccctaaaaatccaatataatctagctagtatctcaaaatctaaagggtgcctatactacaacacatcttttataatttacctctgctttcagaaggatgacgtgctaatttatccagttaaaaatgaagaaatcctaactcatcaatatatgcaaaaaaaaagtatattgcaattcaaaacatcgagattatgggtctgttcagattatagccaaaataaaccttaccaagttttggcaatgctaaaattttggtaagatggcaatattgccaaattttggcaggattttttatgtattgatcaaatttggcaacacactaaacgtggatatttttttagcaactttgcgaaaaaaatggtatggttgaaaatgacatcaaaatgaaaggccctatattagtggattatttgttatgaaaactctttcatatagttatactccctctatcacataatacaagggattttgccctttctaattgtctcacaaagatttttgtgtactactgtcagtcacatccatcaacttcaattcaaatttctacctattttgaccctcaactatcccctcacccaaaccaaatctcatttaataggggtattttagtcttctctcgctattcttaatcttataaaaagggaatagtcccttatatatatattattatgggacagagggagtatttataataattttcataaacattaatttgatttgaaaaggtaatgataaatcatatcaacatctaaaacgtcaagtaaaaatatcactgccagttcagatccgtttgggtgggtaaaaccatggtgaactggcattagtactatctctctatatatatcaccattggtttacactaaaccgtcagtgataagtcatcagtgatgatattttgtggtagtgaatccttaatatataatatataaagccggctttaaataattatctataaattgattatataagatattcaattaattatgtgctaaccttgatgagctcggatgggcggaagccaccaatccagaggaagcagcgctcggcggcgggcagccacgtcccggagacgaggtggaagacgtcggcgctggccacggcggccttgagctccaccagcacgccgtggtgcgccaccgccgcgtccaccagctgccgtagctgcgcctccgccgccgccgccgccacgccgccgtgctgcggctgctcctccaccgccgcccgcatgtgagccatcatcctctcgtggctctccacccaccgcgcgtactcgccgtcgaaccacgccgcctctgcatgatgacgatgacgatgacgacgacgatgatgattagtctcccttacacattataatatgttcttttttttctcttaatcctttaagtctagattcactaacattcatatgaatttgaagttttgaacacatatataaaatacatacgtggatctatgtataaatctatttaaaacccaacgtaaataatgtgaaacagaggaagcattcattaaaaattttagttgtttccattatgtattttaaaaattaagagttgtgtgtttttgcacatggacatctgcattcattcctgacatatttgatctaatgatgaattaattaacgagtaaacaaattaattagagaatttgttggtgattatgtggttttgagtattatatggatttaattataataattaattagggttggtttgatcgtatgcatgcatatatgattatatatacctgggctttgtcctccaatgccggcagaaaaagctccaccacccaaaattgcaccctatgttgatacgtgcgttagacatgcatcatgaaacaaatcaatcaattaattagtttactgaaaacatcgtatagttcaggagcatttgcatgtatatatgctgtacctgagttcttgatctttgcaccaactcctgttccagctgggacagtctgatcctgcttgtctccagattttgaatgtaagcctatatacacattgatccatatacgagacacaatttaaaaaaaaaagcatagttaattaagtgtcatgagaaacgtaattttcagatagacgtagccagtaatgttgcacatctatattccattttaggtggtaagtaattctccgtacccccacactcacatgcatgcaaactcatttgtttaattttgactttattttatatccgacatgacacatgttagttattttaattttgacttaaatttggagtaagaacgtcgtaactgcacaagtctatactcctgtgctgtcgtaaagtagggtgaaatggcagtgcggttaattaaacaacaggtaattaattaatctcgatttacagctaccctaccagccaggtagagcaagagtaattaactataattaactgcaacttaattaattaacaaattaccttcttccttagcctgcttttcctggctgcctccctgttctgtgcaagcctccgcagcgtcttggcgtccggcgtcttggggccctcgtgctccgacgccgccgccgacgatgcgccgccgtgatgcttcccgccgccgccgccgccttctttctgatcggccgatcgagacgaccacacacacacacaaactcatgcgtgagcttgagccactcagaatgtcgtagatcagctgaagacgaagatgatgagatcatcggagctaattaagttaccttgacgacggcagccttgccgtccttcccggaggccgacggctgatcggccggattattcagcctcgacggctggccgccggccgccgccgccgccggcggccgcttggaagagccggcggcgatggcgagggcgttattggacggcgccgagttgatagccgccatggatgatgatcccttgggagaaggctcgccggcgtgcattggctgtgaagggaagatgttgagggtttctgcatccatgtagagatcagtaaagtagcaattcagaataatactgagaaacatatgtccaaaaatatatgcatgttgatgaactaaattgtccaaattaactatatgtaatgcatggcattaattaatatattaacacatatatcaaatggtgtaacagcatgtcaacatgcatgtggttgtaagttctgttgtttcacacttatggtcctaatgtaaattaaaagtatgaaaaagtgaacaaaagggagagaatatatatgtgtgtgttcatgtttgatgtcctagatatgtaaatagctagctagctagcagtagtatatatacatatatatgcaaatcgttgttgcaaatgtctctggatgattaaggttaaaaatgcatatatctagcttgctttagcattacatatatgtgtatatacgataatcatcctagcaagaacgacacacatctccaggtgtttgttatacgtcactctctcctccccatctagagaaaattttgggaaaatgacatgtcagtgagtaaagctttgaggcgatcaaatagaaggaaaaaagaagatggatcaccatcgctgcctgctcatcgatctctatagatagctaatactccatatctgtcgtcgaaaaattcgataatgaccatatatattcacttgtcaaaatcgaggtagctagatgagatgcttgccggcctgcttgctatatatctgatgaaattaattaattaatatgaccaaagaaagattattctccctctgcatccttgtcgatcacatcttttttcggagaagaatataatgcataatttgtgaaaagtctgaagatttggtgacagtaataagtgcatatatatatgtggcttacgaggttgttcttgaattgctgctgatgcttgatcctggctgttgaggtagaggaagatgtgatccaattctgccatgtcgtatcctcccccaggatcctttctgctgcacttgcacaaattaatacaaatggagaaatcatcacaaaattatattatcatctgatctgacagtagctatagctgtagtagttgctaaattattctgcatattttaaggttttggtaagagaagctaagcttcctgctccaagaaaggggataaaataaaaaaaggaatttttggaatatacgttgtttgctaaacaaatccagtattagaaaatgtaaaaatccttagaagatatcaaaattaaggaaatgaatgaaaagcctcggcaccagctagtagaattagttgcacccatcgctttattaaatttggagcaaacaataagtacacccacttcgaataccactcttcaaattaattaagagatgcttaaatatacaccaaataaaacccttaataaccaggataaagttacttatcttgcgcaaacatgcaccattagtaatcaacccattcatgcatcatacaaattaaaacatgaaaaacaattctgtaatcttgaaagttcaaaaaagcactccataatctcgaaagaaaagtaaaagagacaacaaattaaactgccaagaaagacagcatcaagagagagagagagagagagagagagagagagagagagagagagagaattgtggagttaattaaagctccagttctgatgataagacaaaaaaggggatcaagaagctaaacattgagcaaggtgcttcaaatttgttctgataaaacaagatcgaattagggaggaaaaaaaaaggcacaagtcgtataggagttagggtttttacatgatgttgttgccatggatggaggaggaggtcgcagaagcttgcatcatcatcccggccgtgactgagcaagaagccgcctgctgatcatgtggctgcagctgctgctgccatggcctatcccccatgcaaacacactgatccccagtagcaaataaactatctctttcttctccttgatgatgatcacctcagctagcaattaaatcgatcctatcaccaaatcagctcctcaagtacttcacatctgatctcatcacctctagactcgatcgatatgatatcgattgattttgcgaggaatttatcggtagacgacgcgtgtcgatcgatcgcgccgcaatccctcctcctcttcttcttcttcctccaagctaggtagacatagcttctaattctccttagcttcttctgaccggaagctagctagctataggtagcaaaagtattaggacttgtagtagctagcttagttgaggtggagtgcttgtacaagaaatataaggggagtggttacaaggccatggaaaaagctaggcaataattagactttttttataaaggtcgaatacgatatgtgattggatcggggttgatcggtctctgcgactggttttggagcgcggttttatattgatttttgttaattaattggtgtttgatctttacgtgtttcatcattggtccaagtcaatttgaagaaaaaaaaagaaggttatctagtgcttgtattgttgttgggtattttgggttcagaagaaattaagtattatcactgtttcttcttgttaattaattttgctcaacttgttgtgttttggcaggatttaggttgggaattaattgggtcctgcaagaaaacaaagtatggtttggactagccgctaatatatactagtatatattttttaagcaaattaattaaggcatatgctttgcctttgtgtatattgatagagcaggggagatgcaaatatatatatatagttgattatcaattggattgtgtaaacatatatttatgttgctgtatatatagcacatactattacaaattaaaagtacacggtatgaacatatataatttcaaattccctaccgtgtacttttgtaatggttcgatggcaataatagttaagaaacatcagtgtcttaatccaaccacaatgtccacccttttcaggagccaatagccactcaaaagagaaaacaattaaaggatgtgttattacaagataaacataattaatagggtttcctcccttggatacaaaagaagggggccctggagacaccacagttggttgatccttccaaaatgtcaattaattagtaagacacatgattaaattccagatacccatgaagcactatgtccggtctgttgtatatatgttcagcatccaaatatgcaaaatttgggtttgattcttctctggccagcaacagacctggcatgcattgttggctacacctttctcttccaatgagcacattattatacaggtaaaggtcaaagctaaaatacatgccaatgagttgacctctaatgatgcattgcatttagctactatctagcattagtacacatgatcgacccttgtatatatgcatgcatgcaatccaatttcagtatataatatattcttataccaaacctaaacaactaattaaattaagagaagatagcaactaatacttgatgaaaccagccaacaaaagcaccttatttctcttgtttaatttgtttcatatagcgtgcatatatatatttttatatctctgttactgccagttcaattaatctcgttctgctctgcatgtgtgtatatatatctcccttaggattatttaataagaaactcatatatatatatgaatatatcacacacacaattaaccagaaatattaggttgccagaacacacacaattggtatatataaattaagagatacacaggtaagtacattagtgtattaattaggatccgtgattaattatatataatctgtacacttactttgttaaaaaataattatgtctatagtatatattaattatctgtccgtacgtgcaggagtatatggttcaaactgtactgcctgcttgtgtcgtcagatatggacgactcctttgcgtttgcatacatcatacaatgctgaatgcctgaatgcaacactagataaactgtgcgtgtacacgtacgtacatgtacatacactatacgtacctaatacacgtacttagacgccggtagctgacgtgtcaattcatctcttatgtgggctccacagaattgatggcaatggcgtcgtacgattttcttgtacagcttatctatagctgaggatcgatggacctctcgatggtgatgaattgagtgatcatcaatggaggctttcaatccgagtttgaagctgatctctactattataaaaattaaagatgtttttttattagtactttagtacgtcatccgtatatgagttggtttttaaattcgttcgtttttggaaatacatgtacttatttgagtcgacttttaagttagttcacttttgcaaatacaaaagcagtcatataagaaatctcttttaaaaaaaactggcatatatactaactcgaaacgattagactcctaaccatagctcataatttttaaaaagaaaatacatccaaatgaaattgccacagtgaatttcaccttatctaaaccatatagtagtaataaggttagaatagacttcactagttgcaacgcacgaacaatttttctagtgaagataaaaattaaattgatgtatgtaaaacaagaaaaatcattaacacatgattgattaagttttaattattataaacttgacaaatggatatatttgatattttaaaacaacttttgtatagaaagtttttacgcgaaacacaccgtttagtagtttgaaaagcgtactaaaggaaaccgaggtaaaatatcttaatcttagaaaagaaatggatcgcacgtgatgtcatgctgacgtattggttttctcgtccacggctgtcatgtcatgtcatttacttttgcttagtcgccggccattatatttataaatcacctgccgatcgagagatcacttaatttgcctgcctagctaatcacataacctaactaaacgactccacccaacccatggagacgtgtgcatttgtgcaacattgcacaatcaacctacccttgagttggatagatagatatattaaattacaaatgatactatatctttttgtcatgtgtgatattaaattttgttaagagtattttgctgaaaaagttcttgagtgttactcggtttgtacgaatgtaaatatgggaaaatcagaagaagttttccttttgtacaagttgtaaaaagaacacatagaaaaaatttgatcaaacctcttgaaaaattctttcgaatagaagtgtgcgtgttcatttctatttctctatcttttctatttctatatgttgaaattcctccaaaccgaataaatcctactgtctacgatattatagttttaggccttctttggaatgaataattttctaagaattttcttatgaattaaactaattcctgtaaagattttataagaaaatcctacattccgagcagccagcccttatttttagattttgtttggcataattaagctcctatctttattatactttgaaaataaattagttatgataatatgttttttgtgctgaactatctttcgactaactagcaatcaatttaatacaaattgttgtcgcgtctgaaagggagagtggatcataacaattaacataatgtcgtgacagtgcatacggaggatcaatctatcccctccttaattaaaaaaaacaggagggctgcagga

SEQ ID NO: 18036 - DNA, 6532 bp, Oryza sativa
  unsure (1)..(6532): unsure at all n locations
cttcaaatgtgtacatatatcggattctttagaagataaggaaatgtcattttcatccatcttttacattgtcaatcactttgtttttttctccggtcagtccatgcattcgagcatgtgttccgcgcgtgtacgcttgcgtgggtggattggttcatgaaactaaccggcaggattaagaatttaagattgcccaattgacatgttggttattataattattaacccaagttgcttgtatttcttcttcttcctcctccaaaattcttcctaatttatttgtttcaaaggtatcgggtcagacttcgaaaccaattaacagaagggattatgagatagttgtgcatgcattcattatccatgtaattcgtccattctcaaatagatgatgttttagtatacatataatcgaatgtcgaaatcctaacccatcattagtaaatggaaaaaaatatacaacgattatttgatgtgtgaaatagaattagagaatttattatcaaaaaactttaacgtagctgtatttttttaaaatatttctatgggttatatgaatgtgtgagacagtattattgatatcttgaatgttttatgaaaaaagaaagaagatgttgtaagaacaatctgggttaatggaaaaagtcagagaagaagaaagtggtggtggtttcagattacagttgaatgagatgctgtcggccaggtcggctacaacaaacaggcaaagccaaataaccttgtaacacaaaatgaaaacaagaagatacaaaaggtcagggagaacatatcttgaccttcttggggtcactacaaagatgatgctaattaaagtcaactctacaataataaacaggaacaatatatggtctctgcatttcacatggatgcatgctaaattgtgtctaattgtttaattattggattggaaaacccatgttatgattctgaaggaattgccttgttttccatggattttctgtgttctgataagttattccaattcagtgtatatataacgatcacgtacgagtcgatttcagaaaacagcaaatgcaataacgacattattgacctatgtataagagctctaaaaaagatgtcctaaataaaattgaccaataggagccaatctgaattgaagtgatcgatgtcgattaattaaccgtgggaatttccttcacaagcacggaaaattcagttttgtcctaattagggtcaagtcttggatcctgaaaaatgaaaagaacttgaccattacaaaagcaactgtttccaaccacaaatggagtctcttgtaataaagcgacggcttaatttgttcttttagaaattagaatcttctactcggtcgatctaagaaaatgaatatatatttcctgcatgctccttgaaaccgtgacaggaaaatgtaattttaagttaattactgacaaaattattgaacataattaatttcaaaatgttctgaaattttcggttctcttttcccatcatgccgtttctcatcagctagcgagcgtgggttttggagttgggaaacggcccacgggccagcgacgatcaggcatcagctctatgggcctcagttcggtccaaaattaggcctgtttttcaacttttttttttcggactgctagaaatttcaacaataggttgtccaaatgcggccttccagtgtaactaagggcttgttcatacccaattttggtattgacacctttggccattgtcaactttttaggctgagttagtttgtcctacgcataacttattagcacatgattaataaaatattagctagtttttttaaaaacaatagattagtatgattttttaaagcaactttcgtattttttttaaaaaaagatcgtttagttatttaaaaagcatgtacgcgcaaaacgaggaagatgagttgagaaatgtaacaacaaacacaaccttagcagtcggttgagcaatagtaattcccagctcttccccaaaaaaaaaaaacacaaccttagcaaagtttgatagtgttcgtatgaaaggaaattatctgaactaacaaaatttggaaaggtaataatgctaagagtagcttagtttgctacctaatcaaacattggtactgctaaattttgagagttaaaaatccgcgacaaaatgaactgccaaacaaaataataaatagctaatttcgatgcaattaaaataaatcagaatattttcgatgccacaaaattgtaactggaaacttttatatttctacaaaaagtataaactactcctttgcttgtcttttggcttattacccgtagccagaatttaaatttaaatatttaattttcaaactgattttgataattattttatcatggtttatttttacaatcatatgactataaaaaatttatcaataaattattaccagttttgatcgataaatgatagattaaaccatttgtttcctcatataaaaaacacagtttaggacatactcaatagtagagcctagtatgatctcttaaattatttagagataatatctttacaatataatagttgagacgacgaaaactcaaattttgtttattgttgttctttcttgttttttctcaccctcatgtaatcatgttttctttctgtaagtgctaagaatcaatattgtgctgttgttaactatatcaacgatattttgtttattttttttcacaaatatttctaattagcaaggttaatagcttatgatttaatacgggttgtacacttgtacatggccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaatttcagtttcatctaaattggagtggagctggctagagcgctctcacaaaatgaactaggctaaataatctgcaaataaaacttttatatacgtgttcttaacgatctaaaaagcaaggttgaaaaataaacttcgatgagaaaacctcaaaatcaactccaaatttaacgttgaaaattcaaaatttggctaataagcataagcataagtgaaaagatgaaactgctaaaagggtggagctagatttatactgccccacaactttatactagacccaattcatgaagttaaatttagaatttaaagctctaacaaacgagtcgtttggttctataccaaacaaaattcccactataatggaaaacaattttaatataatctaataaataaaagaaaagaaaagaaaaatcacccgctcccctgcgatcccttctcgccatttccgcggcgccaccgcactccgccactctccccctcctctcctcctcctcccagatctcctcctcctcctcctcctcgccgccggcgatggccgacgaccccctcgacccgccgccggagccgcagccgcagacgctgccggcggtagcagcccgcgtcccttccccgttccccccgccgttccttctccgcccccgccgcgaggccttcgagcacggcctcctccccatccccaagctaatcttccccgagggcacgctcgcgcacaccctcgcncaggtcaaggacaagctcgcctccgccgcggatggaggaggccgcgtggccgcggcggcgctcgcggaggcgctgcagatcccgcacgagcaggcggcgctcgcgctcgccacgctcgccgcggtgctccccgcggacgaccccgcgctggactccggcggcgggggcagggccgacctccgcgacgtgctgctcttcctctacatccagtcgtacaagcgcctcgtgccccgcgcgcacaaggactcgcccgccgtcaccgacgtctggccctccacctccgccttcgacggctacctctccgcgctctccccgatccaggtcagggatctaggcctcccccccgttgctttataattagaatttgggtgctcccatgattcctctgcagcagagaacaccttggatgtgtgattgcttagccttaatcatgtgcccaattgagcttagaacatcgccgtcgatttaaacaaggcggctgttgtgccaccttatatccttcatgttgcagctgatgctgccgtttatctgctgtcacaacaaaaattgatatgtgatgtaactcactcgagctataagaaatgctccacagtaaaaagtcgtgcagctctagatatatagtgcaaaggaagatcctagctgctgatacttattggatgctatggatggtaccgtatgctggggtcacttcttgacttcaatttaaggttatcttttttattggtggccgtcagaaatgaatggttggttgcatcaaattacgtatgatggttggacttgtatgctaacagtaaactcagaagcacacagactttgccataattgagcgaccagtcattgttgtgaccattttgttatagattcagtcaattgtatgtttgcttaattctttcgatttgatctggaaccatgcaaacctggtaatttcactataggcacaatattttacttccactcttttagctcaaatttcaaaatttggagactatggtgcattcaaatatgacttacaaaattcccagctgctaaacctctgtttcgtctatcagcaatatttttaaactgaaatcctatgccctgtgccttttctggtttgggtggtaacagtggctacagagggttagtattcatgcctttttgtataaagtttttgtaaaatcaagatttctcctacttattcaatttctcgtatttaaagcttttacgctaccaacctcagttacatgttaaaattgttctaggtgttacatttagggtcaatcccaatttcccttccccaaaccaacagatcaagcaaaagacataaaaacaccttctgttccttttgctaatatgagtcgtatggtacctccttcacttactctttatatttatattatttcgcagcttgtacgcagtaatagccgtcgattcatgccttctcaagctgatgaggaaattcaccagctatcttatctgcaaaagcatatggccaatattcttactctgttggccgattctgttgagggcgaaggtgatgattctctggtacgcagccttttctttcttttaagtttgccgagcttgttgctatttgtgatatccacttgattactcttctgtttgacaatttgtatcttgttttcttagtagagtgaagctttatgtgggaaaagagtgacagaataatgcatagcatgttctgataatggagtttatttgtttttctatatctcaaaacactagaatcgacccgtaaaagtacatctccgtgttggatgcctggaactccagggccgtgatcctgtaaaattatatgcaaacctacctctcagacaagtatacctctaaatatattgtgatgtatgagtatgcttttggtcaattaggtgttaacttcactcagaaggtgccctgcaaaaaaagaaaaaaaacgaagaccacccatcagtagatgttttgagatagcagattcttttttaaaaactaatatatagacaagcaaatataaaggtagcatatatttgacccagttagatatatctggcccaagtaagaactcatctttttgttaaatttaggatacatgtcacattgtcaccttacatttgagggcattttctgaaggcaattgcctttgtgcgtcctatttaggtttttattccttaggattctttgtggttgggctttggtagaccattacacttcagaatgtaaaataactgtatttcacaatttttgtgcaggtattgaccatggagacatttgaacaccttggatttctactgaagttctca

SEQ ID NO: 18037 - DNA, 678 bp, Oryza sativa
tgttctgatgctactgttgttcttggtgctattggtaaggtatggatgccaatcggtatatctttacaccctcctttcccattgttgcagaatattgataatatattcctcatatttttctaagcaatttaaagagaaaaacccttgtatacacatcagttgccaccagactattttagctgcaccggatctgtttgagacttcaattgtgtatgccttggtatcacctgaatggtacatgagtgctgagtattttgtccaaatagaagaggaggtgatgataataataacaatagacagtgaaagatgtcacacattgttgtgtgaaccaaaaactgacatgctagttgctactcttttacagtcttttcctggaaaattcctatcaaatagatttaatcatgcgttgagttggactgttaaacataatataagataggctgtacattaacaaagaataaagggccccaagtggaaaataagaaacacttttttattgtcacttcaaatttgctgttattacctctgttctgctaaagtgctaagtacatttgacaattatactttatatgttttgtgttgtcaggttgttaaggtggagcattgtgaaagagttcatattattgcagctgctaaatggatttgtattgctaactgtcgtgagtgcatattctacct

SEQ ID NO: 18038 - DNA, 695 bp, Oryza sativa
gatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaa

SEQ ID NO: 18039 - DNA, 733 bp, Oryza sativa
  unsure (1)..(733): unsure at all n locations
ttttcttaattcaacccttttaaaaaaaaattagggatcaacgtcaacccaatattaccaatattgtttaaggaagggagtccttttttttgtatattgttggaattttatgttccctagcttgtgtcctgtcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttttcaannattcatcctgaaaagttttttttttccggatggagtacgttttaactttgcttgcgtagtacctatagtagatatttcggtttttgattttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtgg

SEQ ID NO: 18040 - DNA, 3515 bp, Oryza sativa
tcatcgatcgagcacggctcagtcagtatattaactgtgaagcccggggcaactattatatcacttgttaattcctatacaaaattgaaatggtggttatcacattatccagatttattaaaccatgggctaattaactatagggttaattccttctctctcttttcttttgcaaaacacagcacacactcatccctaatgaatgtacacacgcacgtacactatatctagaaacactttcatgaaactggatcaatatattttgagattgataaaatcaacacagatatcatatggcagacgtgaacctaaactgtcaagctatgctcggtttgcattataggtatcaattacatgtcttttttgctatagtactcgtactataccgatacttctcgatagagagtgtcggccgggggcaagaaatcagcacgtactggtgccgttcatcagggaagagtgtcacggagcacgccagctcgctcgtccggccggtggccgcccgtcgccggtcaagacgacaagggtacgacgcgccgcgcgtccgctttccgattcagttttttttgttcttaccttgcacgcgatgcgccgcgcgcgagacagagagatctcatgagcgagccgtggtggtacgcgcgcgctgcgtacgtttttttttcttctttggttttaccgcgcgcgcgcgcgacaagcgcccgccgcggccatgccgccttgcgtgtggggatcgcacacacctctctctcttctctcccccccggccgcttgggcgggcgaggtcagcgtccgtccgtccggccccgcgcgcgcccgtgtatgtatgcgtttgcatttgcatatacatgcatacacatccacagccacaaaaaatattactaaaaccacgtctccctctctctcatctctgctgctacatacttctttattgtcatcttggaagccaactcaagttacccatctctctctctctctctctcttctcttctctttgttttcttgtttgcttgcttggtgtaaagaaaagatagctccctttccactgcccatctctcacatccctgcttcccttccaccctacctccttttctgccccctctccacaacaccccaacaagtttgtttgcttgctcgcacgcttgctgctgactagtagctcgctagaacaagcagatcagctcaattacctagtgtcaagaacggagaagaagctttcagcttaggtagctttggtgcggaattgtgtgcagaagcgggaggagaattattgagcggttggaagtggatgcttgcgtcgagctaagcaaatagcatccactatagagagatcggtggagagaaagccctagctgagaggaagctctagctagctaagctagccatgtgcgactacttcctgcagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcggcggcggctgcggcggcggcggcggaggtggtggtgggagcggtggacacctgttagacatgagcaggaagcctctcttgcccagagggatgccgatggcggccgtcggtgggctggcggcgccgagggtgatgccatcgccgctgtcgccgcgagccatacggccgtacccgccgatctccgcaggcgacatgatgaagctcggcatcacggcagggcaggcggccgggtgcgccatcgacgccgccgtcgccggcatgcagatgtcgtcgccgcgctccggcgggatcaagcgcaggttgggccggcaaccaccatcctatagctagatctaattagatcgatccaaaaagaattcttcgtttggttgcatgcacaatatcttgggttaatttcgtaattcgtgaccggattttgattaattaggggggaagtgattgtacaacttctccttgtttttttttctctctttcgctatccaatttgctgttcttttttcgaaacaagcaaatttgctgttctttttttccgtgttctgcactgcaccgccgaagaaagtaagaagagagatcgaggaggaattccgaggattcttcgggctgtggcaaggtcacagatgttacctacagctcaaaattttaggcacaagagttatcatgaacacatggtgaacggtgggaatatttctggattggcaaaaacgcattgcatatcgggtgatgtgcatatctgcatctagacctaaccggccacagctttttttccggccggcaaggtcggcttttgaaaccctaagctagcacatacgcatcgcctcgatttgatcgatgcaaaatttgcaaacgagttaattaacttggctgcgacattgcgtgtgtacacatatggatatgtaaaacaaaaaaagaaaaaactgtgagatatataagtgatacttatccaagtgctaattaaattgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaaggtacatgcatgtttatcattctagcaaatgcattttctgttttaacataagctaattgatttgatgaggtaataaattggattgaattgagtgtgtatgcattaaaatgtttgaacaaactctttttaatcatctggcattcatgtatatatatagtccatcatcattatataattttatccagtactccacattgcgtctgcacgatccatgcatggaagtcaagagattaattggaagatactaaacaaatggttagctaggtatagggtagcatgaaagatgcatgcatgcttctagctaattctcatatccaactagttctactagcttctgtaatttttgtggtatttttggggttgcacacctcatcacatacagatagtactccataaatgtgtgacgaattaattagctagataaaatgtactgaaataatatctgctgagattagtttatccttattccaagggtgtagtacttagtttatccatgtattaatttgtacaagttttaaatcagcaagtctcaactctcggtgcacactgcaggtaactagctagctcacacgattagatggagtatactcctatatctttctggcaagctagatgcagttaagtccaggatttttttttttgtacacacatcagatatgatgtttctctttctct

SEQ ID NO: 18041 - DNA, 3386 bp, Oryza sativa
tttctctttctcttaaaataaaaatggaagtgtaatgaagtgagtaaaattaaatcaagtactgtaaccagtttgagaccactgtgatttcagtatgaaagtcaaaacatttttttattggaaacggccggatatatcttccataacttagaggatcgaagcacataggagtactactactagtacttattaatttacctacagcattggtttaatatcagaacaagtgatgaagtgcatgcaagcttaattagtcgatctaaacaaatatatcttgttgaaatgaacaatttgcagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaaacccatgggcataaagccatgcatgagggtttatgcatgcatacggttacataaacttgatcccagctaataaccataaagattgtgacaatgtcagcaaaggaaagatgagattttttttttttacttttcttttcttcatttggtctctctgcttcttcatattattgtgtgtgagaattaaattttgtttcaaggtctaggtatatggacctcattttttaggctgtgtcaacttgttgtacttatgcatgagatgatgaccactctatctctctctctgtcgctcgatgtgtgcactgtgtttatggttatctaacagatataagaagattatattctatgtggatgtactgctggggtatagggatagcagctgaacaagtaaaattaaaatggggtttttgaagttgatagatggaagaagaagaacaacaagagtgtgtgagatcgacctgcattcctgaaggggatagatatgatgtgacagagatcgggacatgcatgcattgctagcttgcaacggaagtgatatgcccttggatgtgacctcaagtgaaacacggtgcgtgaaatagctagagtatgaatcacaaacacgcacacactactcctctcaaagttggcagaatagtgcatgcgtgtctgccagtgagaatctgaaacaatataggggatgccaaggaacactagctggcctcctcttcctctttgcttgcataaggagggcatatgttggattcgctggagatggtacatatttttgtctctgcgccaaggaaatgcatttacttctcctgttcatctaatggccaaacatttttgagatatacattactcatcaatcccctcacgggctcaccccatgaatacgcatatgtacatcagtagttcagtactacacacatgtgataatattgtactggtatatacatgtatatctgtgcagtactatttgtatatggaactagatagctgcatcctctagctacctgcagtatcatgcaggaagtaaatacatgcactgctaaaaaaatgtatatacgtggcatctggcctttgatttggcccactggattaacaccatttcccatccatcaatagtacttctagcttcactacaagtgagtagggacaatgcgactatgcgaggactaatgccatatgcaggatatggtatgtgtctgttgtagctggatgtgagcatgtggatgtgtcttgtggttaaatgtatctgaagactcaagtcattgtaacggtgtctgtggatacatgcagcatgatatgtacgtccatccaccactcgctcatttgtacgaggtatatatactcgcccggagaataaatgttttatttttgaaaaacaaatattcttttgtacttattgaaccaagatacctgtagtaaacagcaatattaatattgatgtttaactaattaattaaagatgatgcaaggaagctatatataagcgctgatctggatggatgaggaactcgacacctgggcgaatttgtacctttgccgcaaggatagcgagcgctgtagctctcttcattttctttctctgatcccaggtggtgcataccctgcaatagttcttcaacggcggctcgtcttctccgtttctgctacatacatcgtcctcacctttcgttgaagctgcttgtatttgtctgctagtactgtttattctaaaatattcaacatacagagcttttgcgtgcgtgtttgtcgaaaatgttctggcaggataaacaggtaggaaatacaactttgcaagaacaatatccgttttgtataatattggtagatacaaacaggtccacggttgcataagctctaactaactttatatcctcctaaaacttctctttgagaaaggattttattgggcaaaaattagtactactagcttggaatgctttgcttccatgtggtgctaatattgtttagtgtaacactaccgtgcaagccaatccatcaaatgagcggccacacttacacatagcaacctacttacatttttgttctcgtttcgtgtaaaaaagttaatccgggagtggtatggttgaatggacaatatcttataaattggttccacccaactaaactagcaatgtggtgttaaacgtgcatgtatccacggctctcaggccacaaatgggccatctaaattgggcggatgtcaaattttgtcactggacctagatgaatttacctagaacataaacccaaattggacagatctatctctagcttgttatggttgtgccagcagcgtcctgtcctacttagtttctgtgcttgacatcttgagctggtatcatgatcccagcggttgtatggctctgttacgctttgttataaaagctgggctttggcctttttc

SEQ ID NO: 18042 - DNA, 12544 bp, Oryza sativa
attcctgcagccctatttttctgataagaaaaaaaatcatcttctttaatataggctatctacttacttatccaatagcttcgtacatgggtctttatccttcaaaagacgccggatttacatgacttggttgcagttccctgtcaacaattggttggagcaggtggatccatggttatgggtggtggtctaatctcttcgatcagattgatggtccttaatattagtacttcttttgagttcattttcataactgtttgtttctttttgggttgtgtatatcttagctatacagaggctagatgtattttcacgactatatcatcttgatatagttatcttgaatcaataaaagcttcctttataagaagaaaaggagtgcctgcatttcactctacttttgttaccagacaccattttggtggttcctttctagcaacaaatttataaacacttagaaatagactataatacttcatattgaagtatgtcacgtggtaattacacactttttatatataactaggaaggtggcccgcgcgtatgcgcgggcacttatattattgaaaggtaagattattgtttgttcaaaaattttgtctcatagatttagggcaaactaaagtttggataattttattttataataatttaagggttctatttttcttaaggtatcttagaaaaccattcacgaacttgtgagtaggagatgggtttagtacttacaacttttaaatcatgttttttttctcgagtaaataagaaactattggtagttaattatcatacagtccatctatatacataccgtgtagtatggccgcaaatgaaaaatgcgagtgcaagaattcaaaactcttttgattaaatcatctcatgaaggcgtatgatatagtaataaagggagggaagcatatgcatgggaaaaaagaagaaagagaaaaatgaaaaaaagggaggggatgcgtacgaacccgcgcacgtaggtgcgcacctatgctgaggtgggaccccgtaatatttagtttgttctaagatcaatttaatctaacggtttataatattggacctaccgatttaagtgaaaattaagtaatagataattttattttttttcttagaatttctaatatttgccctaatttattagagcaccacgcggcagtttgagagcattttaaggaattttaaatgactaattagaatattaactgcgcaatatatatgtatgggacatatggtaatatttgttccagcttcgtccttgtttatataaatgtagagagaaattaattttgtggctagcaagccattagatgtctaactaatagcaattaattttgacacctatttacaattgttcagagtaactcttatatattcatcttacgacttcgataatccattgatcaccaatttactaatcaccatgacttgcatgaaaaaaaaatatgtagtaaggtttaggatagctgaaattgatgaattatataatttatgtgatagctatttgagagtataaacgaatgaattgacttctaaaacgttaaaatgttgtttaaagaagacaccatttagaaacttagaaagcgtgcaaacaaaaatccaaaatatgcaatcgggaaaataattaatcgctgcatcacacctttaattttcttttcatgttattaataaaattaatcatctccatatatgatttgatatgtggcaaaacggtagcgctacatcggttgtgatcaccttagatgtctcagacactgcgctttgttacatgtgcgaaaggcaaaggtgcatacgtatattgtgcagcgagcaaaaagagaatttcggacgctttatttattagcaaacaatagatccgatgattataataatatgtccaccagttctagtgtaagtgtaaattagttaatatagattttaaatttttattttaatgggtacataatataatggtgtagaccttacattgaaacagtgcattacgtgagaataatagaccaatgtaataaaaagtagatccgatgatttatataatggggccatcagttttagtgcacgtataaattagttaatatagatattgtttatttgataggtacatgatataattgtgtaaaatttattttaaaatagtgcattatttgaaaatagtggtacaaagtaaaaaagtacaccggtttaagttatatgatggtagattatttgtttgtaaaattatgattaattatttaaaaatatatccattatatatataaatggaaaaaataagaaaaaaaagaaaaaaaggaaaaaaagggggggaaggaggcgtacgtatgtacgtacgtatatactacacctgccaatgtgtgagaagaggataggtgggaccatggtatttagtttgttttaagatcaattttatctaacggtgtataatattggacccaccaatttaagtgaaaattaagggatagatgttttgcttttttcttagaatttctaggattttctctattttattagcgcgccacgtggcggcttgagagcgtttataggaagtttcatggacttttagtatataatagatagaagatagatagatagataatagatagatagatagatagatagatagatagataatagatagatttaacaactttcaagttattggtagcctggaacaataacctggttgattctggcataatggtagaaagcttgcctcattaatttttgttggtggaaccaaattaagtagactataaacaactctaaatttttgagcttcggcagataagccataaaaaacaattaaagcaaccaaaaataagttataacaaaactttatatctatattattgacaataattaaaagccaagagtacaacccctcaagaatctactctaaggctgcgttcgtttgggtgatagggagtgagaatgcacatcgttttccacgcgcacgtttcccaaactactaaatggtgtgttttttgcaaaaattttctatatgaaagttgctttaaaaaatcatattaatccatttttaaaatttaaaatagttaatactcaattaatcatgagttaatggttcacctcgttttgcgtatattcccaatctccttaatccccttctcctcaaacacaccctaatatttcaatttttggttgtgactaataagccaataagcaaattattagctagtttggacaaaccacgttatcaaaaatgaaaatcgtactagtaataagttttactccctccaaatttaaataattatcaccaaactccatccattttcaaaattttactactcgtctactccaacacaatagtaataattaaaaaggatgaactttcattcatcgtaatttttattttgcgattacacagcacaagcgcacacacacatgcaacactatactggcatacatccgtgaatgtgtcccctataacacgctctctaagagttaaaaacccaatgactcaaatttgaataattatcaccaaactcgattcatctttgaacttttaccagttgtctattccaacacaatagaaataattaaaaaggataaacttccgttcatcataatcttattgtttaagagttattagtggtcaaaattaaaatagatagtactacagtcaagatcgataattatttgaaaacgtagggagtaataattataaaattaacctgtaaaagttttgatattataaaagaaagcgtgaagaacgtacgagtactgttagaactaatggaagaaataaccccaatcacttctcgaaacgcatgtctctatatcaaattgatatgaactgaagagatattataatgttaggcgcagcgcaggcaggcatgcatgcttgcatcttaaactaagttgggcttatttggtttactattatgccaaaatataggtatgtagattttgatagtgccaaatcttttgacgtcttattgacacattttggtaacaaactaaacactagccaaactattatttaaaataacaacaatttgataggatatattttggcatcaaacaaaaatggtcctttatcagtcatcgcccttgttgttttgacagtgcagtggtaaaagtcccgtatttaattaccaatacacttacagttttcttaagaaaatgtttggagaggcggccctccctctgcatcttgttttatcagtcatcgccctcgttctccacgccgcgttgatcaacagtccgctcgtacgagtacgacggcgacgcaaaagctgccgcggccgtcgctgttcatggagttcgtgcgcgctcgctctcctcctcgcggggcaaaatgatcgagcaaaacacgcatatcgagtgcttttccgccatgcaaacaatgcatcaaacccccgtgtgggtaaggataattccggacgacgacgcccctgtacaacagcaatggccgtgactgtacgtgattgggttgtgatggatccaataattaggcatttaatcgccggggcatacctgtccgtcgtccgatataggactactactatagctcgcatttgatccggtgtgtgtggatcaatggcgcgtacgtgcacgcaggcaccagtgctatagcttctgcttctgctgctgcttgcttgcatgcaatgcacattgctcacacagcctcgcactgtttgggagggggcaagcaaccttaatgcatgccaagaaccgaactgggctgaaaactttaagggaacccctgtgccggcacgtatgaatgtttcagactttcagaggagacgcatgcatgcgtatatgtctcatgccctgcatgatgatggcatttgcaggggctcgcagttgtcttcggcaagaacaaaatttaagagatgtggagtgaaaacgctaacgcttgcagcaggtgctgggcctgggcgtgcttgcctgggaacctacacggcaagtggaattttttttccttttgttggaacattttcttttaatgctgctggagcactattgctgcctctcttttgcagtgagcgcagttaatcgctgggaccaaagttgttcttgctctcttttatttccaccatttttttaggtttgggaataagatattctgcaagcacgaaaatgtgccttgtttgcagcctgcaggtcgagtaaaagcaaaaccaaccagacgttccagactgactcgttttcagaagatcaaaagaggctatcattgtttagtgggggcccaagaagaaagaaggcccagttcatatgttcagcaaaattaactggctacgatgcgtccgtccccctgtatcctgtactcatgtgagcagcagaagtgaattgatccgtagtactgtacactgtaaaagtgtactcgtaaacgtgaagtttggtcttttgcttctgggagaatcagtttggtttttttttactgcacgcatcttagttacgataagtactattttgtgctcagtggttcctgcagtcatgtgctgcttcaggctttcagctgtttcctgaaatcttgccccagggaaaacactagcagcaagattaaccactgcacatctggcgccatgcatccatctcgattagctgtcaacgctgtttgggccggcgagctccattcactgattgacctatacgtttctgtgtctcatttacagatttttacctgttacctgtagttgccgtactcgcgaacaggaaccacctcaatcttcatggtccggttgaacgagatctattgacgcttgacttgtctcaattagaagagtgatccccaaacgataccggagctttcaggcacaggggataataagggttggatgaagtaaaagcttacacgtcttgcgggctttctctcccaaagccgtttaattaaactcgtgaaaacgatggttttatccgtcgccgtcaccccgtggccggtacggtgaagatttgctccacccactttttcttcagaaaacaattaatacatgatttgctccaccccccaaccatcatattactttctctacctctgggagactcggactcgcggcgtttgttttctttcagcttcaaggagggggcgcgcggatagcaccggtgcaccggcatggacgctgaccacgagcgccggcgtcccgagcagggcgctctgaggaggccgcttttagccgacgacgaggtacgtgtgcttctgcttccccgcgcgcccccgtagcagcagtagtatgtactaccaccgacagcttcgctgccggcgccgcgcgcgagattgctcgttgcttcgaatcgcggagggctcgtgttcgcatcacccgcgctagccggccaccgcggccggtacgtcgcgcgcggctttcgcgtgtgccgcctgaattgggccgtgcacggtgcacccgcggcccgcggcgcccctcgttgtcgaacaacacatgatggatggtccacagaccacagcagaagcagctcctccactgtactatatggttgtagacttgtggccaccgcactgcagagtgcagaggagtctttccgtttatcgatttctgctctgctgaagattgcgaggtacaataggctggttaccttcgcattccaaatggggcttcgatgagaacaccaacttatttacttacgtggcaactgctttattgttctattttttggtcaaaatgagattggtactagtatacggcgactctgctttaaggttttgcttgctgtaatgcttgcaggcatcttcctcaaatcagagcctggtatctcaggaagatcggggacaagaggtggctgaggtgcagaaggttgagagctgctccaacaaggcactgataatcatcttgagtgagtgcctagccatacttgctcgacttgttcaaatcagcaatattgcaatatcgtcagatgaaaatgctgagaaaaaaaaagagttactgtagtactgatttgtctaaaaaaacataggtctgaaataaatatgtgtgcagtagcagtagtcatcagctatagtaggttagacaacgatcggattagactgattctcgagaaaagggaaacgtagattagagtctgattgaaaataatgatatgactatatgagacctggtcttatgcatgattggatcaaataaatgtcagattaccatgcgcggatatcctaggattacctttcaactttttccagagtgatgtttttcagccaacactactgtcttttcatatttttgccttttttttgtctacctctgtttacattcttgaactgccaattcgaactgaattatgtaagattctcaccagtcaacccatcctaactaacaggcctgcaattcttggaaatcactgccttctacggggtctacctgaacctgatagtgtatcttcaggacgttcttcatggcgacagtgcttcgaacgtggcgacggtcagttcttgggtcggaactgcctacctcatgcccatcctcggcgccgccgtcgccgactcttgctggggaaagtacacgacggtgttggccggcttctccatagctctcgtcgtaagcgatcttcccctgtaatgcacacgatctgcagaagcacaatggcgctctctgcttctctgacggacacaatccgaacacagggcatggtcaccatcaccgcgtcggccacgctgccgtctctgagaccgccgtcgtgcgggcagagcgcctactgcgtcccggcgacgctcagccagaagctggtcttcttcacgggcatatacctctgcgccctcgggatcggcggcgcgaaggccgtgctgatcgcgttcgggccggagcagctcgacgacgacgacggcggcggcaagaacgagcgggtgcgggagaggaaggcgtcctacttcagctggtactacgcggtggccaacgtgggcatgctcacggcggggacgatgctggtttggttcgaggacaacgtgagctgggggttcgggtacggcctgtgcgcgtcgttcgtcgcggtcgcggtcgtcgtcctcgccgcgacagcgcccatgtaccggatcctgcccccggcgggcagcccgttgaagagtgtgatccaagtgcttgtggcgttctctcacaaggctaaattgactttgccggacgatccaactgaactgtacgaggacgacggcgtcaagaactcgttgcagcatccggtgcacgaacgattagagcacaccaaccaattcaggtagtaatctaatatattctcatggagctaggtgaacaaccatggtctcagagactcgtccctttgcgatgcactaggtgtttggacaaggctgccattgtcagcgacgaggatctggaagacggcgacaggtggaggctgtgcacggtgtcccaggtggaggaggtcaagattctgctgcggttgatcccgatatggctcacgtcggcggtctacttcatcgcgaacacgcaggctcagaccacgttcgtgcagcagggcaccaagacggacggccggatcgcgcgcggcgcattctccgtcccggccgcgtcgctgtcgtccttccagatggcgttcgtcgccgtcttcgtcacgctctacaacagggccgtgatgcccgcggcgcgccggtgcctcggccgcgccgtggcgttcacgccgctgcagctcatggggttcggccacgcgacggcggtcgtcgcggtgggcgtggccgcgtgcaccgaggcgcgccggctgcacgcggccagggccggggcgcccgccatgggcatcgcgtggctgctgccgcagtacctcgtgatggccgcctccgacgcgtcgctcaccgtcgggcagctggagttcttctacgaccagtcgccggagacgatgcggagcgcgtcgacggcgttctacttcctcgccatatcgctcgggaacctgctcaactctcagctggtgactctggtggcgaaggtgaccgcggtatggggcaatgcagggtggtttccactggacttggatgacggtcacctggattacttcttcctgctcatcgtggccatcaccgcggtgaacttcgcagtttacgtcgccctcgccaagaactacacgccaaagaaggttaggtagggattatacttgacattcgcttgtgtcagaacaacagaaaaatgctttgacgacgggatgcagaacatgcgccggcgaaggggctcgacggccgtcgtcgtccgccactccgcgtcgagcacctgaaatggcaagtgaatggtcttgcaataaacagccataggagggccttatatgtaaagaaacatagtacataggcaaaaacatgggcctaattttaatgggccgatttggacagattgactatctgtgggctgtaccctcaatttgttgggccagcatggatcgacatcactggcagcgatccagatttgatgggccaagatgcgacgcaactttcgccggcgaactagacaagctgaattttgcgggggctccttgctagggggcttcctaacgggcgcgtgcacgctagctgcctatctggcgcagccgcgcacgtccctatttcacttctcagcgctaataacgctgattagtattgatgaccttaattagcgctaatgataattgttagtattagttttttttcaaaaaataatacataaatagaacttttaactcagatgtggaaaactttcaacccggatttgaaactttcaattcggatttaaaaactttcgacccagatttgaaaacttttatccaaatttgaaaactttcaactcagatttaaaaactttcgactcggatttgaaaactttcaagtcaagatttttttaaaacttttaactcatatttaaaaattttcaagtcaagatttaaatactttcaatctaatttttttttaaaaaaaaattcaacttatattttaaaactttcaaatctagatttgaaaactttcaactcggatttaaaaacttttaactaaagattcgaaaattttcaattcagatttaaaaactttcatctgaaaatttaaaacatttaactcaaatttgaaaaattttatctaaaaattcaaaaaatcaactcaaatcttaaaaattttctactcaaattcaaaactttcaactaaaatcaaagatgaaatattcaacttctaaaataaaaaaattgcgaaaaaaggcaaagagaaactaaaaaaacgcatacgtaggtttaggtttttcagaaaaaaaaaggacgtggacgccgtccgcgcgcatacgcgccagcgccgtgggccttatgggcctaaacgcgcgccgccaacgcgtacgcgcgaattagctctggcgccttgctagcgcgttcgcgctgatagcgagcactcccctcttttaagtcttattaactatctctattagttaatatacttaacactaataatagtaattaggaaatattctcgagattttttgggagattttttactaacagattgaaaactttttaagttagatttgaaaactttcaatttaagttttaaattttaaagtcaaattttgaaaactttcaacttagatttgaaaattttcaagttagatttgaaaactttcaacttagattcgaaaactttcaactcgagaatcgagattcgaaaactttcaaatccagatttaaaatttttgaaaacttttaatttgagattcgaaaactttcaactcgagattcgaaaactttcaactccagattcgaaaaatttgaaaactttcaaatcgagattttaaaactttcaactcgatatttgaaaatattcaagttcaaatttaaaaattttcaactcaaaattttaaaactttcaaactcaaaacgtgctaaagattaaaaataaaaaaaaagtgggaaaagacgaaaaaaatgggtaaaaaaagggaaaaaaagcgtaggcggaggcgcgcgcgccgagaattagcgatcgcgaaatttcgttctccgtatcgttgggctagaactgcccatcgtacctaagtacctatttcgttgatctattagaccgtaaaaatttgatctgacggtcaccagcaatcctcctccatagcagaagaagagcgcgcgggctcctacttttctcctcggccctcaccgccgctcgccggagctcccgtcgtgtttcccccacctaccctttttcagacatgcagttttacaggctggacgatctgaactacgtggagattcggcaaacctgcccatcaattttgacggggaggtgatgctgccgatctgatcaagcacgcagatcgggctattatctgttcaattctctcttcttcttttttaagggtatcagtacgagattgtgctatttcattaaaaatagagggaacaaagtataactcgtagggataaaaaaaaatgagaaatgtacaaaactgagaaggcctatacacaatttgatataaaatctcgtagcctccttgctcccgccatggtcctagttgttgcctcttcttttatttttttcataaggttaagggtcgcagtctccttgtgtttgaaaacccactgatttctttccttccagatctcctaaactattaaaataattagagtccgaaggcctttcttaagcacatactttatattggctagcatttcttaccaattttggacgctctggcatagagcctagtggcatgggtccagatgctcgtaagccaaacggcttagagcaggtacaattaacatattttaatgagataaacgacgagacagaagagcaacggactacagatctgtagcaagctacagcacggattataagacgtaatgtgtgtatgacatgtgggacaatatattaatagtatagtaagcaactattatatgaatagctattaaattggctgtagatgaattggagctaacagtgggctatactattaaactcttacccaatctcaaaaaacgaaggagaatcgagcagcggaacagtcttcacagagatttttccagagttacatgcgactagttctaaaaaagattaaaaagaatttgaacgcaacggtcggcggcaactacctcctagcaaagatcaaagaagatttcaggcttgcgggagttgcggcatcgtctggttggtgagggcgtgaggccacggcgcgcttttacgagtttcgtcaagcggaggttgttgagctcgatcgatcgctggtcaatctcgaccggcctaaactacttgaccgaggaaattcgccaccacctgctcttcccaagtttctttggagctctcgcgtcgtcctcccctgggggcggcacgggaggcggcgacccggccacccctctccctcccctcctccccctctgcttcgccgccgcccgagcggccgccggcaaagccggccggccgcaaggacggcagcggcggggcctctcgcgtcctctcttccgggcgggcagggggccgtcctaggtggagcggcggtgaccgctagatccggcccgctccggccggatctggcggggcagcgactggcggcggcgagggtggcggcaacggcggcggggagggcgacggcgatgtcaagggcgcatgacgctgggcggcggttgctgaaggcggcggggacgg

SEQ ID NO: 18043 - DNA, 8005 bp, Oryza sativa
cggccggatctagataccggcggcagttggtgacgacggcggctgtgtggtgtcggcggcggcggcggcggcagtgggccggcggaaacgtggtggctgccgtgtcaactggcaacggtggtggaagccatggcgttgagatgctagctgctcggtggtggagggcgacggtgcagcaaaggttttgcggaggcggtggtgacgtcggcggcggggaaggagtcgggtgcgaggtggggatgatgacggcgaggtggttgggtgttcggcagcagcggctgtggtggtggtgaccgtgttcgcagtcaccggaggcatggcggcctcggttgactagccgagggcgtgggagacggtcgcatctggtcggcgcggcaccgttcggtggaggggtcggagaccggcttagcacagagaagtgcagccgatggcagcgcaggccagctcggcgcgagaggcacgggcggcggagatggaggccggcttggcgcgggaggcgcagccgatggagggaggccggattggcgcgagaggcgcgtccagtagaggaggccggcttagcgcagagaggcggccggcggtggaggaggcgacctaggtgtgaggaggagctgccggtgggtgtggcgcggtcttcggtgcacgaaggctggccggcgggggacgccggtgcaggggtcccacatgtcggcaaagcttgtgtggtggtagagcatcgtgcatcagtcgtggtttcgcaggggcgatctcgtctgtgccctttgttgatctagtggcggtcggtcacgcttagcggcggccgatccggtgctagccttctcctggtcgtgtgggtagtggtatattttttccttttcctagttacgactctccagggttgtaatcttataattttttcctgctctatcaatagaacttcgcaccgtctcgtgcgagtcgttcaaaaaaaaaaaatctcgaccggccttcacgtacgtatggccgaaagcgataactcgattagacgatagtaaatctcatcgaaatggtgagaataagctggacactaaggccctctttgtttaggcttataagccaacttataagtcgaaaagtttaagccaaaacaaacaagcagctttttcatttggctttttttgaagccataagccactctaacactattaagccaaaagctagattggagaagcttttttggcttatatgagatagatgtatgactccaccactaaacttaggacattaaatccactggcttataaattatataagccaataagttgatttaaaagtctaggccaataagcctaagcctaaacaaagagggcctaaggccttgtttagttattaaatttttttttcaaaaaatattacatcgaatctttggatacatacatatagcattaaatatatataaaaaactaattgcacagtttgcatgaaaatcacgagataaatcttttgagcctaattagtccatgattagccataagtgttacagtaacccgcatatgctaataacggattaattagacttaataaattcgtctcgcggtttccaggcgagttatgaaattagttttttccttcgtgtctaaaaactccttccgacatctggtcaaaacatatacccatttttttcacgaacgaaatacccattatttgcttctccacttctgactcgtccgtttatccacctaccatttcagacatgagatcttgggggtccatgtcatcagcatggcctgactgtttgggtgtagttgaatctgaatgcgtgaggacatttttgggaggacctggattcaggtattggttgatgttttggggccagactgtttggtaaaacaagactgattagtcatcgcattggataaattatatagaagggatgttgatcataagctttatttattttggtagattgattactacttgcgcctcaagcgtgattcaaattaagcagagaacagaagccgcacaataggacttcgccacgggtgataccatcggtgacggttgtgtgagttggcggggagagcagggtgtaggtgatcgtaacatttcttcagtcaaagcatcacgtgttcatgtgatctcactatataagtcttttgtccatcttactgaaagttctctaataacctgtcgattttactgaatctctcaacaaccacataataacggtgtcttgcaccaaacaaactgaaggatctctagcatagttgcatttccctgtgacgtcaatgtgttgggttttttttacagcaattcgagaagcgtgcatataaaaaatgagaaaatagaatatgagtgcttgtacttccaaagacagctttaggctgtgttgaacaggacatgttggtaactaatcttctctacacgtaaaatggaatggcttattagtacatgattaattaagtattagctaaaatgcttgaaaatggattgatataattttgtaatgcaacttttctattttttctataaaatatacactgtttagcagtttaaatatcgtgcacaataaaaatagggggggttagaaattggaaaaaggggagtatatatataccgcagccttagaagaggtagaaacaaatatggataagattcagacagaattaagcattttattcccttctgtgtttttttccatcttagttctacggtgagcagttgcagaccgcaaaagtgcaaaacatgtctagtttgtatgcacgctaaccgctaaggcatgcatgcatatggtcgattgttgaatgttgactgagctaaattctctcttatcactccgctttcattatcagcaataaatctgttaactttgcattgtccacaaacaaaagaacaacggtaacaaagcaatacatgagaaaatcgcgtggatttagaattgcgtgttgtcaagacaaacacttcattatttgcatattggataatcatattagatcaggttagaatggtgtaacaaaattcagaaagaccgcttcacgtttataacgcgtacctgaactatccaaccagacactatattgtttgtttattgtcagaggaaatggaggaatggaacgcgtcagttatgacaaagatgaagcaactgtgtcgaacacctagtaccgtgtccgaagaaccagcagagttacggtgcatgctactatgaaaagagcaaattgaagcagtaaacagtgacagcgacttaggattgctcgtgcagttgcttggtttttccttgctgatagtgaatgtaggtgaagaacaaaaactctttccgaagaggtctcgctgtctcacctgtcttcttgtagtttgactgttattctgagcagctgatgtaatttcaagtagtagtggataagtgccctgcgtgcacattttaatcccgctggaccgttcatgcttgtacagaaattccctctctctttttttaacaaagggagggaattccgaccttgcaggtagccaccttaaagattgagcacatttcctgaccaaattacagtgtttgttctgaactctgaagttcagtggtggtacctaaacgtgatcgcaaagaacaagaaacctgaaacttacaagaaaaatggaaaagtacccaccacatgccgaattatctttgacggatcttccacagataaccttgatacggtttcttcagttttctccagcacgggtcaaagacactgaactgaatcttcttctgacagtgaagcagggaacaccacattaagccgagacgcatctttccgtagatagccgccgaggtaaattcggcacgtttcagaatccagctagaagattgggtgcagcaaattctcgatagatagttgttgccacggcggcacgccgtcctcaaaaaggcgcagatcgcactccggacaaaagtgcagtagtagtctccttcaggagccaagactaatcggagcagctgctagcctgccacagccagccttcgcagcccgcgaccagcacagctcggaaatttcccgcacgtctcgcgaccaaaaaccattacgaccaactgcttgcttctcgatctttaattaattctgcagtggactagtattttacgcatgtgcgcgctaaaatagagcaatgaaaccgtgcaaggaaagcataaatgcgtaatagtagtataatacaatttgcgttcacctaaaaacgcagagatttgaattgatctcgcgctgatattttttatttttctcactggggtgggtagatggtgactgcggccagggcgcttacctgttctctccatctctctcgcgggaagcgtatataagctgccctgcttgccgctcatttccatctctcgtgctcagctcgcagccaaaaaccccaaggcgctctcacgacggcaggagctagcttagctgcagaaaaagcaggtgacgttgaattctgatttctgaacgagttgcagcagcatagcgacaatggacgccggcgacgccatggagagaggccagcagcggctgccagaggtaagcatatgcacaacttcacaactatctcgttctcctcctctcaccggtttcgctcatcatgaattgatctttcttagtactccagtttgcaacttggaaacaagcgatggcagtgagaatgcacgcatatggatcataactatagcatagtaattttcaggcatgctgttattggtttcaccttctttaaattcagagttcagattgaagaatgggttgttatcaggttcaccaaaatgacagaacagaggtgaataggtgaacgaaggaaacagtcatggtctacatctatgtggtgcagttgcaccactatttgacccttttctacgcaagatagagaataatgttacggctaagacgaaccgtatccaaacacactatagtcgtacgacgtattggcacgttgccacgagggtgagttggtggcaacacactcattggtcaggtctccatggttaaaacgagcgtgaaaaattctgaagtcagaaaaaattaatagtgtgtgtttaatactaagaaattttgtcagacttttcacgcataagtttaaaaaaaagttggtcagaaaactaaagcaacagaacacatacacacaagtgcaccacaaccaccgtatacctttcgtattcatctgtacaaagctgcttcctttatccctttacgattttcaagtacaatcgctgacgtctacaacaacgccgcaaaaactttgatggcttgttcagatatacaagaaataaaaaaaaatgtaaactgacatgttctccccaaactttgaacttgatctgcagagctggaacccgaaactccaggacgacgtcagcctgacggtgccactcatccaggacaagaagagcgggagcaaagcgccggcggtggtgctaggattcgagtgcttggagagcacagcgttcaacggcattgccacgaacctggtggtgtacctggagaccgtcctgcacggcagcagcctcgcgagcgcgtccaatgtcacgacgtggttcggcacgagctacctcacgccggtgttcggcgccatcatcgccgacacgttcttcggcaactacaacaccatcctcgtctccctcgtgttctacctcctgggcatggtgctggtcaccttctcggcgttcctgccgaccaccgcgctgtgcgccgtggcgggctcgacgtcgtgccagcagcctgtgtttggcgcgcagaccatcgccttcgtggggctctacctcgtggcgttcggcagcggcggcgtgcgcgcggcgctgctgccgttcggcgcggagcagttcgacgacgacaacgcggtggaccgggagcggaagatgtccttcttcagctggttctacatgtgcgtcgacttcgggatgatcgtgtcgggcctattcatcgtgtggatccagcagaacgtgagctggggactcggcttcggcatcgccacggtttgcgtcgcgatcgcgttcggcggcttcgtgctcgccacgcccatgtacaagcgcagcatgcccaccggcacgccgctcaagagcctcgcccaggtggtggtcgccgcgtgccggaaggtcagcctccgtgtccccgccgacgccgccctcctctacgaggtccatgacaagatcgatcagcccaagatcacgcacaccgacgagttcagctttcttgacaaggcggcggtgatcgtgcagtccgacctggaagaggactcgaacgacgcctcggcggcggccgcgggctcgtggaggctatgcacggtgacgcaggtggaggagctcaagatcctgatgcggctgctgccgatatgggcgacgagcatcgtgctgtcggcggcgtacgcgcagctgaacaccacgttcgtgcagcagggcgccgcgatgaacatgcggatcatgtcgttcaccatccccgccgcgtcgatggtgtccttcgaggtgttctgcgtcctggcatgggtgctcgtctacggctcggtgatcgtgccgctcctcaggagcttctccccggccaacggcgagccgtcgcagctgcggcgcatgggcgccggccgtctgctcatcgcggtcgccatggccatcgccgcgctggtggagatggtgcgcctcgacgcggcggcgcgcggcgagtccctgagcatcgcgtggcagatgccgcagtacttcatgctggccggcggtgaggtgttctgctacatcgcgcagctggagttcttctacagcgaggcgccggagtccatgaagagcatctgcacgtcgctggcgctgctcaccgtggcgctgggaagctacatgagctccttcatctacgccgtcgtgaacgcgttcaccgccgtggacggccggcccgggtggatttcggacaacctcaacgagggacacctggactacttcttctgggtcatgtcggcgctgtgcacgctcaacttcgtcgtgtacagcgcgttcgcgcggaactacaaggtgaagacggtcgtgtcatgatcgctcgcccacacgtccgcgcgtacataggcaaaacaaggtagcgttaggaacggggtgcgtccaggaaatacacgggacacgtccggtgcacctgcgaaacggtttttgtatcgcagcgaccaatatcttctggctgctgctgatcgacgccatcgtgttccttgttgtttattgtttctttctttttgtcggttttactggaaaggaaatacggatgggcaacaggacatccatgaactttatttatgctgtggtcctgaaagaaaaaacagaaggaaatgcaatgtggaaacatggtgtgaccgtgtgagtgataccgcacatttcatggtagtactctgcaacagttatggccgttggtgatcaaatctctatgggccgtttgtaaatctcgaccataaatcaaaactcttaaatttatgggccatttgtaaacttgccaacgctaggacccagaatgcgctgtcgagagtccagagcccagccttggccgcagtgatgaataaatgggccatatctggaccggcatcatcgaagtgtatctacagccaggaaaaggcccatttggctccctcaaatatatgagtcatatacacggtaaaatttacaacaaaatagtcaaagttcacattatttgctataggacaccgtaaaaacatgataattagttactagacacgaacagattattttattatatccgttgcaagtacagatagagaaactttttaaaatgataagtttgtccatagggcttatttatttttaacccgagcagatctagttcaaaccggacccatactaagagagtgagaatggactggattgggagagtcagaatggtctggtctgatttgaatcagacccaatcaccttacaaacagatcaacacatgagtaatttactactttccacgctgttactctccgcgtttgtaccggatgtaatgaaatccgtgttttcattgtgtcctttaacaaatactccctccgtcccataatataagtgattttgagtttttgtttgcattatttgaccact

SEQ ID NO: 18044 - DNA, 5215 bp, Oryza sativa
tcgcgaactaacttaaatataaccatcacttgctaatactttatccaattatctagtagttcttgcgttctctcgtgagaatctcatcgcgtgatgatttcgggcagtggaccggtgtcgcgcatgtgcgcgttaataaccatttgatagccacgaatcaattagaacatgtacaatagcaggctataaaccagctataaccacatatcgagaagaaaagagaagagagaagaaagcggactatagatttatagccggctgcaacacggactccaatacgttatgagtatataagagataggaccgaatattaatgatgtagtatatttttatagataactattatataaatgggctattagattgactataaatgatttggagcccagttggctatactattgaacttgctcttaacaagtactacaactgcagcgtttgaaccgatctcgcctcgctctaataacacttcatcttccgagttccgattgtccggggttggtgagttggtctgttggtggccggggcgcgggcgcgcttacctgttctccctcgcgtggagctctttgactacgcccgccagctgcgcgtgtgtataaccttgcttgcttgcctctcacagccgaagtcgcaggcgcagtcaggagctatcgggaaaacgggatttcccccagctttccaaggttcgcgggtcaatctcgcagtgatactccggcggcggcaatggacgccggcgaaatcatcgtggcccagccatcgccgcggctgtataaggtatgtgaaacttcatgagcgagctcgccgtcgacccaagcttagggagatatagggattgatattatcggtgcagcagtgcgtgattagttgtttagtttagcttgcttcttaatttgagggctttcatttggagtttataatctgattgtttggattgcttttgtgcagagtttgactttccggaggatcgcgacgaaggaaaggaccattccccaggatgaagagatgaaggtaagcacctcttgatcacgtttgaactcgtcctctgttgttaattagtcattaacttgcgtagttgtagtccgtagtaatagaaaaacttggcgggcggggtgcgatgtgtgatgatctgctgcaagaactgagaaatttttgcgtcaaaaaggaactgagaaatttttggataatggatcacataactcgtcttctaaactctaataaatggatgtatacgaccattttgtgcattcgttttagtaaaaaaagcagctacacattgttttcttgtttttgctagtactttaatatagtatacatgctatattgttggtttattacggattccatttttcaggtgtcctatggtaataattttcgcaagtgtttttttttgaattcatcactgcagacaacaagaaatatgatttaatggtcaaattgattaccctgcaaattgtgttgtgacaataaaatgatattctcaatttcaagaggccagcatgcaatttctactatcataaaatagtgaaattaattgaccgtatcaagaactgtacacaactgttaggtttttcaagttattgtactagaccgtatccacctgccagatttttgttctaaaagcgtaatttattttatattaagctattatcaatatctcgatgcaaatgtgtgttcttttttattaaaagattctttcactagggaaaaacgtccggccaatcaatttgtcccagcatagtcgccctatgggctatttttataggccttaggcagccgtacgccctgttgaaaaaaaaaaagactcccagctcaaacccagcccaaaacatctgttaatttggttttacatgtaaaatcattgggagcccgtagattcagaaacaaaggtctcaaattggatatttttcttaatttttatattatttcatattatttctaaaagattaaaaaataaattacagttttaaagttttgcaaaaatttactcctcccgccctaccgtagagcgatatatgtgacatggcaatccagggagggggtgccgtggcaattttgcataaatcgccctcccctaggacgatttattcttgagaaggagccatctataaaattgtcatgacgcaaaatttagtgatgcatcgggtgcgttatggcaattttacaaggctcccacccgaggagaaatcgccttcctgtaaagtgatttatctttcaagggggccacctacaaattgtcacggtatacctcccacggggtgccatgccacatagattgtcctattgtaaggtgatttataagtccacttttcgatatgtaaaattttaaaatgataatttattttttaattttttttaaaaaaataaacaaatcctcaaattgtgcaatcttttgaggccttatttcgttgcaaactttttcttcaaacttctaacttttctatcacatcaaaacttttttacacacgtaaactttcaacttttctatcacattgttttaattttaaccaaactttcaattttaacgtaaactagacacatcctgacttcgttcgcagattcgcagcccgaggttccaggacgaaagcctcactgcgccatttatactagacaagaaagcgaggagcaaagcgccaacagtggtcctaggattcgagtgcttggagagcacagcatttaacggcattgccacgaacctggtggtgtacctggagactctcctgcacggcagcaatctcgcgagcgcgtccaatgtcacgacgtggttcgggacgagctacctcaccccggtgttcggcgccatcatcgccgacacgttctggggcaactacaacaccatcctcgtctccctcgtcttctatctccttgtaagcatcaatgcattttgcaagatagtatgttgaaatccatatgtccaatgtgcttaattaactttgcaatccatcgtctgtgtgcagggtatgatgctggtcaccttctcggcgttcctgccgaccaccgcgctgtgcaccgtggtgggctcgtcgtgccagcagccacttcttggcgcgcagaccatcgccttcctcgggctctacctcgtggcgttcggaagcggcggtgtgcgcgcggcgctgctgccgttcggcgcggaccagttcgacgatgacaacacggccgaccgcgagcgcaagatgtccttcttcagctggttctacatctgcgtcgacttcgggatgatcgtgtcgggccttttcatcgtgtggatccagcagaacgttagctggggacttggcttcggcatcgccacggcctgcatcgcgctcgccttcggcggcttcgtgctcgccacgcccatgtacaagcgccgcatgcccacaggcacgccgatcaagagcctcgcgcaggtcgtggttgccgcgtgccggaaggcaagactccgtgtccccgcggacactactcttctctacgaagtccatgacaagatcaaccagtcgaagatagcgcacaccgaccagttcggctttcttgacaaggccgcggtggtcatggagtccgacttggaagaggaatcgaacgacgtcgcggcggatgcctcgtggaggatctgcacggtgacgcaggtcgaggagctcaagatcctgctgcggctattgccgatatgggcgacgagtatcgtgctttcggcggcgtacgcgcagctgaacacgacgttcgtgcagcagggcgccgcgatgaacatgcggatcatgtcgttcaccatcccgcccgcgtcgatggtgtccttcgaggtgctctgcgtcctggcatgggttctcatgtacagctccgtgatcgtgcccatgctcaacagcttatccctggccaacggcgagccgtcgcagctgcagcggatgggcgcggggcggctgctcatggcgttcgcgatggccgtcgcggcgctggtggagatgatgcggctggacgcggcggggcgcggcgagtccctgagcatcgcgtggcagatgccgcagtacttcgcgctggccggcgcggaggtgttctgctacatcgcgcagctggagttcttctacagcgaggcgccggagtccatgaagagcatgtgcacgtccctggcgctgctcaccgtggcgctgggaagctacatgagctcattcatctacgccgtcgtgaacgcgttcaccgccgtggacgggcggcccgggtggatatcggacaacctcaacgaaggacacatggactacttcttctgggtcatggcggcgctgtgcacgctcaacttcgtcgtgtacagcgcgttcgcccggacctacagggtgaagctggtcgtgtcgtgattgttcgttactcccttaccatgatcaggttacacgcaatcgtggtcgtattgtgttacagaagaatcttgtactcctagctagcaatagcgacagccgacagtatgtgtaaagttcaaggaaaaaaaacaaggtttgatgggctgacagcccagcagcttcctttatgggccgtgtgcttgccaccggggctgatcggtccaaaaggctactccaataaaaggaaaacgtccactttgattcgtaacgtttaaacccaaaatcgggtataaggactctctcaactattaaaatcgattaaaaatagcccctacaataatactattaaggatggtatttgctgatgtggcatgctaaccataatcaaaaccacgagttagtaagaaaattgggaatattacatggagtcgacatgtcattctcactattctttccctttttatttccctccctctctgctcccatatctctctctcctccctctttcccgtcggcagtagagaggacaggagcgatggcaggtgctcgaggatggtggcagtaaccaccagcattggtagccataggtgtcagagaggtggatggggaacaggcgacggctgaagaaacaggcagcccaatctcacctgatatgcccacaccgctcctggcccataatccccataatcattatggtcacaacgatagctgaaccccgtccatgagaagttcacctgcccatccatggaaagaaaggaagcaacggtggtggtcggaaggtctctttgagctcaagctcatctccttgtccccatcgtcggtgaggcccttcaagctctgggatccggcaacaaaagaaaccaagctactctggctctgaatggcactcgatggtaaagttcctgactagtcacgcatccaga

SEQ ID NO: 18045 - DNA, 3078 bp, Oryza sativa
tttatatccgactcccacgctcccttcccccattttccccatcgctccagctccttccacaagttccactgcaattctgcaaacgaaccagctcaaatcgaagctcgaaacagggagagccagagaagcgcgcgtccgcgacggcgagtacgcaggcatggacttccacgcgctcccccgccgcgacctgcaggcgctgtgcaagcgcaacggcgtccgcgccaacatgaccaacgccgccatggccgatgccctcgccaagctcgccacggtaagccccgtcaactgttcgaccggccgtcgcttcagtcgcccattgccgtcctggattttgtttggtgcgggatgctcatgtgctacctcgccgggcccttcgcgttccaggttgatgggatcgaggagttcgtcaagcaggcagtcgccctgccaccggcgccggcgaccaagccggcggttaaggcggtggcggaggaggatccgcgcgagaagaaggggagcccgctcccgcgcggccgccgcgtcacggtcagctcgccggaggtggtcaacctggacgacagcgacgaggaggctccggggcagagtaaggacgcccctctcccccgtggccgccgcggcacggtcaggtcgtcgaagctcatcaggccggacgacggcgaggaggagggcaaggaggacgaaaatcggggcgagaacgcgcctgtgcatggcgaggggcggcgcggtgccagcaggcgcgcccgggccgagcccgtggtcgctccaactacgaggagaagggccgctcccactagtaagatcgagacaggtgatgtggctgtggaagcgccaccggctccgaccactcgccggaggccgcagactagtacggaggctgcaccggcaccaaccactcgccggagggcccagagtactgtagcagcatctgcagaggagaaggtgccgaggggtagacggacgacgaggagagcagcggcgaagaagcccgatatgctggaggaagaaaccagagaacctcttgcgcctgagcaaaatagcgcacacgaggagccagtgcaggaagagcaaggtgaaatctcaattctatcaaccatttcgctcgaaacttgtaatagatccatttcattattatgtagttttgaggtctgaatttagtgtgcatgttgttcaattggggaaattcaggaattgaagtggaggtgcctgcagaaactgtcgaggcagtagctcaggaatgcttgcctgaccctgatgcagtagttgaagagaagccggtgcaggaagaggaaggtgagatctccgttctgttaacgatttcactagctccatttcattcttctttagttgggaggtctgacttgagtgtgcctgttcgattggtaaattcagggatagaagtggaagcacctgcagaaactgtcgaggcagtagctcaggaatgctcacctgatgcagttgtagaagatgagcaggcagctgtcgaagctgaacagactatcagccaggatgattcgcccatttttggcatcgtgactgggacaattgttggagcgagtgaggaagcccctgtgtgcaacagtgagtgtcccaagaacatggcgactgaagagagttccgacacagttagtgaagagaaggaagccgtgcctgctgatgaggtgccgctggttacggtgacatgcggcgaagcaactagggatgctgaattgcccaccaatattggcaatgccaaagaagaggatgatgatgaaatggaggctgcgcatgaggctggttttgcggttgaagtggacggatctgagactgttgatgagctgattggtacactgacagagcatgctgacaatgccattcagcttaatttctcagcagagctcagttgtgctgatgaagaggcgggagtatttgccaccgatgatctgcagcagagctcagcgactgtgaagactatggtggcagacagcgaggccaacgaggaagaggatgcactggaagcagaaaatgaggtcggttttgcggttgaggagaaggaagttaggacaggcgatgagccgcatgaaacactgtcaaatgatgctgacggtgccattcagcttggggaggatgcactggaagcagcaaatgaggccggttgtgcagttgaggagaagggagttgagacagttgacgagccacatgatacagagacaaatgctgctgaaaatgctcaagaggagggagttgtggccagtgaggatctgctgcagatttcagagaccgagcaagatgaattcaactcggatatttgccatgccgttgaacacaatgaaagggacaatgtagaaagtgtgtcatcagagagggaggatgtcagtatggagaatgcgttcaccggtgacctcacactgaagttcgacggtcctggagacttgggtgatcgcaatacctctcttttggaagagggagctcggaccttgccactatctactgaaacgcccaacaatgtcactgatgcggtggtcacagctgccgaggaaatggtgtctgaaaccatgggtgtcagtaataagaagagtactgaactagctgcaatggaagacggcaacgaagtgaaggttgtggagaagcagaaggaggatcctgtggaactagttaaacttagcctaaggactcttagagccaagctcaaggagcagctgactaagcacaaggtaatgacacctgaccttatttatgcactgtagactatctattatataattaaaggaatagaaaaaggagcctccacgttcgctctcatggcttagaaattctcacattaatcagagaaaaagaaaaaacagagtccatatagaaatacaatttagaaatagctaaaatctggaattaaaaattaaaaaataaggaatattagaagaggagactagagtccatatagaaatacactttagaaatagttgaaattcggaattaaaaaataaggaatattataagaagagtatagagtccatatagaaatacaattaggaaataatagaaattcggaactaaaaataaggaatattagaagtagagtatagagtccatatagaaatacaa

SEQ ID NO: 18046 - DNA, 1839 bp, Oryza sativa
aaaaaaaaaggagcctccacgttcgctctcatgacctagaaattctcacattaatcagagaaaaagaaaaggcagagtccatatagtaatacaatttagaaatagctgaaattcataattaaaaaataaggaatattaaaagaggagactagagtctatatagaaatacaatttaaaaatagttgaaattcggaattaaaaaataaggaatattagaagaggagactagagtccatatagaaatacaatttagaaatagttgaaattaggaattaagaaataaggaatattagaagaggagactagagtccatatagaaatacaattaggaaataactaaaattcggaattaaaaataagaaatattagaagtagagtatagagtccatatagaaatacaattaggaaataaccgaaattcgaaattaaaaataagaaatattagaagtagagtatagagtccatatagaaatacaattaagaaaaaaaaagaaatttggaattaaaaataaggaatattagaagtagagtataaagtttatattggaatttaaaaccaactaaaattcagaataaaaaggagcctccacgttcgctctcatggcctagaaattctcacattaatcagagaaaaaaaagcatagtccatatagaaatacaatttagaaatagctgaaattcagaattaaaaaataagaaatattagaagaggagactagagtagttattacacattagtagttttgaaaagttattgcaaaatttaaaattatgttgttattgtaatatattttaataatataatgagaaaaatatatgctattatatgagagaaaatataatgatgctagccgcgcaatctgcgcgggccaccatgctagtttatcatataatgctgagtactaagacggctctataatgcagcgtaaggaagcaaaaagggtggccttgggcaggttggacgagaatgtttgttgattcaacacaactggacagcatcctgcaacaagccaaccaccaccctggaagatagaaagtgtgatcaacgtctttgttgcaagaacatatcatggggtttgcgttgctgtttgttttgtgaggttggtgatagtttggtgtgggttttggtcacgcaatggccacgtaaatcgacgagatgcgtgtgttgtgaaaccatggtttctgcaacctccgctcgaataatttatttatgtttcttcttctatttatgtacgattcgactgtattttaaagtctgatcgtagtaagctcatcacttcatcagctgcgtgtgtgcctgtttgtaagtgtgtattttcaaagttatttgcagttgctcaatctgttagatttctaatggcaaactagttgagactagtgtcctttcaaacatatatactcactgtccaagagtgtactagtactctgaaatatagccggcaaatttgagagtaatcggaacatcaatctgatgaacgtcacactaccttgtgctcttcagctcttgggcatccaaaacttgtgtcaaaatgtccggatcatttgctattgtcctttgctcctgatcagccaccctattcagcaagatggtattcagctcttatcaataccgtgtgccctcacgtgacactgattgcaaaccaaaccatccaacgacggggacacagctagaatatttatgcaccatcacgctcagaaaagattcaccggtaaccaaatacttatagtacggattaggacagaagtacattacagccacaagcaacatgagcacacgtcttttgcttgttcttattttaggcatcagcatcgcctcactgtaactaccgatgcacgcca

SEQ ID NO: 18047 - DNA, 6457 bp, Oryza sativa
gataaggaggcaggcagtaaaaaaaaatatctccctggatctggcccagtagagttcttttggtaaatcctagtactccgctagactttctagtttctagtttctacaggtaccacagatcgattgtttgagtcaggagattaaacaagtcttggttatctttctgaagtgttactgaggatgcccatatcaagagtcataaatcatgtggaagcatcaagcatgggagatctttactagttttaagcatactaactagaactaccatcaaactccttacggcaagaacacatgtaaagctccatagtccataaaaatcagtctgaaacataaaaaccaggctatataaccacggaagacaaaaaaaaaaaaaaaaaaaaaaaacttttgcgcgtgttcagagcctgaaacttcagaccaagcatgaacagctacggaaggaagacgagcagaagtgataccgtacctcggggaggcggccttgccggccaggacgcgggcgacgaagcttccagcgatcacccgccccttggagctagctactgctgccatgcaaaggtcgatcggacgagagaggaaggcgaaggttcagtgtttttcttgggcggcgagattgggaggagaagcggaagagtgggttttcaatcctgtggactgctcagctaccactccggctacttatagcgcccccgaggaggatgatgccggtacaccagcgtacagtcaccgtgacccggacggaaaaagagaatggtggtatattacggcgattgggaagccgcagtagtgacgaccatttggctaattgcgatggccgcagccaactaaccaacggctgaggcatgctgtccctcaacgactgcatcgatcttggccttcttggacactccgtccgcgctatgccgtccgattatatgactaagatcacgccttcttttatttcttttttgtttctttctttttcctttgatccttttcttttcttttttttccctttctttccttttctttttgacagagccacgcatttcaaacatgtgtggtgtgacttgtaggtacaaagaagttaacagctgaattccaacgcgaatttcaacactttgtactgcatggttatagtacttcggagaaaactggtccttgggaatgtttgtttgatgttttatagttatataaaacacaattaaacacctttttgttttcacaaaactgttaaaggagttttaaaaccttgatctagaatttcaaatggttggcactataaacatcaagggataagagagagagaagggttgagggggactgcatgagtaacgtactcgtttaccactccagccccttttgtgcaataaatttctcattcaaaatggcattctttttcctgcaaatgaaaaatggtggacggtcgaatctgtttttttatcactagtagtacatggaacaaggaattaaaggggatcaaagactttttgagtagcgttgattcgaatgtgctgagaaaatagcattgttgaagcattcagatatcgttaacaatcaacttgtattggtagacgtcgacatcaatgtgtttatgtagtgatacagtacagcgtatatagtagtaacattcatactaagcaactaggcgagtcttcgtctgctgatggttaatatatgcttggaaaacttcgtttccttccccgtgtaaataaaatcataaaaaaaaacccaccaactttccatcacccaaaccttacggaaacaaaaggtttcaaatttgaggagtatacatatgcacatatggtacataatactatgagctacgttaaaaaaaaaacgatctatacattctgtctagatcggtttttattttcggacggatggagtatgctgttactaatggagtaggaacgtcgatgacaacagatatactgctccatccattccaaattgatctacatatttttttttggtgaataaccaaagtggtcctcaagtttcatctgaggctcagtttagtccttgatatttcaatctatacatattagtccttcaagttttcattttagttcaaacttatccttgaaccaacaattctcttcataaatgacacttatacccctcatcatttacatatacaagagaaaaattgcatgcttgaattttttatagataatacatagtatatattatgtaaaacgaagaaaaaaaatatgtactaacaagtgtatacgatagcaattgcttaagtttcatgtgcacatgttgaaataatgggaagtacatctgtaatgttgtttattcatgttggctttctcttttctagtatatagatgtatataaattaagggcaaaaaggacattttctaatagaaatattgactagaaatagccatatggcatattaagtggacccaaggatgatttcaagccaaaacaaatatttgaaggacctacgtggacaaaatgaaatgtaaatgaccaaattgagtcttcgctgaaacttgagggactaaattagctattcacccttttttttaggttatttataaatgatctacatatttgtgtttattcgttaagtctattcgttatttgtgcattggagtaaatagacattgatgcatacatccatacacacaagtatttataatccacatgcaatatcttgatttgctattggctaagaaatagtggggatggtgtatgcatcgagtttgttgctagaataaatatagtatgagagagttattagtttttcttgatcttggtgtacttataaaatatatagatcaatttggaatggagggagtaatacttgcgaattgaccagcagtgcatgcattggagattgagggctacataattaaaaaataagcataactttgcttagggtagacccaacccaaaacactagacatggttttcataaactccacatcatcaagaaactagtattatacactactcttccaatgcaaacaccactattctatacttcaatttaatgctacttagagcacctgcaatggtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtagaaaaatatgctgacatggatctcttatagagagcctatagataaccattgtgggtgcccttatctcacatgatgtcttggatgttgtatagaaacaatgtctcatgcaagacatggtttccttttctttcctcatttattcacttgccacatcattttttttcctaggtgacaacttatttaatgctatggacaccatcttagacattgggttggggatggacttacccagagcagaataagtacgtgcagcctgtcttaggtctcgtcttccaccggccgccgttaattagctgattagctcgtacctggtacagtttctcctatcaagtgtactgtgtagcccacatcggaatatgccatgcgagatccggattattaagcaccgactccgagtgcgtttctggtcaattagtactcgctacacgtgcctgcccttgtgtgcgtgtacggaagtcaggacgccgtgataagttgataatggagccacgaacgcatgatctgtgctggtaaattaactgtcatcgttttgacttagcgatcattgatcattcaacaggcagtactgctctgatatcgtccagatattcatggaccggagtttccagaattccagaattttcaaacatctctcaaatttgtcccctcccatgtctacgactacgaggaagaggccgaaaagagcaaaggcgttggcttgccagtgcaagtttctcccgataggtggcgtcaggctatctgccgcaaccgattggtcgttgggaattcgcactggcggagcgttactggtacctgaatacatgatggcaccccaggattaggataagcacgggacagtgggacatcgatcggcacgggcagtagctacctttgcgtgcgtgtgcgccgcgcacggttgaagccttgaagatgatgcacataggcacggcaccagacgcagacgatgatgcgtctcggcagcctaaagatagacccgattcggttgctacttacatgtgtcatagctgacgccttctccgtgccaggtttcaggtttgtccatggggagccagaaaagcgatcgatttgggcgcggttggggtcacctggtcacgaaagcgtgcgacgtgtcccacggcattggtagcgccgcgccgtgctcggttgccaccggccgccaacgcgtgcgacgcgatgtgggagccggaaccagatgcggcgtgtacgggttatggcccgccggccacacgtcgtgctcctgcgcgatttatcggtgactactcgtagctagcagtatagtaccgtagtattcccaaacggaatctcgcaaccactagagtgtacagtaatttatcccggcacagttgctgatcgcgacgctacagtagttccggtacgatggtggaagcgccactgaacaaacaaacatgccatgtgattgaagagccagcttacgacaattaatacggcatctcgccaaagcgaaaaccatagggccaacatggagtaaaaatttgttctcgttttaagttcatgcatgtgcccgtgtggcccgccacggtttccccccctcgatctctcccgacgtacgtgcgtgggtataggggtacagcacctgtcgttagctagaatcagatccccggctggaaaatggaaacacccgctcgtttcgccaatcgctgcaaaagtggaaacgcgatgagatggcgcctatctagtagctaaccccaacaacgatggctcattccggggcacaccagccgtgccgtgccgtgccgtacaacgcaccgctcggagccggaacggcgtccctttcatgagttcatcgtcgtcgatgatgcttccagcgcggtgtgttggcgtagtgcgcgagcgaacccggactgagataagatcctgactagtcacgtcgtgatcggtggagacacttttatccgcggcttgaattcgcacgaagaaaaatgaccacaccggcctaagagctttggacggtcgtactcgtctcggctgccaccgcgcttgaagtcctatcagactagcgctggccctgactaatcctgcacaaacattatccttttcaaaaggaaaagggaaaattgtcgggtttttttataactaaaattgtcggtttgctcaacgttttatttcatgatggggagtacctatacatctttcgaaagaattttatgatcgtatcacacagatttttaatttttggattaaaatctgatagatataataaaaagcaaaaagcaattaagaaacaccataatggacactaaattactatatcctcaagaaaaagaccaaatccaatacaaaatttaaaatttacatgcgaagattcaaaaattacattgtaacttacaaaagttgcagtgtaagtttcataaattacactgtaacttacaagaaaatgcactgtaaatttgagtgagaaaatcgagtgagagataagaaaaaatctttcgagtgagatatagcaaaattgttcatgatgaaacagacgtgccagatatttctgtgtttccacgacacacgattagcgtccaaaacttcggcccacatttggtaagaggtagcccaaacttccacgggtttgtggactaaacaccagaacggactctattttggataggactaaatccactaaagtcctttaatattggtccaatctgattcacatcctttaatcgtagcatccgatattttaatcccctactattaaaaatcggtggaaaaatgatttttttttatttggttttgagggtggtttttagtgacatggttcgttgacctaatccaaccagttgagttagcatatggggcctaaatgttagggattgtttgtcttatatcatatatcctctcgacctttcggtctcttgatccccatttgtctcaatgacgctgttgtcagtcttgatgacatcaggtacgatggttggatgctacatcgctgaggacagagaaatggaccgtggatcttctctttgtgttcgcccgcctcggttagcaggtcctcgatcaagaggtggcatcatagtcgtactcgagcatggcgtggaggctgacctcgatccggatagagtgcaggtcagcttcactcgaagatggtggcccgaggtggagcccatatcatcatgcacctcctcaatctctttgcgacgctgaggattccttgagcttagtgtcgatcaacctccttagctcgatgatgcagcgtcggtttccccgccaaccatgcaaggcaacatggtttgcgacgcggtaagg

SEQ ID NO: 18048 - DNA, 3501 bp, Oryza sativa
tcgaaagagttttgggcttcatagtcacgtactaaaagcttattgctccaaataggcttattaatgggcctttcaagtgttttcacgaaggcccaacccaatcagaaagtaagcacaactaggccgctatataaatgcgagtaacccgttcgagtcgaaaccctactgcgcctccactcccacccgtagcgcctccccgcgaacccactcccagccgccgccgccgccacctgcaaccgagggctcgccatgccgccgaagctcgacccgacgcaggtggtggatgtgttcgtccgcgtgaccggaggcgaggtgggcgcggcgtcgtcccttgcccccaagatcggccctctcggtctctcccccaagaagatcggtgaggacatcgccaaggagacggccaaggactggaagggcctccgcgtcaccgtcaagctcaccgtccagaaccgtcaggcgaaggtgtccgtcgtcccctccgccgcggcgctcgtcatcaaggccctcaaggagcccgagcgggacaggaagaaggtcaagaacatcaagcacagtggtaacatcagcctcgacgacgtcatcgagatcgccaggatcatgaggaacaggtccatggccaaggagatggccgggaccgtcaaggagatccttgggacctgcgtcagcgttgggtgcaccgtcgacggcaaggaccccaaggatctgcagcaggagatctccgatggcgaggtcgagatcccttcggcttaaaaggtatacaaatgcgtctttcttgttacccttttttgtagctaacttgcaatgcaattgttaaattcataaaattttcatgacacaagtctgttagtgccgtactgttctgctgtaatgtttatttttccatatgtaggtttatatgtaccaacatggtattggttgaaaatgaaatgcatttggcctcattgcttttatagctgtgtaaccctataattcttagtatgaaagcatatataactttttttaaccaagtccacgcactgtactctttgtttgcaacgttgaataatatgaatggaattacttgttttgtaactttaacaagagttgatcatcacttgtcatgcgttatactcgtgatattaagtgaccgtttctgtttacacttaccatcctgtttttcacttgttctgccgaaccgtgcaatttattgtgtaactttgctgttttggttgtctaggttattttcagtgtactactcgcattgtttctctatgcaacatactgcatttatgttaagctttagttaaccttcctgatgtttattggcaaggtactttgcccgatattttttgagacttttgattcctgtatggcgacggaaaatcatagggtgagataggagttattaggatgggattgccatttgattgaatcggtttatgattatatagtaagctcaaatagcttagtgcggagtatgtctgtaattgaatttatatctgattaaatgttttaatgggtatctaaatgtaattgatgaaaataaactattcactgtagcctgtcctgaaatcatgtatgtataaccatctttatgttttattaccttttcaggcttgatatttgaggacattaccatctcgtgctactgaagtgatcatttgttccaaaatgctgcttatgtaccttacgagacgatgtgattcgacctatttttgtcatgctttagtagtgatcttgttgagacctcaatgttactattgcaacttggtaccatttggtcctctggaatggagtttcaagtacttgcataatttaatctatagtcctgtctgatgagatgtctgattcagttttattttctgtgtgcttgatctgatcaaaatgcctactagtaatattttcaggaatctgtcactcttgcttgcacccgtttctgcaaatgggacattatgaacctgtatgattttctcagttcttttaccatgataaaagcacatctagccaattctgattactcacgaacttgctatttagcaatgggattttttctctattgacagtcgccaattctgcccatactattgtttcagtggatttcttttagagataggagtaggtgctgctgtttaccagcattaaatcaatcagtgggattttttatgaggaggtagtagttgtttagcatggaattaaacgatatgtggccatgagggttgttctatttggccatttacccgtcgagtcctcttcaaatttaaccccaatatctatttggccatgaggatatgtcacgattatcacatattcgagctgcttgaaccaaggatgtcataacatttcgtcagacgatgcaaaattcacgacatttaggatttagcatttcataaatagagctgcttgaaccaaggatgtcataacatttcgtcagacgatgcaaaattcacgacatttaggatttagcatttcataaataaaggaaacgaatttaacatggtaacagctaaacaaatgggccatccagatcgcaaacatgggtacacgacgagttcctacacgacgacgcatcctcgatcggcccatcgaatagcttagaacgacctaactgccttacaacgaaaacacggcccaacaccacaggaaactcccacgcgccgtggcggcgcgggaacagcagcagagtctccggcgagcttagaacaagggcggcgggagcgcggcggcggcggcggcgtggctgctccgcgcctggtggcagagctggcggagtctggtgggcacgtaccagatggcgaggcgcgggtgcgcggcgaagacggcgtcgatgtcgaatccgtggcgcgcggagatgtcgacgagcggcgcgtagcaggcctgcctccacgcccccacgttctcgccgcgggccttgtaggcgcgccgcagcgcgtccgacgcctcctcgtccaggcagtgcagcgcgtagcagtgcacgtagtgccgcatcttgggcttgttgatgtagctcgccccgaccttcttcgcgtaccggaacacctggttcgtcacctgcatccacccatacatgcatgatgcatgaaggccatttcattgcgtttcaccaccgagacgttcgcgtgtgcgtgcagctagctcgtgcacatgactcatgcgtcgcacagtgagatcacggatctgatcggctgcttgggggcgcaggagcgcatcgatgcagcagccggtccgtccgggctgtgagtggacgggatgcaaagccatccaatcaccctggaaccccgaccaggccgtgcgtgcattcatttcattgcaccgtctccgagctgagcgccctgatccacggcggcaggtgagctcacatggccgtacgtgcgagggattgccgccacggaatccgaggaagtggccgtcctcctccccctacctccatatggctccatggctgtggggtgtggctccattgccatgcatgcctacgctgatggctagggcccgacaagacaacacatggaacgcaggctttgc

SEQ ID NO: 18049 - DNA, 4688 bp, Oryza sativa
tcctgcagcccacacatggaacgcaggctttgccagcctacctgcaactgacacgtcggcactctttttcaggttggtacttggtactactgcgcatcggcgtacgcgctcgtgtccagctcttcctgaattcttctactacccgcgtacgtgaagcatccactacgtaatcactgtttgcttgtaacaaagcgaacggacggctatgcatgggactaatgaaacagggagagcacgagtgcatggcagaaataccggtatgacagaaacagggagcatcctgttaccatgtgatgtgtgttcctcgtctgtgagcatgaattggtagaatagattaacaccctagcaagtcttacagaaggaaagtgagcattcctgctgttttacgaatgtttttcaaaaggttttgcccgttgtacagttgattttctagaaattttaaacactgtcgcccttttaagtcaaagagccaatgctaaaagttttgaataggcggaaaacttaagcattgaaaatactcaagttatttactagatgctttagtaatcaactgtttgttaccatgcaatgataatgaatctttcgcacctttttaactcaagactggccaacagaatactcctactccatatctgacggcagcacgatgtatttgctcctactagtagtacttataggagtaactgtgaatgagtaataaacaataaacaagtcgagccgttgggatgacagtagtcttagggtgtgtttgaggagaaggggattggggagattggggagattgggaagatacgcaaaacgaggtgagccattagcacatgattaattgagtattaactattttaaacttcaaaaatggattaatatgattttttaaagcaactttcctatagaaattttttgtaaaaaacgcaccgtttagcagtttgggaagcgtgcgcacggaaaacgagatgcttttgtctctcaatcccccagattgcccaggaacgaacgttcccttattcagatcgtcttacgtctgcatgcttatgcaagaacgcgagcatagtagggtaggagtacgtaagatatagagtacgtaagatacgtaatgctcgtaaatcacgcgtaccttggttggggacttgtgtccatgcagcttagccatggattgcacctgcagcaggaagaggcggcactgctcgtacagatggaacaggtagtccagcccgttcttcttggccctcgccacctcgccgggctccgtcaccacgaaaggatgctccctctgccgctccccgccgccgccgccggccgacgactccgtcgactccgacccgccgccgccgtcctcgtcgcagcagtccatctcgtcctcctgcatgtccagccttaggtcgtccaccttcttcctcctcgccttcttgcccttcctcgccgcggatcccttcttcgcctgcttcttgccggtcaccatcctcctgccgttgtcgtcgtcgcccatgccgccgctccccgccatgtcatgctcgtcggacaacactgttcgcgtgcatgcatgcatcacagcatcgtgtacagaacaagcacaggaacatggttaagaatttaaccgatcagcttttgcatgcatgcatgatgacatcgtcgcaattcacacgcaagaacacacagtacgcacttaatacgcacgagcgtgttcggtaatcacatgaaacaagaggagaaagatagtggtatgatcgatgcgtaagataccttcctgggaggcgccgtccacggtgctcccggactggtgcccatggtggcggccgccgagcgacatcaggcggccgcgctcggctcgcagcgcggcgcggaggccgaaccgctcgccgaggagcaggtcccagcggaacagcccggcgagcgcggccatcatgtcgtcgagctcgcgctccgtcatggccaggagcgtgctcgccgtgaacccgagctccgagatccgcgccaccgtcgacatccgcacgccgtaccctgccaccagctcctccagctccctgggcacgttagccggcggcggcggcggcggtggtggcggcggtggtggcacgggcgccggcgccggcgggccgaggtcccaccggaacgggtgcgcggccgagaaggcatcgttgggatccatgcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttttatggaatatcatcgatgccggtgcaacggatgaccacagatcaatctagccggggaaaaacataaatgacaaagttactcctaatcaccatattaatgacgggggatttcttggttttactccctccatccaaaaagtccaagacctattttctttttgaccaaggccagtgagtaattaattaattcattatgtgacaaaatcaatgaacatgtaaccaataagtactgaagtataatgatttcttaggctccgctcaaaaatttaatataacacatagtaatgactatatggataggacttaaacttttagaaaaccaaaaaataaaatatatcttaaaacttttggatggagggagtagtcagttaccgatgtttctcctattgtgtcaaaggttggtttgcttagtcattaattagctcgatagaacactaggaatagttcacggtcgagtccgaaagcattaattaatgaaatgagcctagtgcatcgagtgttttttacatttgaatttaaaagctaccataggcaaggaactctacctattggtagtatattttgggggtaaacgacattcaaccactctgcctaacggtacaacgctcgtattgctctctcataacttcgtgtttacgatttagactactccaatttcgcttgttgcttctataattcaatcgagattttctagttaagagagaattagttatctattagctcaaagagacgcttatctttagcctctaccttatagttgacggtaaaaaggagaaatgaaggtagcaggggactttaatatatagcaaaattaccacgttttttaatcatgagacagttgtatgagagcaaggataatagtacagctcacttcctactattagcacattttaaagccaacagatataatagattagctataaggttggctataattttcttctcttctctgtctctcacttatacatttaatgtatttgtcttggagtttgtaataatctagctcttgtatgagagccaacacccttgatttttcactatct

SEQ ID NO: 18050 - DNA, 4329 bp, Oryza sativa
tggttttgaagatgattggatttacaggtgaattacaggtgctatcattttatgtgaccggtcagaccggggtgcgtatgccggtcagaccggcagtgatcgagcggtcagaccggccagcccgcggtctgaccggccgactctgtgtcggtttcggtttcgggttgtttgtttggatatccgtgattatttcatgattatggcttctagatggatactatacgtatgtaatactgttgtttgatactaatgagtcaagttggagatagcttggtctccgaatatggtttctttgtttatttcatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggagttattatgtgcgtatgggatgcggactcgaatttggaaggagtccaaatttggtatgattggttatgtaaagtttgtttcttgtactagagggtttcctaaggtgtttaggactcctagtatgagtttggttcgtggctttaggctgcctacctcatgtataaatagagggggagcgtgaggcttcccgatatcgcttttgagagcaattaagttgagttttgagttagggtttcgagtttagtcgaaatttttgtaaggagtgttgttggtgcactttgtaaacacagagagaatcaataaagtcgtcatccactttaagagttcttcgatttgtgtttaccgggtttcggcggtctaaccggcgacacaccggcggtcagaccggcgacacaccggcggtcagaccggcggcaatgcggtggcagaccggcggcgacagcaggcgaggcaggcgacttcggcggttcgaccgatcgatctacatcggtcagaccgatgttcatcaggcggtcagaccggcgcaacatcttcggtcagaccgcgatccatcgatttcgagggtaacttttatttccgctaaaagtttttgttttttgggtataccaactattcaccccctctggttggcttagttattgctatttgatcctacactctctcctccaccgaagcttatagtaggcttatagcttactattatacttgctctgatatagtagcaacgacaagtgtatggtttatattaacaaggtgaagtgagggcggtggaagggtaattgatcaatagtaagagaataaggtggtgggcaaggacaacgttaaccgaggatagtggtttggagtggctagccaaaacaaaagatgatgggggcacacacaatggctacaacagcgactaccccacacgtacgtattactctccagtgcatcattacatcatcacggttttttttgattgggctagtgggcctcagatggccttttatgtgcatgttatgttgaatactacattcagcaaccaatgacaactaactgattcaatacccatcgtcatttccattaggaacaccacaacgtgaaacacatttgaaacgacaacatgagatgacccgacaagatgtatagaaataaattttgttagtaaacaagctttccggttgttttgttttattagcaactcctaaattttggtcatgcattttttttaccaatggtttgaacgtggagagaaaagaggtactagggttacctggttgagcaaatcttgaagcaattgaaacaatccaaaagtaactgtattagaaaaagatatgaataccaaatagacaatgcatttgctttatacctttaatttgttcgagcaatcaaaacctaaggaatgtttgatttcttgtctatgtatccattggaattgtctatttatatttgtttgtcacaaaaatgttgtaagtgaaccaaagcaaacaaatccataggtaattttaaaattttgacaagaagtcaaataaccgtgcattaacaaaaattagtaaagtatgtattgctttcccccctcctcctttggattggtgtatttttaatgaaccatacattttcaaaggattaggtactattaatgtcttttgttgtagcagggggtaaacaccatcctcccagtccggtcaaaacaccaaaggaaaagaggtcttaagaattctaagtgtccaacttggaaaaagctcgtgactcagaaattaccatccgagtggtaaagtaccattaaagtggtaaaatactatcctagtggtaaaataccattcgagtggtagagtaccatccgattggtaaattctcatccgactagtaaaataccattcgagtggtagagtaccatccgattgataaattcccattcgattggtaaaatactattcgagtagtaaagtctcactcgagtggcaaagttccatccgagtgggttttcaacttgtgactggtaaatttcaagggcccagcaagtgagaaggaatgtatgaactctcaagatggaaagtgcgtttggccaatgaacttgagggaaaacactactcgagcaatgaagataccacaagaagattccgtggaggccactcccaactacttctatcagttgccgccaaatgaccataatgacctctaaaatgtatcaaaatgtccttagggttgctgacctggcaagggcattatggtaaactcatatatccataagggcaaagttgtaagccggccaaaatcctatagcaagacaagaatatcaatcactaaagttgtgcattttgtgttcgagctcatttcttatgataagcggagaaaatgaacttttccgtctatcctcgaacttgtccatgactcaaggtcacgacatctttgtaacacaagaagaggaaatctagaggaagagatttcctactcccatcatcatttggggaatatggacctcttctcttcctttttcctctcgtgtcggatcggcgtaaagtttcgcgagtatactttgggggtgtttgattgagattgatataagttgatgtggctatcgctacagctacaccaacaataactagtatagcaaatctatgctaggcctgttgcggcgttgtggtgtgccatcgctgagggcaccgaacacccgctttctcaactacggtgctagtggagtattgttatatggatccattgacaatagatccattaataatagcttagcatgttgtaaaatgcatacaaattaatatccactctagaattcctcatattcccgtgttccaaacagcttgtcctattgattttttgtgtttataatcctacagttttgtatgcacctattgatctatttctatgtttttcgtaaagctatgtttttcctatcatgaaggaggcttaattcatgaaacaaggggctaaaaagggaattcagctctatgtacttcagtagtagaggtggaagtaacgagctgaatcattggtggtagagaaaaatacgtgaacggcatctatcgtccagaccagatccgcatacaagtgcaaccacgctaaaattaactgacccaggcttttctgcctctcctggctcccccctgctggccctgcctccctgcgcgagaacatgcaagcgtaatgtttttgcaactgatgatccccggatagcagcgcagtgccacttatgatgccgagacgacagtgcaatttgaccgacgcctaccacaccgctgctcttaactttgttcaaactgcagtgcacagtgcagtgtgctctctcttcttaattcaccgaatgggatgctctctctcgcacgcaggcacacagtcgatgtgcatgcgtgagacatgtttgtccggttgcatgcattgctcgccacttcgcagcatctccactgagatgccgtctcgagcgtatcatgtctatctgtaaactgctgctcccccagaccaccagcaccaccacgccggccgtcgtcgtctgtgcgtgcatgcatgcacacctctcaaggcacatatacgcaccggcatcgcggccgcgtacgtactcaatggggcacgtgatgaactgacgagcactggactggtattattcctcccaattgaatcgttcatcagagagctctcactgcttcttgcactcccatgtgcatagcagctatagctagccggaagatgtgcagatgaattcatgaacttgaacgtgcaagtgcaattgtgcaagtgtgtgagcatatcatgagtgtgggcttcagtagaaaatcgcagaaggctcaacagtttgctttttttgaaacggcgatcggtgactgtgtgcacgcaattatatactgagaattctgagacgatatgtgcgaacctgcagg

SEQ ID NO: 18051 - DNA, 2437 bp, Oryza sativa
aattcctgcagcccgtcgtcgtatggagctctagtggaaaacgacccgcgtatactgaagagagcgacctcaaattgtttccaactttaagtgccatattgtttatcagtttttgcctgttagtctgggtagtggtgttctcgtgcattcatccttgcgcattgagcaattgatctgtagctttatctagattcttcacaccctcctattattgagtgggatggttgtgattggttgatagaaagatgtaagtgaagaaatagcttcattttaaaacaaagtaccatgctaaaataattatattttgagacagagatatactacttatttctcgaaatgtagcaacttttagctatatatttatgtcagaagttattatggctttggaaccgatgtaggccccattttatttagatcaagacaccaattttaccttgattttttatatcatgtttttaaactgctaaatgatgtattttgcacgaaaactttcttttagataaattcatttttaagtttcaaataattaaaactcaattaattactccctccatcctacgaagactcattttttagtttttgatataacatttgactcatcgtcttatttaaaaattttctatgattagtgtttttctcgttactagataaaacatgaatactccctcatttttagattttgacacagtcttcaagatgctacttgatcaataatatctataaaagtaaaatgttttaaataaaaagaattgcacatgatagttgtttaatgataattctagtaacaatcaattttacatgatcgatctttttttctactaatagtcaaaattaaaaatgtttgacttgacactattctaaaaattattatattttttgtacggaggatctagtactttatgtgtggttaattttttttaaaaaaattttcataaatttttcagataagacggatggatatactagcttcattattttcaatataaatgaacaccactgtagtatatgctctctccatttcaaaatagaaggcaactgaggctcttataaccactgggttacagtccctttcgcattatcatcttattgttagaatcatcctaataaatacaatgcatgtgtccaatagaattagaaattctaagagtgaagaatttaaataataataaggaataagtctacataaccccaccaactatcacagcgtgactacttaaccccctcaactatcaaaccatgtatcagacccctcatctttctaataccgtttaattaaccccctgaggtagttttgccaggtggtgtgctgagttggacaagcttcttgtgttatagcaggctgacatgtgggcatgcatgattttgtgacactcaaatgacctgaaacacttatgcttaaattctgaatgttatggcgttatttccgctagcacctgttgcttaaattctgaatgttatggcgcgctagcacctgttgctttgaattgtacactgaaatagcttttcatgatgtagcagccaattatgtttgtttcggtggaaatgaatagttcaaattatgatctaatttgtgtttgcattatgattatgtgcatgctgtcatatacttttagtgttgattttttttaagccgattcaatgtccagagtttaatcctctcacttacaagccggtctacatgtcagcctgctctaacacaggaagcttgtccagtttaacacgccaccgtggcaaaaccaccctccaaaaccaccttagggggttaattaaacaatatttaaaagatgagggggtctaatacatggtttaatagttgagggggttaagtagttatccggtgataagtaattttaaggatgctagttaattgcatatatgtcttgtattatagaacatctgaaaaaaattggggggagtaaaagttttttcagtctcatgagaatacatagaagttccaggttaatctgagaaacaattaaaaatttaaaaccaacatgtagccagtagccacaagagaattagcacgctttcggcgacaatgaccccttcacagttcacactcccaacatagcttctctcggcgctcgtctatgctgtatgcaccaccgagaaggagaacagcaagcaaaggcgcgacgacatgccgtgcagaagagcaagcacaccggccgctgcagctgcagctgatcctgctgtggctgcatggcctctcaccccactggtgctggcgctcgccgtcttctcggcgatgcctcacgtcacgctctcccggggacgggagaatcagtggccgcctctagagggaaactcgcagctgacgacgacgaagaacctgtcgtgcgacgaagtcccttatcccttcggcttaaaaggcaaatctgcccctggcttcagggtaacatgccggaaaaacgacagtgctgccatgctccgcatt

SEQ ID NO: 18052 - DNA, 8392 bp, Oryza sativa
aaggatggtcttggactgggtgattgggcgcgccacctgtgagcaagcccggaacaacagcttcaagacacagtaccgctgcaacaacgagagctcatgcatggacaggttcatgggagagggctacgtgtgcagatgcaaagcagggtacgaccaacacaacgggaatccatacgaggcaggcggctgccaaggtaaatagtagatacttctaaacacagtgatctaaaaaatatgcactagctagtgaaaacagtttgttatagtttctttctgtttgtatcatggcagaattcaattaccatagaacttagctaactgctatgaatagaactgtatttttctgctttctcaatgtggcttcacactatttatgaagatatcaacgaatgccggtctctcatttacaacaactgtagcgtactctgtcataacactcccggaggatatacttgctcttgccccaataataagactggtgatggctacaggacagggacagggtgcattgactcccatcggccacctggtaaatacatgccatatattttttccgactgcttttgtttaagataatgggatatttttttagattgcatataatcctacttattctagaatttctgttcaaacaaccatattaatcaccacgtgttatttctagaccaattttgagataagttggaaaactcaaaaaaaaaaaaagcttttaaacggttcttcctgggtacttttatgtttgattggatgagaaaagatgaaaggtctaaattgattctactaccaataaataccacagtaagaattttgttccttttaacgtgactatgcatgaacttaggattgcctgggtgataggagctttgttccctttttacttaaagaaatgtcaatatgaattgatatatttcttccggttgaaacgctaaaatgatattgtatgcatctcctatatatggctggattacgctgtaatatttcttctctaaaaaaattctgcaatagttactcgtaataatgcgtgatgatctgaccaagatcatatattctctctctcatgcaggcgcccctacccacaaccaaccgcaaggtatcataaaacaaagtgctttgttcaccacacagaagagcattttaagtgcagtctttctaatcaggaaattattatttgttcaatgtaccgggagaacgttcgaaatcttgtttacaacatctaataatgaaccagtagcggcctaatcatttttcatttggaaaacatctcctaattgcatgcaatttactattattaggcctagatgtgtgcagagaattgaacccttgcacgtactcaaaatcctgcaaggatgagcaaggagttacttcgtgtgtttgcccgaaaggcatgatcggcgatggccagaagaatgggagtggctgcaaaaagcagtttcctttatataccgctttgggtaaatatgctcaacacccggcattccacatcagatcattcattttctctcttttatttttaattcctctgctattaatacagttgtcaaaaatatctcccgtgcagaactgctaatctacagtatatagccgctgatgattacgtcattactaacatgaatgattgaacatcatatagatatgaccagtgtattgactgcattcatgattaatgattcagttgagctagcaaaactagattagacatagctaatgacgataaacattaaaaatgtgttaaggttgtaaaaaatacctcaatattgtttctggacgaaagaattgaagtcggagctcataaataaaccggaaccatgcacaaatcacaatttacaatctgcagacaaatagtcgttcggtcaaaggctcctaatattgattgcaattttatacttctttttacttccacaagatatcattgagaaataagactaacacaagttgtgaatattctcatccagtgtctgcaggtgtagctcttgcacttacggccacgctagctacagtgttgttgtgctactacttgacaatgaagaaaagaaaggtggaaagaaacagagctgagttattcaggaagaatggaggattgctactgcagcaaagattttcgatgatgacatctcaaggtgaggattcatcagcgaagatatttagtgcggaagaactcaaggatgccactgacaactatagtgagagtcggatccttggtcgaggcggaagtgggatggtttacaagggtatccttccaaataataccacggttgccataaagaagtccatcttgtttgatgaaagccaggtggagcaatttgccaatgagattaccatcttatcgcagattgatcacccaaatgttgtcaagcttttgggttgctgtctagagacaaacgttccgttgttggtttacgagttcatacctaatggaacactcttccagcacatccacaacaggagttctttaagatgggaagattgcttaaggatagctgaagaaacagccgaagcacttgactatctgcactctacatcttctacaccaatcattcacagagacatcaaatcaagcaacatacttttggatgagaacttgatggctaaaatatcagactttggtgcatcaagatcagtcccatttgatcaaactcatgtaacaactctaattcaaggaacaattgggtatctcgatcctgaatatttccaaagcagcaagctcacagagaagagtgacgtttacagctttggagtagttcttgcagagctattgacaaggcagaaacctatttctgcaagcaggccggaggaatcctgtaacttagccatgtatattgtgaatttatttaatgaaaggcgtctactacaggagatagagccacacattttggcagaagcaggtgaagagcagatacatgctgttgcccagctctcagtcagatgcttaaatttgaagggagaagaacgaccagttatgagggaagtggcttcagttctacatgggctaagagagtcgtttgacgaggagcaaatcatcagaagaagcaatgaatcaatacagataactaatggacaagacagtgtacatagtgaggcaagaccaattcccagcttgcagtcttcaggggaaattaccactgagtacagcttgccagctgaaatactgccttcttcttacttggcaagatgatgctcttattacgatactgtaaaggaattttgtaaatgttcacttccgtaatttttttaggcaaaagatattagtgcgcacgtctgtgttaggggatcggcaaactgcagccctagacctatcaagggtgtttgtccctaaaaaaattggttgaggccaagccttccaacttccaatcctcaacctctgacctaaccatcatgtactataaatagttgagtatgaaccaacttcttgtcgagcagtaaacctacatggttgatggttaggattaggagagtatacctcatgctttgacttaccccaatgagcgtggcgcggttggactgcttggccgctccgttgctggtgattagtggcaatcccctcgggcttgtagaggtcgaatccatcttcgctcgcgttctaattgcgttttgttgctacggcggcggcggcggcggcgatgcgaggccggaactcacgaggaggacaaaaggtcggacaggtgggcccttgtgagaatatgggttgctgcgacgcgacctatcgaggaaggtgtggttcgttatagacttaaagttgggccagaagcccataaggtgattgctgcgaactgcaggccgtgatggttcggccttactactcggtgcttctgggcgatccctcggccttgggctggtagcaacttcacacagagtcggcaaagtttccttcttgtatacgtggccttagattctcgagctcatatggccatcatcaattcaggtacggcacatgcaacgcaacacagagagcatagcaaggttaataatatagtcgaattgttaactataagattctttatagctttctctcagcctacccatataatagttagctctttatagccgatttatctctctcacagagtttcttggttcttgtgttcaaaccggcggtaagtttatagcccgcttctcctctctctcctctcctccatctcagtatttagccggcttatagtctactattatacttgctctaattcacgagtaaatttacacggaggaaaccgtggagggacgcactcgagatggggagacgatgggaaccagactagccttaatgttgacagcggcacgcattcaccttaatgttgacagcgttttatgctaagttgctaacttgctatctgctcgcagtagctttttaaaaaataaagctcaagccttagcattggccaccacatacaagagcgctaccaactgttcgatccaagtgacgtgaaagaaaaagagcaatgaccagtgtaacaggggcgctaccaaatacttttatcttcccaaaatataagaaattttaaatagatggggcacatctcagtactataaatctggttcatctaaagtcccttatattttggaacatacatttatattttgggacttttacgagaggacaacgattgcaaactgaaacaaaggcgaatcatagctttcgagatttcttaccttttgtccttttaaaaacttatttgttattttacaaatagatttataaaaaagattattctaaaaatataccctattcacggtgccagtattattggcgtcatggtccaacatgacagcgtcaataacaacattgatgttgttgtcctctctccctgtaagtcaagtcattatatgaaggggttcagcgtcactgacaccgacatcaaggatttatttgaaaaaaataaaaatgacctcataataaaaatattaataaataggtccttgacgtaagtgtcactggaataggaaacctatttgtaatttgtaataaaaatattaacattttagttattttttttacaaattgctccacagcaccattgccattggagtcaaccccttcacatagcagcttagctttcgcgaggagcgagggggtaacactaatattattagcgccgtcatattagaccataataccgacgctagcgccgcgaaaagggtctatttcttaagtaggtttttccaatgatttatttataaaataaatttttagatggtctaaaatgtataaaaaaaaattctgtcatagcttccaaaagtaccgtgcgtccatcaagctgtcttcttccaagggcagccattatatcgagtgcatagtgtgcaatatctttgcatgatgggagtcacgtcaagttgcccttctccgaagagcgagtgcatagtgacaaacgactcgtgtgttgagatgagaatcaaaatggaatcaaatagttcaatgacaagttgccatcctttacatatggcaaattttgctacggaacacgtaaaaatcgtgtaattgactggaagatactgtaaaaacgtaataatgcccatagacactacaaaatttatgtaattggttgtaaaacatcggagataatattttataattttcgagacaaaagagaggagggaattttctaagggcctgtttggtacaggtccaactcctaaatttaactctaggagttgggtctggagtggagttgtggagttgtctaaactcagctccacaactctagtccattttgtgagagagctccacccagctttactcccagttttggtggagctgaaactgtttggctgagttccagcttcagaaggggtggagctggagctggagttgtgccaaacaggcctaaatggccagattacccccgggttttgaaccacccatccgccgcgcgcacgacgggcacgacccagacacgccgctgcgcgcgtgtgcaccacgaaacaagtcgaacaagattgatccattcgctaccaagctccggctggtaaacaggacaacacagtatgaaggggcacgcagcctcggtagttacacccagcaaattggccaatttgggcgtctaggcatctaacggtggttccgtcatcaacatcacgcacgaactgctttcgttcactaaacagaatttcctggacgtcacttttacaacagacgacaacgatcacaaaaaaagaaatggcgcaaactcggcctttggaaggactatgcaacatgcgtcaacaatgtactactacgtgataatatagagtcgcacgtctgatcaagccccgtcaaacgaagggtcaaagcaacccgtgagcagagagagcgacctcaaattacttctaacgaaatggtggacctaattaaatagcatatcaaatataagggcgagttataatatggaaggcctgagagtatgcatcccaaaccacattatatatgtatcccgctaaagatagttcatgtggttctttccttgtctaataaagccataatgatggagcattaagccacatcatttatgaattaaatttgaaaaatatactatttatttatttttttcagaaatattcatgatataattttttccaaagatatatcgtcgatgctgcataacagttacacaaaaatgatgtgtgcgtgacattgcgggcggtatcgcgtggtgagattgcaagaacgaacggtctcgcacaaccaacataccatgcgagaccgaaacagtagggtcaattcttagtgattaattagtgtctaattagattaattaatcgctaatcatgatcattagttgagactgtttggagctggcgctgtttttggctgcggtgtggctgggttgctacgcgagaccgcccgtgtcatcaagttatttctgcgcatcggttttacgagattgacggtatattttaaaaaaaaattgtatctcgaatattttttttaaaaaataaataaacattatattttcaaatttagttcgatcatttatatcttttctaaagctatgttattttagttatttctagttcttgaatgattgattgaagatgcaaatttgatgaaatccaacctactatgagtaaagaataaatccagcttcattttatttaccacgtggtgataaaattttctcacgactacagctgcggtattttgtttatctagtttttctctccctctatctgtctgttgatgtgaaattcgttgtacacgaaggctctaacgcagattctaaatcttgataagatttggacgtggcaattattttgatcttgcaactaataaggatgataggaataatcgaaccaatgaaccaatcagctaatagtgtagttgatgcagattcgatggtttaagcatacattgtatggaggtctgatgcaagtagattaaaatatatatcggccaactaaccgatacatctgataattgaaccttagaataatgataactcgacagctagaaactccgatggatgtcgcataaaaacttattaggcttactagaattaaacttataatcagcaatctaacatatcaaacctaactgagagagtacaaaattgaagagaataagaaaaacctatttaaccgatagatctacacaacccatgcatattgtcaacgggctatacctgtagacgggatttgtagagtatggggatcgttagaaccaggttatacgcgagatcatatcaagcagacaaggacaaatatttatattggtttgggctcacaaggagagtaataactctagttcagtttatatggatttatggatgggatgtcacaaatattacaatagggaatagagcgactagaataatctgccgactagaagccgtcaagaacggcccgacgagatatattcgacgaatataacttattgtttctcaatgtggctttagctatcgcttgtaactcgattcccctccatgaatcaggacttgtaactcgatctcatgtccgatcatgacttctggcttcctccggattgcttctcaatcgtacaactcttcaactacctcctttttcttcctcctcatccgatccccttcttcttctcttgcgaatagtagaggcggcatgggcgagcacagcgaaggaggtggcgcttgcggcacagatgatggaggcagcgtgctcgagcactggattccggggtggcgaaggtggcgctcgtaggaacgacacgagcggatctggcggcagcggcgtcggccctcgcgagcacgactggatctagcggcggcggtgtcggcgcttgcgggcgcggctgaatccggtggcggcggtgctcacagcgaatccggcgatggcccttgcagctggatctccggtaacagcaactctatccaggtgctttgagcctgctccttgtgttattcccctttcacatggcgggttcgtcaccttcttcccctccccatggcgacaa

SEQ ID NO: 18053 - DNA, 5630 bp, Oryza sativa
tcaatacaatttcggcgcatcgccacctttttgctttagttttatttcgacgagttcttgctttcgggttgagctgcatcggtttcgatcttcaacaagaggtaaaacttgttatgacggcttgtgttctcgggattagtgcttccatctttatgatactctaatcttgtttatgtaattcgtcgagttatcatatatcttacataatctctagcaatatcgctatctaatctacaatcggctaacatctgttaatggaggacagccgatcaaattagattttgacgttgatttagattatgtaagatatctaccactctatgaaacttccagtggcttgattgtctagatattgttcttcttttcatacttagtcctgcatcagttgagtttgatctattaagttgtgcttagaatatcaatctctagcctgccttctggttgccgattagtagtatcggagtttcagccgatcttatctgatttaactatattcgctctatatgcttcattgacatgttaaatccgccctttatgtcaagatcttattgcacttaagtatattaggcttttgtttgatatattatacttgttttgatatcttgatatagagtagtatcggagtattagccgatacatgctagatctatctgatcggttattctataaacatatatagtcctgttattaatatatatttcgatctaagtaatttatactgtctcggcatgtcgaccgatctatcccaatcacttgatttaagtatatatcgatataagaattatatattgttaatatctacagccgatcgaatagatttagttcttcattgtctatttacgaccgccgatcgattcacatatgacatcggctcaaagataaatgatatgtcatcggcacttagccgatcagctatcatttatagatttaactgcggtctctttgtccccatttcttgttgattgcaggatcaaattaactggcacgctaacacacccgaaggtgagctttggacctgcactagatttaagcagatctctcaggcctcgtgtttttcatcaacaaatagatgagcaaattttttattgcttatagctggtcgcctggtccttagatgtaatggtagctcattcaagtggctcctattaaaagtattcccacaatgtatgtgaactccttacgggacttaagactctctgtatttctacatcgctgatgcccttatcatttcaaagactagcaagtgagttggacggagagcagattggacagggatgaggcggacggcttggtcgcttggataccgtggcgacgggataccggtgtttactaatttcgtagatacatgccaataggatgcaactgctcaagcctcgcaacttttacgagaggatcacaacgaccggaaattgaaagaagggggaatcatagcttccgaaaggaccgtgcaatatcttcttcacatgttgggagtcccgtcaagcagaccttctccgaacggcagctgtcgtatcgagggcatacgtatcaacgatttccgtggcgatttcaaccgcagtgagcctatcaacgacatcgaatgttccaatggcaagtgccatcttttagtggtttgcataataagtccagctggggttatcatcgacttcgaccagcaattgaccagcacctatcttcatcttactttttttcgagttgagggccttatcttcatgaccgatttgtgatatactttatggtatttcgtacgttccttccgagtgccaaataaactgccaatgatgctagtaccttttatgttccgttaaagttgcaaaattgcacgaagtcacgaacgtgcttgtaagttgtaattcaacgcgcacactgacccatatttatatgtgtataataataataataataataataataataataataataatgataataataataataataataataataataataataataataataattattattattattattattattattattattattattattaacggtgcatagcctacttctattaattagcaccttcaaaaaaactaggacgatgtattttgagattgacgaaatcaccatacgcgtctagatgttgatcggtgtctactaataaaaaatagccataaatacaagtatcattgttaagtctaagtcttaatttcggttggtaggttcctttaaaaagaaccgtcacaaggaattcatatcaggactatctacgcatttcttgtcaaattttaacacaaaaatttaacaaatataattatagaacaaccataatgtaaggggaaaatatatgaaaacaattgttggatccaaaaataaacgtatgagatttgtccacgccaataagagtaaaaaaaatttactcacaaattcaatcataagtaaaaattttactattgatgaaatggacaagtcttagacgtctatttttatccaatggtaattttcagatttccactacatatgcggttttcactacatattttccatgatgtaattacattacaacctatttgcatgtaaatacaacataacttaactcaaaaaatccctcaataaaatggtatttccgtgaaacggaggtcgtaggactgaatctactcacatgggcacacattatgattcttttcttcctcgcttgcacgaattttcaagaaaatttgactgttcaaaattgtgtgaaagttatattgtagttacatgcaagttacaatataattacattataattatattaaatttacatctgttaaatttttataagaaaatttgttgataaatacagtatatagcaaaatcgttaatatcataatacgtatatatgagaccttgtataactttgaactcggctagacaaagaaaaaaatgtacgcagaagaaaaaaatcagtgccattaaaaatagatagcccctaactactttgaacttcagctcaatggctaggcttgtgagattgttttaggcttgagcttgtctagagctctttgtaattaaggccgatcgagctaaagcaactcataagcgtcaagtttttttcccctacctttcttgttagaggctcgtaaggcccaagtctttttacataaaaattccaggttattaatctccaaaacaatctacaagaaaattagcacgactcctatgataaagacgacccattgacccactccaccccggtcctctcgggccctatcacctctcgctcccgtgcatgcaccacagagaagtacagttgagcataggcgacatggtgtgcaggcgagcaagcattccagccgccacagaggcggctgctgtggcttcatggcctctcggcccactggcgctcgcgctcgcgctcgccatcctctcggcgatgccccacgtcgcgctctcccagaacctgacgtgcaaggatgtcccctttcccttccgcgaggaaaggagcggagcaacctctgtccccgggttcatggtaacatgcgggcgaaacaacgaggccatgctccggatcggcgagcatatctacaaaatcgacaaggtgtcggtgccggaacacttcatcaccatacgtgcagggcccatccaacaggtgtgctacgaccgcagcaggaggccgaagcagatcaagccgatcaccagagtcgatccggctccggctccgacgagcttgcaggccacgcccttcaccttctccaggcgcaataaactcgtcgccaccggctgcaactacaggttcttcgctaacttcacgagctcgtcgggtggtggggacgggacacccacgagctgcgacacctggtgcaacgacggaagctccgacaccatcttcaacggctcatgcgccgataaggcctgctgcacgaccgagatgcagatggatggcgcgcaggaattcaacctgacgttaaagccgtcggggaatgtcgaggccagcacctgcagtgccgtcttcttcctcgacaaagacgagcaagtcttcactagcgccggtgatggccggaatatggcactgaaagaagcgctggtgccgctcggttaccgcaagatgttcttggattgggcgattccgggcaactgcgagcagaactccgcgtcacagtacccgtgtggcagcatgagcacgtgcaacgacgtgtacaacggaacgagctacatctgcagatgcaatgaagggtacgaggggaacccgtacgagcaaaacgggtgctcaggtaagtactttcatcgacaacagacaggctagtacagtacgttttaaagacagatatgattagggagctcgctgttgttcattttcacttcaagaacttgtgatttagcctgtgaaaaaacagataatttgggagctcgctcgattacctgctggctatgaatagaactatgtttttttctgctttctgaatgaagcttcgcactatttatgaagatatcaacgaatgccgggatatgaataacaacaactgcagcagagatgcaacctgtacaaacactgatggaggctttacttgctcttgccccaagaacacggttggcgatggttacagggctgggacaggctgcagtattgactcccttccgccatctggtaacatgtcacgtatttttggaccgaacaaaatcctattaatcaccgttgcatcacccatcacaattctcattcgcatatatataggtactactccctccgcttttttttagtttgatataccaacatttttaacacaaaacaaacatagtactatcaaaagtgcattcaatgttagatttattaaaactaatttggtgtcgtgaatgttgctaattattttataaatttgattaaacttaagaaaaattgatcaagaaaaaaaagccagatcatcttgtaacataaaaaaaaagagtcaaggatgaaaacggaggaaataattgattcagtccccttgtgccagaagttaaaggtattaggagtatataagattagttttgaaaactgttcggttcttttgctccccttttacctaaaaatgtcaatataaaaggatatatttctttctcttgacacgctacaaagacattgtgtgcatcttctatggctggaatatagtaagttcttagctgtactatttaagtacttcaatatggctgtacgtaatatttaggacggagggagtatgttctactcctaggccttgtttggatcctccgaactattaaatagtcctctggaatcttactatttagaattattaaacgtagattaccgataaaaccgattccataacccttagatgaatctaatgatgtatattaatctatgattaacagctgattactgtagcatcattataacaaatcatggattaatatatctcgttagattcgtctcgcaaaatagtctagggttatgaaatggtttttgtcagtaatctatgtttaatactcttaaataacgagattctggagggccaaataggaccctagtaatgcgaagaatctgaccaataacagtagagcattctccctcaaaccaaccgcaaggtacgataaagcagagtgcagtttcttcacagcacagaagagtaatttaagtgcagtctttctaataaggaaagaacaaagtttccactgttcaaatttctgtt

SEQ ID NO: 18054 - DNA, 2036 bp, Oryza sativa
ttgacaatgtggtgctacagtaaatatgtgctaataacggattaattaggtctaataaattcgtctcgcagtttactgacggatactgtaattagtttttttattagtgccaaaacaccccatgcgacaccctatataatacctgatgtgacacgccaaaactttacacccctaaatctaaacaccctctaaaccaccagcagactacatcatctttcatttggaaaaacttaattgcatgcaatttactattatatttacttattattaggtctagatgtgtgtgctcacccagaaaggaacccttgcatgtacccagagtactgcaaggatgaacaaggagtaacttcgtgtgcttgcccggaaggcagaaatggcgatggcaggaagaagggaagtggctgcaaaaggcactttcctttagatactgctttgggtaacatactcaacacccagcattcttcatcagataattcattctctcttttatttttatttctcattcctctgctattaatgcaattgatatataaaaaatatctccattgcagaactgctgatccataatatatagccgttaatgattacatcattattaacatgaatgatgaaacatcgtatagatatgaccagtgtattgactgcattcatgattaatgatacaattgagctagcaaaactagattagacatagctaatgacgataaacatgaaataatgtgttagggctgtaaaaaatacctcaatagtattgtttttgcacgaaagaattgaagtcggaactcataaataaaccggcaccatgcacaatcggtcatagaatcctaatatggctcgcacttttacattttcttttttttaaaggaaaacttttacattttcttttacttccacaagagatcggttaaggaagaaaattaacacaagttgtggatattctcatacaatgtctgcaggtgtaggtcttgcactgacggtcacgctggctacaacattgctgtgctactactggacaatgaagaaaagaaaggtggcaagaaagagagctgagttattcaggaaaaatggagggttgctactgcagcaaagatttttgatgatcacttctcaaggtgaggagtcatcagcaaagatatttagtgcagaagaacttaagaatgccactgacaattatagtgatggccgaatccttggccgaggtgcaaatggcactgtttacaaaggaatccttccgaataggactacgattgccataaagaagtctattttgtttgatgaaagccatgtggagcaatttgtcaatgagattaccatcttatcacagattgatcacccaaatgttgtcaagcttttgggatgctgtttagagacaaaagttccgttgttggtttatgagttcattcctaatggaacactcttccaacacatccacaacaagaggactttaacatgggaagattgcttaaggatagctgaagaaacagcaggtgcacttgcctatctccactctacatcttctacaccaatcattcacagagacattaaatcaagcaacatattgttggatgagaacttcgtggctaaaatagcagacttcggtgcatcaagatcagtcccatctgatcatactcatgtaacaactctaattcaaggaacaattggctaccttgatcctgaatatttccaaactagccagctcacagagaagagtgacgtctatagctttggagtagttcttgcagagctgttgacaagacaaaagcctatttctgtaggtaggccggaggagtcctgtaacttagctatgtatattgtgatcttgcttaatgaaaggcgtctactacaggagatagagccacagattttggtagaagcaggtgaagagcagatatacgctgttgcacagctctcagccagatgcttaaatgttaagggagaagaacgaccagttatgagggaagtggcttcagttctacatgggctaagagagtcgtttgacgaggagcaaatcatcagaagtgatgagtcaatacaga

SEQ ID NO: 18055 - DNA, 2028 bp, Oryza sativa
ttttgtagattttcaattccttcatcgtctctaccctaaccatcatgaatgtggaattagttgagtcaagtgcccatgagaccatggaggcatgagccaaatggcaagtgctaactgctctcgtcaaccagtagagctgtaggtttacctgtatttcccatggaatttaaaggagggccaaagtgttctatacctcatgctttaacttaccccgatgagcacggcttgcttggactgctcggctagtcggctgctccgctctggtaaccagaggcaaagtgtcctcgagccccgatggtcgaatccatcacttccactcgcgttctggtgcgttttggtgcgacggcggcggcgccggggacaaggagaaagaaaaaagtcggacaggaggcgtcccgctatatttccagccgttcgatggattgtctgcgcgatctgttctagttgggccggaactggagcgcgaggaacgtgcaacacatagtttattgttgggccataatgggattgcagcaaacgcccggcctgtgatggtctgatgggattgcgaggaacacggagtggcccaactaatctcggaagcaggggtgatcgaagtcagtagcatcttttggaaacgacactttgattgatctaaattatttagtgtcgagaaattaaaaaaaattatatatacctaaaaagataacagtaagaaacggtaccctttatacgaaaacggcactcgatcaattggaaattttcacgaccatttccgaacccgcatgcactatcatgataaagactaaagagaaaaaggcaatagaatttcaactaaaaattttgagggaattttggcatgccgatgtagagaaccatggtttacataaacaacaaaaactagataaacttttagataaaagtggcatacttttcaaactgttaaacggtgtgtttcgtacgaaaactttctatatgaaagttgttctaaaatataagattaatccatttttcaagtttgtaataattaaaacttaattaatcacacgttattaacacctcattttgcataaaacacttaatttttatctttgttttcattttcaggagattcaaacaccacctcagttgatatattgtacactaccatgggaggtccattgatagaagtggactgctctccatgcatttatccgaggcactgtccctgtggtacaacttcagcggctcaatgttactcattttttcctggccgctctcctcttgaagcaactgcatctcttggcaatcttcagcagattgctgctccataagctctctcaaagccttttcacttttcagggacaggtgttgtttcattaaccttctgagcgcttcaagttcaattgctacttctaccatccttggcctctcttcccctttaagcttcaaacacttcagaatcaaatgcgacaccacattaacatgcctcattccagcttccttcaccacgacgcagtccacaatctcctgtagtcggttctgctgggcaagcgccgtgaaatgtgaagctagatttatcccttcctcttgcctatgataagatatcggtttttgtctagttaatagctcaacaagaaccacaccgaagctatatacatcgctcttgtcagttagttggcttgtgtaaaagtactcagggtccaagtatcctaatgttccttggactaaggttgttacatgtgtctgattggaagggactagccttgaagcgccaaagtctgataccttcgcggtgtagttctcatcaatcagtatattggcagacttgacatcacgatggatgattggcacctttcttgctaagtgaagatttgcaagagctgatgcagtttcagttgctatcctaagacgatgctcccatgaaattggtaccaaatttgtattatgaagttggtggaacagagctccattcgatataaattcataaaccagtagggcacttcagtctcaagacaacagcccaatatcttgaccacatttttgtgatcaatctgtgaagaactatca

SEQ ID NO: 18056 - DNA, 2500 bp, Oryza sativa
tgtttctgctttgcaagcctcctcttcttcactatccagtaagtccaaaagccaagaacaatgagaacagccatcaaaccaaggcttccacctgaaatgggtatttgaatcttgaagttactactacttcatgtagtaatcaattgtttgttctggttgataaaatttcgaaaaagagagaataatattaaagattgcaagagacttgcctacagtagacaacattgttgtatctcttttacacccaatgccttgcttcttgccatctcctgtcatgcccattgggcatgtacaattgtaaccaccagctatgttgatgcacttgtgggtgcatggatagttattcccgtcgttgcattcgtcgatatcttgtagtcaaaagtaggaaacaaagcaaaaaaggatattagaataaggcatgctagccagtaatactatattggcaaccaaacacatgaattgaggatttctcaccaacacatccaatgtacgggttgccagtgtaacctccagagcaattgcagcgatatccagctccatcttccacctcatagcaataactgttctccttgcacatgtaggtttgacgactgcggcttgcctccttgcagttgccaccctgtatataccagtcgagcaccatcggcagattccccaagtccttgtataggtcatgcctagagaacacatacgagtcctgctccgcgatgaacgccttgctgcaccgtgtgctgccgctaccgacggcactcgtgggtggcatcagctggtcccgtatgctggtgaactccaagtccagcttgttgagccccttgggcactgacgactggcagcagcccacaccggagcattcgccgctgatgatgcttccatttgatgcgcagaacgacacgcaccccccgctgtatctgctcatcaccgtgctgttggtgttaccgacaacatcgctgctgtttcttatcattgccatggcatcacagccaacggcggtgaacttgttttgcgtgtgggagaacatgtagtttgtggcagtgaggtcgatgattccctggctattgttatggcactgggaggagtatacggtctggccagtcacacgtacgtatccctcgagcagggagatgctgaggacgctgtagttaccaccgagcaaaatcattgggcctgtttgacgacatgatatcgcaaagcctggagttgacgttaagcttgagttggtggcaattttgaaaggaaatgggatatcaacggagctattggggcacttgagtgggctgatctgggaagaactgctcgaggaaagcgataacaagcagaggagaagcaactgtgcaaggaccatggaggaaaccatgtgtgcttgtttatcagaacgaggaactaaacctgctgcaaagttacaaggatcaagtcatgcgactgagcgtcttcatatacccctatcggaggagcacagcgcgattttcttcctttagtcaacaccattttgtcgtatgttatacggaataaacgtggactgatttgttcctaatgggagggcgtgatataacttgtggttgagtcgaattgttattcaaaggaaacatatgagagagtgattagttattttagaaacttttccctggcagtagcaagctggtatctactcccgctttgatttttttttaaaattctctatgttcgatcaaatgtaacattgaatttattttgataatatatttattttgtattaaaaatattgctatatttttctttataaaaatcttaaaaaaatcaaaacgacttattaatatgcaacggatgaagtatatgatattgcgatatccatgcctataacttgtaagcaccgtcgtcgtcgtggagtaaaaccgattgcaggccgcaagccacacttgacccgattcatttccccgtcaaccaacgatcttgtgcatctcacacacggtttacattctgtggaagagaggcaccgacgcaccgtccacggcggcctctgccgacagtaactcgtggccgtaacagcgcatggttttcgcgctcttccgtatccgtcaacccagcagcggtggcctctgctcgcggcccgcgcgggcgcacggcgccgcacggttaaaatccacaccgaacagggcaacaggccgaggcccgaaccgatcgactcgtgaggtgcgcgcgagccgagatgtacgtacgacgtgtccgtcgcaacactcgttgtcatgcgctcggtgctgacggtcgcgtgtgatcagatcacgtcacacgggtgttgaaccatagatgcgcctgcgcgcgcgcgatgtcctaactaacagacccacccacgcgcccacgacgaaatcaagcctttcttccgagcaaaaagccctgaagagcacatgcgtagcagaggatgcagctgcgtgctggtcgcagccagctcgccgtgcgcaagctgtaatgcgcccatcgatcaaatgacgagaaagcataggtgtgcagaaagaagtccaggggccgg

SEQ ID NO: 18057 - DNA, 7062 bp, Oryza sativa
atttttctacttagaagagattaaatgaagagagagtaggattatctactaatctgaagatagtctataaaaaaactttctacttgaaagagattaaatgaaaagagagcaaagttatctactaatctagagatagtctataaagaaaaacgaggcaatgtattagagagctgtagatacctatgtagacatactattgaggtggtttactattaatctagtttattgttgagatatatatgttttatagagagcaccttactttaccattacgggtgctcttagcaggacaacacagtgcgaagggcacgcaacctcggtatttacacccagcaaaatggccaatttggacgtctaggcatctattctagcgctagcggtggttgcttcatcaacatcaggcactgctttcgttcactaaacggaattgcctggacgtattctacaacagagacgacaacgactacaaattgaaagaaatggcgcaaacaaggcctttggaaggaccatgcaacacgcgtcaacaatgtaatataatacttaaatctgaagggagaaaagcggccagctatgagcaagagtcatttgccaaggagcaaactatcagaaagagcaagagagtgtacaaagtgatgcaaaaggccgaacttccggccttcattcttcggaagaaagtacacattacagcgtgcagggtgaaatgggatttggttcctgtgcagtccttagtatgattgcaacttaagcagtcatactatagctgtagaatgcaaattcaaaagcccaaatttgataagacactgttcatgcagaaaatacagcaaaaaaatattataggaagcctactgtagcatttaatctagaccttccattgagaaattgaatggacaagatcttgtgcagtccctaacgtgcagatgtagttgggactacatctgatcccaatcctgtgaaatgctaacttcttctcatatggaaatatgatgatgttcttcgctttttttttctttagtaattttcttattataatgttataatcagatgcatcagttgacattttaccacatcctgcaatacaatggattttttaaaaaaatatatttaattcaataattaataaagtgaaccttaatttgttttgagccaagccttaccaacttcactctctcacctagcctgctagtcatcatgcttgtggaaatagcaggttagtgcccatgagccaaattgcaaatgccattttgtcaaccggaaaccccatagggttaggttgtcattatccggtttggagtttgctcatcagctaatagaatcaaaggaaagaaaaatcggttgtcattatctggttcgcggtttgcccatcggctaatggaatccaaaggcaagcaaaatcgatttacctcgtgctaccttggaacaggtacaaccgtacaactagtggagtgcacattgggaaactaacctatcatttctttataaagtttggtacattccaaatgaattactttaaccaccatgttaagaccaaattgacttctgaaaggatcagatatttctttctgagaaatagttgaacagacattggagttcgacaacactctccaattattcctagtatacccgtctctgggtttctacatgattggcagctcagagcaacacagaaaatcattgtcatgaaactggggactgagttataataactaagggaaaaccatttgtgctgggaggactaacatgagagggccctgaatgggagtagaatggtgtccatgctttcctcctccttggtaatgttatcaaggctcaaactcggaggatgcttcgatgtttacatctgcatgctgacctgattcgcagagcagagggtcttcttcggtctgcaggaccaagtgttgtttcatcagccttctcagagcttcaagttcaattgccacctctatcatccttggcctctcttcacctctcgaccttaagcatcgtaaagccaattgtgcaacggttttaacatgtttcgtgccagcttcctcagctacttgagaatctacaatttccaacaactggttctgatagaataacatactaaaatgacatgctagatttctcacatcatctgtcctaccatcagatataggtttctgtcttgtcaatagctcgataagaaccaccccaaaactgtatacatcactcttctcagttagctggcttgtttggaaatattcagggtccatgtaccccaatgtcccctgcactaaagttgtcacatgggtctggttgtgtggtattggcctcgaggcaccaaaatcagacacctttgcagtgaagttctcgtcaaggagtatgtttgatgacttgacatccctgtgaataattggttcctttgtagctaagtgtaagtatgcaagtgctgatgcagtttcaactgcaatccttaggcggtcctcccatgaaatcaggacagatgtattttgaagatgagaaaaaagggccccattggtgatgaattcataaactaacaagggaagttctgtctcaagacaacagcctaatagctggaccacattcttgtggttcacttgtgaaagaatgaccaactcgtttatgaattgttccatttggttctgatcaactcgctgcgccttcttgattgccacaaccatttgattggataatatacctttgtacacgatcccaaatccacctcgaccaatgatattgtcatcactgaagctgttggttgctttctcaagttcactagaagtaaatatccgcagtggtgcaccttgagaaaacatcttctgcttcagcaacattccaccattctgcataaagtatctctgtcttatcttcgcaagttttctcttcttaacaagccaatgggtccagaatatgagaacaaggagaagcagtagcagagctagtccagtaactgcacagacacagaaaattcagggatctctactggatgcagcattaatcaactcaagccttcaaattgaatgattacatcattcacatggcaaggcagtgatacagggcttcagaaacttgcctattccaatcaacagtgtgccaattccattgcagccactgccctccttcaagccatcacctctcatccctgctgggcacatgcagtagaaactccctttcgtgttgatgcacttatgcgtgcatggcctcttaatggtgcattcatcaatatcttataaaaaaatcacatgaaaccagacgaaatcaggcatgagctattcttgctgactactaaattcaagaaacataagctgaggtaactagcatgaatgtattcgttaccttggcatccatcgggcccttgcaagtaagggttcccctgaaacccaagggagcaattgcagcggtatccaattccatttgatgagttatagcagtaggagttctccttgcaggcatatgacatgaagcggttcgcctcctcacagtagccaccatcaatggaccactcaagaacaacagggcggtattgaggattgttcctgttagtgttgctcagatcaacactagagaaaacataggagttctgctccacgatgaaagcctcgccacatgttggagtattattgacctccttgggcctgctgagctgcccagttatgttagtgaactccaactcaagcttctttaaccccttcggtactggtgcttggcagcaagccacgccagagcacataccatcaattatattgcttttggtggagcaaaaagaagcacagccaccgctatacccgctgctaccgttcaatagcatggctaccatatcacaacccagagctgtaaatttgtttcttgtatctgagaacgtgaaattggtcccctcaaggctgaagctagaattccttttgcactgctgagaagtggcactggccaagatgcttacaaaaccatccagcaacgagatgttaagaatcccaaacatgatattgttaatgcgtaccatcgggccagatgaggcacatgtgatctcaaacccttgggctggggcagggttcccaccaagaataccaaagggataagggatgggaatattggagcacttggaggtgcttgattccatcgaatgaacataagatgcaaagatgcatgtgaggaggagcaatggcaggagaagaaggtaaagcatcatctttgccattagtctttaacaagaaaaaatagaccatggcaatactgctatcaactaggatggaaagtttggatcatggaggagaatggactggaaatcggaggttaaataggtcacaggctcacaacctgaggaaccacttggcacgttactcaaaatattcaaggggaaggtgcaaggaatggcaggaaaaagctaacaagcaatttttctggcttatcccttttactgttgttgtcatattgcccttgactcaacggtagacttgctgcaagcatctttcagctaagatggagacatatgatcgcaagcactctcttccccaggtgcatgggctcacaatgaatatgaatatatcatattttttgaccgggcgaaaacagccgggttgacgttaaacagaaatgtttggtttcagactgatgaaaacatgaataagcttaagtcttaactaaattttactagctgacacaacagacaatggccatctgtttacaatctcaaggctgcctaccaatcgaagcatcgagcgctaaattttccatcttatacgcgggctaattgtctttttgtatagactgaactatccttaccttgccgtcagcgtcagacacagcaactccagcacggccacagcttctgcacgtcacctcatcggcctcaactcgcgggaggcggagcccgccaaccacctgcagttcagggccgtagggagattgattacccgctccctcgtcgcctccgaccccgcccgcctggccggcgcccggcgctcccccatccggcatcgaataagcccctctcggcggcgatggcgaggagagagagagagagggggggggggaggggggctggggctgggatggcggccgctttcacctgcggctgaggaggcggtggtggatgatgcggcaatggtgtgtgggccggaggaggagagagggggatagggccataggggatagcttgaaaaagcactatatcagtttctcaagttatttatcaattttatatatctccaatgaaattaagttgctactccgtagatcttaaactttatcaatattagcacatatgatattttttttagtaataatcctgaaaactgtgaatctgtgatggtgttcttctgacaggttccagctgattgctgaatagttaattagcagagtaatttgctcatttacatgtgatcaattgaaatgattcaatgctcatagacaggtcacagggcatgctcgtgtgtgctcgtcttcttgtttatctgatgaatgctaaaatacagatcaacgccaacacaggacatggaaggagagcaaatatggttcagtgagtagcaaaaaagtgattcagttttctcatatacgtgatcaacattcaatgctaaaatacaggacataaattggctctctaaaaagtatccacgaaatggagagctgattatgtactgcagtagaacaagcagtcaaataataactttggtaatgtaaatgtatgaagatgtatgcgaagtatatcacaatcctagatctgttcttgacacaaagaatgccatatataacacactgtagaagttttcagaactaccaaatctggttattgacatatactgtgatacgacggttaacagcgaagatagactgtttacatcatttggtgtacctgttctgatatgttacatcaactacctaaatatgtgcttctgaacataaaggtgaaacaggttcctctaaacagtaaataactactacatctgaatataggtgtagcaatatacatgacaacctattgattgttggctatgtatgtaaaaattcaactaaacagacatggtataaaatgctgaagttagtactttacagtacaggagacagccaatccaagtagtggtcaccattcttattgctctgcgaacaagctacttcagggaggtggttggctattctccggagaaggtatccatcagattgcctaatcaagatatggcatttggaatggaatacaactaatggttctcaatctttacgtcatccactgcagtcagagatgagcacgtttgatgtatgaacattatgccacagcaatgccagagaatgtacatataaaagttgcaaagtctgaaccagatcaaacaatgccaaccatagcaagctaacgctgtgcatcccgtatggcaggactagccactctggcacggtgagcgatagaaagagatggcctcccaacagcttccattatcctactgaagacgacctttgcaggaacacacgtgacaagtggaattgctccctctggtttgatcaaatcacccaaaatattgtgcagctttgcttgacgaccttctctgtgatgcctttttccaattgaaatggaagaaagggctctgactttctgacttgatgagcttccttttttggaattagagggcttcttttgagatctatgtgacaatgggctccgaaaactggtgttgcttcgttttgaaagcctaaactgctgattgaagggggtggaggatctactaaagggcggattcatatcccacaggccctcatcgtcaccatcatccaaggtcacccgtgttgaattagaacgtggaattcttggcatagcagtccttctgcctgtacgccaagcaggtgatgcagaggtgctatgttccagaaaatcatcactggccaaaacaaggtggtcagttgaaccatcttcaagtatttcaatttggataggatgcccaactattgctttgccattcagtctgctcatcaaagaaaccaatggaacatgctccccttgatagccagcctgtacattcaggtcaacattaaatagcattgggcccatgtaaccaagttgggaggaataattttgtcgatacaatgaagctgggctgcaggaat

SEQ ID NO: 18058 - DNA, 7389 bp, Oryza sativa
attggaatcgaatatcatgtttccagtcaacaaagagccatgttttgagagacatgcagtcaaacatgttaaactttagcttttgatacctttgtatagaatgagcattgaaaagtaatacatgtaaatttgtccaggtgattttgaattcataaatattctacagatagaaattaaaggccaacattgtattttcagaactgtgtcactcaatttcattttttctgattggagtaaaacatgaaaaaagaagtacacgaaactgtgcagcaagatagaaagcattattgtacacaattctttcaataatgaagtcctatcatcatgcatagaacatgacccacaaagtaattgattctataaggaaattatatggtatgattaggaatcaattatgttggctttcttaaagaaccagtcaatgcaaattgatctatcctctaaaaaaattaggaatcaatattcaacacataactgttgttgtatttgtgtctgcggataaaacatttaaaggaaaggcagggataaatggaggcacctactttgcaaaagttcagcatcatcttctgtctcagtttctgaacattccctctcacaagaatcagatctttgcttctcagcaaactccgaaattttttgctctgcagaaaacgaatcaggctgcttgaggtagccttcggtctcaaagtgtgctcccattgaagtgatttgtgtaggaggtatatctccatggttattagtttctccagaatcattaggcatgtatgtcgaccagccctgttgggcctgatatatagtagtcagagggtcattcccttcttcaattaaaacagggccagaatcatcatcacgctgaaaggaatgaggcaatttcaaactactctgcacaacttgagcaagtggtcgacatctgtcatgttttttgacaagagactcttcaaaaacactttcctctgatattttctttgtgaggggtgtattttttccatcacttcctagatttggtcctgcttgcatatgtcctaaatgagaagatccattgttccgattactgagagtattttctgcaccttccaaagcaagagattctgaaaagtctctttttgaaccagcatacggaaagttctgctcaagcccttttgtcttcccagggagatttgagctatctccttttctttttttactctttttgcttttgtaacgagtactgctgagatctttgcactgttgacttgctgagtttcctaaaggaaactgaggtttttgtgtattgttccttgagtaatattctgtagaagagttatcaaactctctcctcatatcagcaaaagggacactagagatgtcatcactcctgaagccttgattctggtattttgatgcaagctgttttctctccaattcaagagcatgaagaatagcatcttctctgcgagcatatttttctcttctctttacaggagtacctcgagaagtcaatgccttctcaatacaagcatcaaactctccacacctgaatgccttgacacgctttgatttctcaaggttataccaatcgctgcaaaagaagggaaacaaatgaagaaatggatcactacacaagacatttaaatgcaaataaacaaagttcaagctgcaagtgttgtagaaacccaaatcaatgccagacaattcaccagatacttgggtatttcttgctatcaccatgaatgaaataaaatgtagcttgagatcaagatatgaaattttaatgggtgttcaaatagcgcaactgacatgatgggcgagtgaaagttaatgggtgttcaaataaaagaaaacatcattctccaacatgatgggcaatgggcattactgtttagttgtggtcttgtgggtggagaactgattagatatttggggcagtaaatatagtataacgttaagactcccttccatttcaacagtcacaggcaagctagaaaaaataaatccttaaggacaatattgaataatgtaacttatatagaaagtgagtcagcacaaaagttagcaaatccaatcagagcacagcacccaatatacccataaaaaatcaaacttggaattcttaaataatgccaaatttattttatgcatgttaacatttcaatttccagactggtatgggagaatccaatcagggcatgaactacttttttctttagactttaatttccattgaatatattcgagattctctttcagcaacatttcattccattgtggcagctaaaagacaaaacactaaatcagtaataaacttaaggaaatataagtatatatccgtatgtcgtaagctattcatatcattctgttataacttccataatacaaaacaaacacctacaaaattggctttctcagtacatttaatagaaatggtaaggcaaaaacatcatagcaaatctgaaacatgcttataacttatttaaactgtataaccacgagaatccagtttgtgagtattttttaagctctgttgaacacatgataacatcataatattgtattcacatgtctccacaaaacaccatacaaaacatcatcacaatatatgatctatttaagttgagaaaataatctacagaaccaaaagctggtctgcacctgaattgccagcatcacttgtttcaatcccacatgacagaatgagcagcacgcatgtttattgtactataaaaatttacaccctacttatgaaaacccaagacatcataacctactctcattcttcagtaaaattagcaaccagaaattaaatgtgcatcccacaaaggaatttaaccttctcacatcacaagaacgtgcatataatttcatattcaaaaattgcaaaatattatatccctgtgaattaaattcattcttccaatataacaagcaagatgtacacctcagaacaagtaacaatgagtgtaacacatcaattgaggcagcttatcaatagcaccatattgggttcaggaatgatatcctctagatggtagattgtctaacattgtttagctttccaagtgtataggcaattgacaggtgacttctttaacatgaatagagggaattcatctgaaacaaaaagttgttggctcttgttaaatactccattgttgttctgatggtatttgcagccgcaaccaactaaatatattccctaattgttccttgagcaaacaactcccaatccaatccacagaacattcaatcctgaccaagcgattgtgaagggacactaaccgagcagatgaattatagaactaagtaacagagtacataattaaatttgagggaaaagggagaaactcacacgcttgcgtcctcacggccgaggagcttgaccggagttcctgtcttcggcgacattacctgagacgccgggagctcgtcgggcccgagtatcctccctggccaccatgacccgttccgtcgccgcacccacacgatgatccccggcgagcaatcggtgatgccggtttccgcctccccacacccctccccttcccctcctcctcctcctcctccacctcccgagctccgacccatcccggttaccaagcacgaaagctccaaccccaccaaacctaaccctaggttttcaactcagcccgcttctagaagcctccttcgccccggagatctgccccccattcaaatcccggacggccgcatctggaggacgccccctctccgcgcctccacctccgccggggaatcctagggttccggcgacctgaggcagcttcggccttcttcctcctcggggagctttctcctcctccccctcgccgccggtatgctccggggtggtcgccgccgacgaagtggacgtgttccggcgcctcacgaattatatttttcccacctttttctctcttttttttttcgcccgagcaaagcgaagaagaaattagggcgaaaaagtataaaaccgaagggaaatagacgggggcgttttctttttccgggttggtttgtgtgggtggttttggtggtccaacgcgtggggcgagcgaaataactgcaggctcgggcccaaaagaatacatgggccggcggagacacggattccataaccgggggtagttcttgtctctctcttctgaggacaaaaggaaaagaaaagaaaatgagaaaggcatctgtattactccacttttctacgggtatgaaaaagtagtatgcatacatggtacatgtacccacaccatcagatgattgcgtacatcaagtttagaagtgcacctctcaaagaaaagtttagcagtacatggaaaagcaatattcccacatgatatcattgatcttaaaagaaggtaatggttccttgatacgttctggttttcgttttcccttacgtggtaaaatattttcaagccgttgattttttaaaagatatttgaccgttcatcttattcaaaaacttttctgaatattatttaaaacttgagtagtagtagtatatttaacaattaatcaaatgatagaaaaagaattaataattaattaaattttttaaataggcatatggtcaaacatgtttaaaaaagtcaacggcgtcaaatatttagagacggagggagtatataccatgttatatcttgttatggggctttagagagtccaggtggaataataacattaacaaaatcatggatttgcccaaaatgtaactcaagacacaaagcgcatatgccatttttgtgttttttctagtttttcctcacatttttcagggtaaattacgtcggtactggtggcgcattttaatatacaattttacaatactttcattcatacacataaacattcatgtgaactatacatcatggtagaatgctaggtgtactcctaccattagtatctctattgctgtaaaaacagatttgtcattcttcagtcatctcattccatcgatcgagagtaggagagtagcgctcgagaaaccgaacgatttgcccctccccacactcataatgttactaccactgtagacgctacgtgtgagataataggaggatataacccacgtatcagcgcctgtaatgatagtgacattatgttatgttagtggatcctcatcccacacccatccattcatctgcttcttctcatattgcatcccaacctagttcatcccacaaatggccctggactgttgcaatgcagaggttttgttactagtttaatacgacaagcaatatgttttaacttatttgcacacacaccacacataagctcatgcgctaaaataaatgtgtcactgtaaggggattgtttggtgtggtgccaaattttacccaaccaattatttggcgactttaataatgtatccatttgaattgataccattctctcttacaaattagcagcgccgtaatttacccaaggtttaacacctagtaatgattcaaaccaaactagccccatgtatttttactactgctagtagattgcattctatctgtaatttactcttttatttatttccagttttttttttaatttcacggtagtctgcactctgtcatataagaaaaacttttatatataaatctgaatataaactatatataaatccatgtgtagaaaatgttgtttattttttaccgagggagtactccctccgttccaaaataggagggattttatatcaacgtgacacattatagttctataaatttagataaaagagattgtttaaatccatccaaaatcacttatatatattaaaacatcccacacccatctaaaatctcttataatattaaaactgtttcacattacatgacatccaccctaaggccccctttgattcataggaaattcataagaattttaagggcccatttgaatcataggaacgaaaaaacagaggaataggaaaaacacaggattctgacaggaatacaattgtaaaaaagaggattgcaaaacacagggatgaccgtttgattggaccacaggaaaaacgcaggaatcagataagagagatagactcagaggaaatgttacaaggttagacctcttgctaacttttcttcaaaatgtgcataggattactcattccataggaattttaaaggattggacaggattcaatcctttgtttcaaagaccttcataggattttttttccataggattgaaatcctccaaaattcctatattttttctacaaatcaaaagggccctaattagaggatttcattcctatagaaatttttcctatacaaccatttgaatcaaaggaatggatcttatggaatcctatgaaattcctatggaatacctaatgccatgcaagttttggaggaattctaacatgaggttttatacctcatggaaactttcctttgagtatttatctctcctctaactcctgcggtccaatcaaacagtcattcctgtgtgtatttatctctcctctaactcctgcggtccaatcaaacagtcattcctgtgtttttcttgtgttttgcaattctctgttttttacacttacattcctattaaaatcctacgtttttcctattcctatattttctcattcatgtgatttatgatttatgatttaaagggcccctaaatctttacattttggatggagggaatagacagggtttcctaaaccgccgggcccgggataccgtgccccggcggtaagcacggttaccgcggtaaccgtgaaaaaccgtacaaaacagtgccaaatttatcaaaaatttaaattattttttaaatttatttaaatttaaggaggttaccgtggtttatattatcgtacctcacggtaaacccggtaaccccgcggttaccggagtaagggaaaccttgggactactcgactgctacgggtgacgtaagtcagttctttctccgctgagaaaattgacatttagccatgttcaagatggggtttcgctggaatgccactcccgaatatggcttcgttataatgccattgtcaaatgaagccaacttgctataatgccatttcaaccattttaactgatttccaaatgttttccaatgttttccatcattctctgacatatttgcccctagtcattttgttgactttgttggggaaaggagaaaggggatcgatccccatccagatgccggcggtggagcgtagcggcggcggcggcggcggcgacggggcgtagctgcgagtcggtggccgccggctcctcgtcctcatcaccaccaccacgccaacatccgtcggctcgccgtgggcgtgacggagagggcgaggagagaggagcggagctcgccgtgcgcgcaacggaggcgacgagcgtggtgaagtggtggggagttgcgggagggaggcataggggacgccggcgaggcactcgaagagga

SEQ ID NO: 18059 - DNA, 2318 bp, Oryza sativa
tttttgtgatttctgagcaggtggttgggaatgtctagtccagtccaggcgactttcttgcgggtcgcaatggcatattgacatggcatctcgtgctgattccattatgcgtgtccacgatctgttcgtaggctgttacgagagctggggttgtggtgcctgcgaggtgttcgtggaattgcgcgagtcgagcagaacatagagtggggtatactaccgtttgcagtttatcacagagatggaggagatgggcatcccgtgagctatgaaggtgaggatatgataaaaagttaaaaacctaaatgcttcccctctcgctcactgtgcaaactgcaaacctgcaatcttgtcatacgccttttgcatttggaaaatatggatcctgattattatgcagcttttagacatgatcctgttaggacacatttctattttctgcccaccatcattgtgatagcgcagtgcgccggtaaactattcatcaactgtttgagccaaaaaactgcactcattaggatttacccattttatgcttattcgtgtcgtaccttttgagtgtgatactaccacctaagctactcaacaaaacatgcataaatcaacttgtgcagctacgttttttttttaactggcacagctaacatatgaaataaatccaaatgcagtgaccagattgagataacatgatcaaatacacaagacaagcatcaaagctttcctagtcaggctagttaaggtgtacaaccggacagcagcaagccgttacatggccaaattgttaagaagttttgctaggtagctagtgctaaagataaaattctctccaatcctggtcaaataagtttgctcagcaaggtaactgaaaatctaggacattgttcagataatcagtactgttgctaaagattagttgaatatgtcgagggcctggtgttgcacgtccactgcttgaaggagcttctttgccactgcacatgcataaaccgccgaaccttctgatacctgagttgccatggatgatgaatcgttactatcgatgctaacatgtgtaatgggacaaaaagaatctttgattctactttaagaaaactgaattgttacttaccttagtgttgaacatgaatatatggtgatcacctataatcccacccactacatggataagctcgagctggaactcatctagaacctttgctgcatgaagcagagagttggccttcttcttttcagtgagcttgatgtttacttcatcgtccactatgcggacatcaacgtggcattcctttgacctcctctgaacccatgagctccttatggctccatggagctgattgtcttgatcatccctcactggcctcatcgatgagctctcgccatcagcggctgcctcttgatccaactttaacacctttctcctgttatttccatgcctcttctgttccaccaggatcttcagctccttcactgttcgattgagctcatctatatactcaatggcatcacctactattgaggccctgtcattctagagcacagtttgtaacacattagtgccacaaccaagatatttaagtgctacaatcttgttgaagggtaacatcatgaggatgataacattgtggaatgtgctaacacacaaaaaaggcaaggaacataggaaatatcgaactgaatgcttctattgctttctcctagctaactagaagggctaactcacttggttaggatgaacacaattaggggtgttttgatttgttaccatgtcaatatattggtagtgccaaaacttgaccaactttggtggcaagccaaactttgccaaataacttttcaaaatgccaacaatttggtagggcataatttggcttaaaaccaaaacaacccttaataacatggcactgttatcagtaaagaacatcatactgatgaactatttttcaaaaaacaatcatgttgagtgatatatcagacagcatattccatatacatatgcatcaaaatgtggtaacgcaacttgaagaattttggacagataatttcaaaatttataccagttagatgaatacacagacttataaatttactgttaggtatttgtgatctgtaaaaaaacagagatttgctaaaccggagctatattggtgttggcagtttttgaatcattagttctctgagaataaatggatgaggatatttaaaattttgattatcttcagagcatgagtaacaaatggaaatattattgaaaatctgagtggttgtctgttaatgtgagaatcaccaagttatttacagcctaaccaactaataacttgcaa

SEQ ID NO: 18060 - DNA, 4494 bp, Oryza sativa
agcttttcccttgccctttccgaactcacccttccctctcctgcattcaagtacactatcaaactgcctgtcatctatctcctgaaaaagatctccacttccaacaccaataatcacatctcgttcgtcctcactgggaaacaacccataattttggggcaacgagtggcagatatcctttattagatgagattgagtaccatggtaccctaactggagagctgaatcactagcaaacatcaacccactcccactgtctggaaccgctgctactcctgtaagttcaccgttaagatccaaatagttagtaccattcagtgttgtgtcaccgaatacggatgtcgttgccgggaatgctggagccattgtgcactgcataagattaaggagatctggtgcaggtgtgtaaacaccatttggataaagtgcagaatcatactgctggatctgttgctccaccaatatgttttgtggatcttcgctaaactgatggttgatgatatgatctggtatagtgcagatagctggatcccagtttgcagtttctactgggggaacctcttgctccaaatcaatttctagttgatgttgaaggtggttaattgctcttgcagcttcagctagattggccgtattcgagagagcttctgttgagtacgggtgcactttgaatttctgcaaatcaatgcttgtgttttcactgcttgcaggagcttgatttgagtcatggatcaaagatcctgccatgagactttgatcgtgggaatcctcaaagtaaccagccccaacaatcattttggcaaaacagtgctaggcaccttcgctccaaatctaaaaccaacacaagtaaaaaaacatatgagcagaagaatcaaggacaggatgaaaatgaaggacaaatagcatcttagatgggtgctaatctagtgctaaaatagaaattacttgcaatgcacatattaagggaaacagggctactcaacatgaatgaagcagtggatataattcaatcggacatgaaaattttcagttggcttagctgttttggttgtttcaagggaagatggagccgtggagtttaagctacgcaatctgtctgtctgtttattccgtgtagagaagttgcatatagcatgattaatgagacatgaagcaactttgcttgttgcagacctaacaaactccttaccatctttctttgcctctaatcatattcatattgatgtttgataaaatgtgcttcaaccaccccaagtttactaattaatcagtaaaatgctgagtagcttgaaatcattgccaatgccaaatatacttcatttattataagctgatcactaaaagtaagaactgtaaattcagtatgattgaaagttctatagaacttaacaactaatttacagaaacataaaccaatgctaattaggatttgcatcctgcaaacagtagtagcaagcactggaaaaaacatacctgtatctttgcctcagccaacggttgaatggaaagaacttatgttcatgaatttgcggctcaaagactcatgagatccagtgctatgccaagactattatagtggcaagacatgaaacaatacaatggtgtcacacaagattgattccaaaagaaaaacaacagaaaatgccgatagcagtaacaatcattttgctgaagggtctttatgaccatataataaaggtcaaagtgaagttctatcatatgattgttattgttattataagagacatagccgagaaagacggaaagctcacaccctttgaatttggcatctttgatgttattcacccataggaagttgagaaatgcaagtcatgctttctgcctcttaccatattctatgatttgtactgctgcagttatgctttgagaaactaaacatacaactacctacaaggcttcaagtattcaaagagcacataatcttgcattatgtagtgtagatatcagtatctgtaatttgaacttgattgtatttgtatatagctgtgcagtgtgcactcttcttggtctgcttaattccagatgttctagatctttccggttttacccatcaaggtactgatccttgagtttcagcaccttccctcagacttaaattgtgaagcatcagacactgtaagtttatccagctacaagtgcatgtaaaatagacagatgaccacgatacgcatgcaggctgcatgtcaataatgtagcatcgatcacaccttcagattttgctgtagctgttaatgatgttataggtaactactactttgcttttttttccattgtgaattaataatatgcgtatatttcgtctgcaaagaattttctgaagtttaaactgagattgcctaaataattattactaataggtgatggactcatatctagctctggatcaagggatttgaaccatatagagtaactgatattatataacattctttcacaacaggcaattgttttatgctttaggttgcattgcttgcaatatgacacctgctgagataatctacattatttttatccatctatgttaaattaatcttttggtactggagtcctatctggttatggaatcatttcttagaatgatgcagctatgtgaacagcgccgttctaagtgcttctattaatggtgtaacctccttttctgtttcgtttgatggattcctcgtggtgtgcctgcggtcatcattggatgcaatgtgaattcaatcctgcatgaactatggattgccagtacagttatattaccttcttaacatagttaaccaatacctgttatattctgttgatcaggtagagtttacggattatgcacttctgacagttatcatgaggggtctggaatccattaggtttctctccataacttctgggagctcgcatgcacaagcacaatggtattgccaagaattccactcctgacaaggtgcgtatactgttaacctccacggctctctcgccttgtgacattgtgcacagacgtgcaacctcctgcttggacccaagatgaagaggaggcgtgaggtgttttggaggggaaagggagacgtctcacgctctccttgcttcagctggattcgcggtgggttgaggcacgcagaacgcatttgcacggtcaaatagccgcattctcctgttcaacagagtacgaatcctccaaatcaccgacttcccattgcaacatactcctctcgataccttttatccttcttccatttttgacctcttttctctctttgagagacttttttttttaatactccaatgcatttttgtgtgaaaagactctacttttgttctgatccaatgatatgtataggtgcaattctctattttatttggacgtgttgatggtctggtacgatgcaactgacaatctgacattagtatggtacattccgtaaaggccgattttgcaaaatggaaaaaacattaagacggcagttcggcccacggcccagttggcccaacatagcccagtcggaaatttttttttttgaaataaggtaaaatgcattacccggctttggggagaaagccaaacagcaacatacagaatcttaaacagaaaggaaaggaaaaacaaaaacgacacagaacaaactggggatgccagcatccatgaagctctaaaacttaagaaactaaaccacccaaaaagacactttgacagacagtatcactcgtatacagacaacttccaggaatcaaaccaaagcattatcaggtaaaacatctcccggtcgcagctccttcatcttttgcttcagcttctcaagccagacgttcagctccacgcgctctctttctcttaagagtaccttccaccgattcgccagagcaattgatctgtaaaccacctgcaaaggtgttttaaccaatttgttttcaaacacaaaatcgttgcgtatagtccataacccccaacataaacaagcacaaataaaaattcccagattaacccctaactgttttttgacgacccttagcccatcccaaaaattcagaggtaccttatcacccccaatcacttcaattacagagcaccaaacgaatttagctatagggcaattgaaaagaatatgactggttgattcaactttcaaacaaagcttacaaaatctatcaccccccttccaatttctgctaaataaaagatcagcacaggggattcttcccctcccagctaaaaacagaaaatgcttgattttcagagggaccttgctcccctaaatttcctgcatatccttatcaacaacacccccaaacttcatcagtctgtacatagacttcgtagagaaaagattctttttgtcaaaaggccagattaagcaatctgaggaattattaagttctacccttagcccagtcggaaatgagcccaccttaatcctccggaagccgtacttgcggcaaaagcccattcttaacgtcgtggagcgtcgaaatcccatttccgttcagcgactgaacagaaac

SEQ ID NO: 18061 - DNA, 8451 bp, Oryza sativa
agagggatgctgcgaggcggtgggggaggcgcgcggtcgcgaccaccgacggcggcggtgcggattcgttcagcgatttcgccagggcgccgtcgaggagctaccagcacgacgaccgggacctcacgcccgtagaggtaagcggggtttatttatctgtttatagtctgttccactgttattttgcactatcattcaacatagtccgattgctgatgctatcgttggaattgctggacactttttttttttaacgaacaagatggacacttttgtgggcaggtgggatgggaggttaattgaccgatcagttaattgtctatatttgtttatttacctatttacagttagatttaatggtcgatgtttatcctacatgagctgtttcgtcatgttgaaattatgtgtaatcaactaatcattatctagagttacttgattaactgagactttcctgtgggtttgcaggccaaactaaagcctctcctctcaagggccaacctccttatcgctagggacatagaatgggcaaatattgtgttggctttcgagcaggtaatgtatctgtgtctcatttactcatttacatgtactgaagttgcgactctaggatgcttctcttgctgtgtttggaaatgaaatagtaacttgtgttcaattgtccttgctatattgtttttgttactgtataaagcaaccggcagttttcacgtgattcatggaggatagctcatacttgaataagtgcttcatttcttgggtaaaaaactgaaagaagtgacataattcattttaccagcaacaaaattacataattcattctgcgcttcagaatatatgcacatttatttgggacattgatattttctcccagttttcgaattatgtcttttgattgtttcagactttcagcctgttatcacttactgttattactcgtactgcaggagagtagatatatcataatggatccgctctttcctcaatcagtatgtgtactcagattttcattggttccgttgctgtattactctgttgttgtattattttattgtcttagcttcattattgacttgtattttttgtcgaatttccagcctgttggtttcattcgagagaaaagcaatgtcatatttaggcaggtatgtctcgtgattaatttatcctaaataagttaataccgtagtagctcatgtctcatggccttgttctttacttcaaagtaacttagtggaaaagagacaggattttgattctttaaattctctgcgtagcagtacttaagttcgaacatatatgatttcatgttctaaatattaaactagtgtcataatctcataatatgttgaacttttcaaattaactattattgtatgctctaatgtatagtgtgatatttgtactagtgtgcttagtcagcatcgactttattttatttctttataaaatattatcatgatcttatatcatgcatgatgtcctattgagttatgcatttctcttcctagtgctaaagaacagctgttgatttttagtaggttagacagatccctttcttttagctatagcaccagtaatgactccttttcttttgtgttgaatgattttttggttgctctctttgctgggcaaggagtctcttgccacgttttcctgtaatgatcgatgctacaaactttcagttagggtggctgtgatgtggtatgtaaaatttcacaatgtgtataatgtggtgggactcatgcaatgttatgtagaatttttcgctgggccggcaaaagaaaaccggccaagttttgtattaagaaggagagaaagttttacaacagaccctaaaccagaaatggcttaggctacagaaaaatttcacatcgatttagacaacagacaagcacagctgctaaaaccttagcaaattagccgccagcgattgcactcagtagcccagcagccttccatgtttccacttgtcgacaattgtggcacaaaggtgaaccgctgaagtagctcgtccatcaaacacatgcgcattcctttccttccaaactatccatgttaccaagataaccccagcatcaaaggtcctccgatccatcttgtgaactgatttgcgcgcttcacaccaccaatccaacaggtcatccatgggggaaacacaggagagtcccaggcgactcctgaccctcgtccaaactgccctcgtgtactcgcaagcatggaaaatatgggtgcatgattcagcatccttcccacaaaggtgacagtatggggccaagtgccatcctcgccgctggaggttgtccgccgtcaggcatgctccacgcatggagtagtagtatctagctatagagactgggaaaatagagatatggaagggaatgctttggagaggggcgcaaggctgtaacttgtgggtgtttgaattttttttcaaaaactatttaccctcccatttttaatgatctaacatgtcaatatgttaccatgttaagtgattactgggatgcaggggatgggctatatctgtgcttttgttctgattcaacttaatggaaacatactttacatcttctttcagagaaatatcaactcctccagttatcatgcagaatgttttatgtataatttgttttatcgatctggtagatttgaggtatagcataaaggttcattagagaaccttaactagctattaatagcagtagtttaaaaagaagtgttctctattgtacatgttcggcttgtttatttgatctggacttgttgattacatcgtttcaaaatttgttgcttattatcttggttgttgtataacttttcattgtgatgataaaaactaaatatgtatcaagtttgtgtaactgttgtgcaaaaaggtattgtgtttatttacccattccttatctttgatgtacaagaaacattttgctaatgtttcagctatttcgctcaagaaggccatttgttgcagaaattactgatgctatgggcaatgagatcttcacggtactatttcataaatttattactgcactcctttgcaaatatgttcttacaccatttaattcaggttcgacggccattttggcttatcaacagttccatttatgcagaagtgaatggcaaggtatgcaaaaattctttacttgcttctacaaatttatttagatgggaatgttgccatcagattgtttcacggaatgtactgacattgtttcacggtttcaatttggttaggaggtaggcgtagtccacagacgttggcatctctggcgtagaatttatgacctgtacttagggtaatttgatcttctgatctctatgttcccttgtttcatagactaaactcaaattactcaattctttgtgtaccttttagtattgctttactgcctgacagcttggtctgccaccttttgtgttctttaggaataggcaatttgctgtggtcgagaatcctggattttggaactggacctttactctcactgatgaggatgacaatgtactagcccagattgatcgtaattggaggggaatcggttttgaggtaaatatcttttctagtagagaattgtcaaataatatgctttttcttttatgttggtgggcattccatgcttatctgacaagaaaaaccagatacatatagattcattatttacagattgatagtaagaactgcccttccaaatttatatgatggtgttgcttttttacattgcttgaagtttttttttagagaactcatgaattatacaggacatgctcattgtgcagtattttgaatttgctttgtggtgactccacatattgtgcagtttgatccaagctgatggcagatgccacaccccacatcttttcagagtgcattgtttcatttgttgcgcactgctacttctagcctgcataaaaaatgggactgaacttttaaggactgaatgtatctctggttcactgcagctcttcacagatgctggccagtatgcaattcgatttggtgatgcaggactaaaccgtaaatttggtctcgcttcagatgtaagtgctgttctcattttagtacttcacaagccacgcattgagtgaatatttttttgttgcctaccttgcctagttaactgctatttacctgatcgagatccatgtcacaaattatggtcacagatcgatgaactgcatgttgttcgccagctgagtttacctgaaagggctgttgcacttgctcttgctgtgtctctggattgtgattatttttcaaagagaggtggctggtaagtgccgtgtgaacttaacctgtgtagacggttcctctgtaaattttggtttaactactgttgttgggaaactgattgaaatgccctttttctttcaggggacttccttttcttattgccacagagtagacgcatatgacctactaccattttcagcacaagaggaaaaccgatgaccttcacattgttgattagtgaagaaacttaatgggtcgactattttgcgcgattgagatcgttaccgaagcacgaaacggttttttgtgtcactgcatgtgctctgctcacttcacctgtcttctagtacgtgtgaatttcgaaagcagatgtcacccgaagaagtttgagcttaacatccaactcgattccgttttgctacagtacaacttgcagcgatgcagtagctcttcattagatggatctttcagctttcaggctgcaacctgtttcatccttatgccctgtggatacgaagcaaaccccatgtatgatggagacgtgcattgaagtctcgattttactgcaggtctctgaggtgctataccgctgcgagtgataaattactattgccatgcgactctagcggtagtaccgtaactctagtaacattgtaccgtcgtcagaactcagaatctagtatctggcatcctagctacaactctcataatccaatacagatacagtactttctacaggggaaaaaaacaaaatatcgtatcttttccttaggggagacggaatcgaactcttaacacgcgaggtaattggagtgatgatgtgccttcgtgcgtggaaagatggttagatggaggtgacagggaaggaaaagccgtccggaccggggagagatgacacggatcgcgtgggcttttcgtacaatccgacgttctcactgtccataaggcaaagccttgcaggccgaaaggcgaaagaattgggcttttcattgtggtagggtctcgtgctctcgttctcctttgccatctcttcgcctacaccggcttcgtccctctcctgatcctctcgtcttcctacgaaaaaaaaatgaaaaaatgctagtgctgcctacgagaggcgtcagctgtagtaacttgtacagctactactttcaccgaattgttctcgtcgggaagcgtggggggcatcggcgtgccagtagttgttatttccagaagaacagcagttggtgcgagcttttactctggaaggtgtaggagcgtcgggtgtgtgttcctgaaaaaagttagaagttagaaggaagttgagagtttaaaaaaaaaagttaaaagtttatgtgtgtaggaaagtttttgatgtgatatgatgtgatggaaagttgggaatggggaggaaactaaacacagccgttgttgtttttttttttgcctttcctttttcatttcaaaaactcaagcctacttgaatccttgctagcagtaatagttgtaattcgaaggttattgagccgaatagaaaaataacgacacaactgctacaatcgtgccgcggcaaactacaatcacaagtaaacttcatctcttaactccactaaaacaacacttagactatcataaggactccccttaaaacatcgccttcaacgaggaaatgaggcgtgcacgcgccgtcattgtcatgttccaatcaactaggatcagaccattggttttcacctagggaaattccgtgaactccagacaatgccttcaagaagggaagaacgtccattgccaagtacaaccaattaaggccaaacttagggatttaaccccggagtcaaagaattagtaacaggcaggagtaccaccttaacgaagtccactagcattggttgccccatcattctgagacagaacctccataccttccaaacttaacacaatcacaaaaaggccataaacatcatacctgcatatttctatagatacccttacaaagataatgtcgcgagaagccgaaaaggtgcatgcccaaaatccatagggtggatctaaaggatgtgacttagatgtaagcgataccttgaatcgaagccaagctgacgatgatctatggtagatctgaacgtcaccgccttatgatgaagaaaacatcattacgagaagtagccgctaaccattggataagaagatagtcggcgttgtccgcccccttcaattgcgacgaggtgaagatgtcctcgatgccggcgaactagagaatcttcttaggcacgcatgccgctacgatgcccaagccctcgccggctccaagcgaacggtggaagtcgcacttgccggcgatgtgcaacttccccatcttgttcccctagtagccacaatggaggttggcgacgatgacggtgtttatgaaaggtggtgtttacctcttcacttgacccgagcatgacacgctcgttgcaccgtccagccgccgccgttgacgaactcatccaatagtattcgctgctcagcgcgcacctgtgcgataccccgccgctgccttcaggccttcattgcaccctgcatggaagtgtgctctggcggcgacggcgagacagcttcactcggcaagaaggcgcactcctaatcgccgatccgcaaattacggattgatccgtaatcaacacgtgagcaaaaaaaaagaagaagatagttttgataaaaagttgcaacttttaaaatttagtcatgatgttaatatatactgtagtctaccctccgtctcaactaaatataatcctaacagcgaatctggatatatgcgtgctcagatttatagttaggatttatttatttttctttcgagagtatagtagatgtaaacgagtgaacatttgcaacagtgaaattttttgtttttgctggcatgccttgtgtggattcctttttgataaaaaaagaactggtagcagtaaaatcatatcaacgcggccaatacactcgacacggtcacacaccaccgcggctgcctctttgccttccccatacaaagggtccagtccccgatgatccaaaaaggcccgaaccgcagcgtctcggttctttcttccttttacttctcacagaagctgaagagactcctccgccatcaaacccctctcctcctccctcatcccactgatcactccggtttctccgcgagcagcgaagcgaccgccattagactcgacgcgaccgcgactccggcgaactactactcctcctcctcctcctcgctcttcctcgcgaatgctggtcgcggcttgctgctactagcctctccaccacccagtttggtcgatgagagagaagggcccctgccgcggcggcaacatgggggagagggatttgggcgacatcgtgctctcctggtcgctcggtgaggtcatggacgacgacctctacagaggaaaggtgattgatcgatcctcatggctgctaatgattttgcgcgaggcagtgttgctgacctgagcaatttgtttcgttatttttttattaaaaaattcggggtgtgaactgcgagatggatgcatggggttttcggtgtacgatttttttttctaaaaaaacgcaaatattagggagtgacttaacatcaaataattaaataattaaaaggggtgaggcttcgaaatctaggtcgtttaggccaccgccttgtttagctaaccagaagacccctaagcgtttctcgtacaatttgttcttctatgtttacctgggagcaagctgttgtatattgtagatgttttgtgagtcgcttgtagtgtcctgttgcttaatgccttgttctgttatagaagctcactagtcagtagtccgtacgtcctgtaacctctgtagtttggagtgttcggaaatgcagttgatactccctccatattttaatgcatgacgccgttgacttttaaccaatgtttgaccattcgttttattcaattttttagtgcaaatatgaaaaatatttatgtcatgtttaaagaacatttgataatgaaccaagtcacaataaaataaatggtaattacataatttttttgaataaaacgatttatcaaacattagacaaaaggtctacagcgtcatacattaaaatatagaggtagtatatgttctgattgctgtgtacgtgcaacgcgatcaataaatggtttgctactttgattatgcatggggatcaggaaatcatacgtttggctgcaggaattcga

SEQ ID NO: 18062 - DNA, 1013 bp, Oryza sativa
gtactgagcaattactgtcaattaatcttaatcaatcgcaagtggatgctattgagtctgttatctcagcagtgcagtgtaggcatttgaatctcatgaaacttatatggggtccaccaggtactggaaagaccaagacagttagtgctttgctttgggctttggcatgtttgaaatgcagaactcttacatgtgcacccacaaatgttgctattgttggagtttgtactcggttccttcatattttgagggatttcaacaagaatgccaatgaaaactttctacccttttctcttggtgatgtcttgttatttggaaacaagtataatatggacatcactgaggaccttcaagatgttttcttagattgtcgtgctgatgaacttgttgaatgcttttcatcgttgtctgggtggagatacagaatagcttctatggcttccttttttgaggattgtggttctcagtatgatatgcttcttgaggatgatggaagaagcgatcctatttgtttcctggactttataaagacacaatttgatgtgacagccacagctttaaagaaatgcataatgaacttattgattcaccttcctaggaagtgcttttcacatgatagcatcagtaatatatcaatgctctttgattcactggaaaaagttgaagcccttttacatcatgaaaatttaactgatgatggtgcaaaaaggggctttggttttctgtctattcaagacatttcttgtgcaaagtctgcattcattattgagaaggaactgaatagagcaaagttatcatgccttcaattgcttgaagatcttgagagatcactggatctacctactggtagagacagaaattggattcagaactactgcatgcgtaatgcaacacttattttttgtacctcctctagctcgtatcgattgcatcacatggaaattgcaccgcttgatgtgttaattgtggatgaggcggctcaagtgagggaatgtgaattgattattccacta

SEQ ID NO: 18063 - DNA, 566 bp, Oryza sativa
ccttaattgaagccacaaattccagtccaaatccatctcttcctccgccggagacgacgaagaccagggtttaacttctcgatttgtaaaaacagcttcttatcggtttatcgaaatacgacaaaaaacgatgaatttgatcaacgccgtaaaaaagcggctactacctatcggttttcacaaatcgatacctaacagtttcacgaaaatagatcgattttttgaaattccatcggttcggcgtgctggggggcaaacgttctcacgaggaagaaaggtcggacagacacgggaaaatgcgcgatttccagccgttcgatgggttgacggcgtgatctatttcacctgggccggaaacaggtgcgcgagggattgcggcccgttatagttgggctgaaacgggagcgcgactaatgtgcgggccgtcatggtcggccttatcacctgctcgggagattgatcaaactgtccagcttcccaaaactggaagaagatagtgcaccgtggaaacctgccaacagcagcagcgaatggatctgtgcagtgctggtgcatggttgcttcat

SEQ ID NO: 18064 - DNA, 633 bp, Oryza sativa
attcctgcagccctaatcgcacggtgggtatgttactgtactgcccagatcggtgaccgtacaagccggagcgggtcggatggcatcggtcttatccgcaaaccaaccaaccgactcccccctgcgtcgtttggctggtgtgccgctcacgttctcgcttgtcctctttcgctgctgctgaccccagcagccacgaccgcagggagcatgggatcttcagtgccgtcccatgtgtacaatgaatatgcctggcctaaataaagcctgaaaatcacattgcaaagcaagtcaaattaacacagtagtaagcaggtgcggtgagagattgtcttggactgattttgtgtggtgtcttgtgggttgcaggagatttgtgagcgcttcagcctacgacaagaacgtggaagagcaggtgcgcccggcggtggtgccggacgatgtgatcggcagcgtcgggagccctgacaagtactggggccctcacccgaccaccggcgtgttcgggccagcggcggtggacgccaaggcggcggcggccgttggcgcggcgaaggccggcgcgaatggtggcgcctccgtgctcgaccagaaggtttggttccgccccctcgaggacgttgagaagcctcccgt

SEQ ID NO: 18065 - DNA, 566 bp, Oryza sativa
cttatacaagaccgagcactgtatcggcgagctcgataatcagtacaagcggctcacggccattcatggagatttgaaggggattataacactggtgagtgcctcccattctgctgcattcccacctcccacctaacgacgtctacagtttaacgggatacttcaacactacaacacgcgcatcgcagactcttatgcgcgcgccgccaaaacctcgacagacagcatgggttggctggcactcaagacgaagcaggagaccgtgtcaatccacgtcattaccatccttacccttttcttcctcccggccacttttgttgcagtaagcgccggcctttttactttgtatctgtacctgtaccactatgattttcaacctcgagtctgggccctgactggatatcagaccttcttcgggagcggagtaatcgactttgagagggaaggggaggaggatgtcatggaaggtaagtggggatactgggaggtcagatggggagcgctcaagctgttcggtgcattcatcgggccactgacgggtctggtgctggcaacatgggcagtaa

SEQ ID NO: 18066 - DNA, 921 bp, Oryza sativa
cggcacctacccatagcccaacgtcctcctccctgaagccacccacgtcgctttcttcatcatcttcccctctctattgcggtttgcgacaaggcccacgagcaagaatgggattgagcgagggtggcgacggtaacctgaggcctggcggagtgcgacgatgccaacattgtcgaaggggaggcaaagcggcagcgtggagcagagcgaaggacgcccttcgcgaactcgattgttgaatcaattgaagaagggattgggcttctgcgagcgtggggttacgtcgttgtcgtggagggcagcaagttgtggacatggatgcgcctggtgctaccaatgccggagaaggagacggtgtaccggcttgtgaggggagggcaacagtagggcgatgaccgcgatagcaacccaacatggccggaaagccatgctagggtttttttttctcttcctcctaccatgcctccactttcgctccgctctgctcctagcccaccatctccctacccccaatcgagctcgtcgatgtgggccctgcatgctgactcaaccagttggatcagatcaacgagctatgtcagtgcaaatgttgaaggagacaaattataacggtttcaatagctagagggttaaaatatcttaaattgggtttgagggaaacaattttgattggatatagtagtatattttgagggagtcacagtgaacttattccccaataaaatatgtaaagattccttgaaaaatccggcacgagatcgagaggcccattaccatatggaccacatggccccgcaacgttcgaattgagaagacaaatcggccgcaaagcctcgactgcctaacggtcaaatgcctcctcgaattcaaaaccacccccgctccgcctttatatcggactcccacgctcccttcccccat

SEQ ID NO: 18067 - DNA, 427 bp, Oryza sativa
ttacttggttagacaacgccgtgggaaaccaagcggaggagagaaaattgacatttagccattgtcaaaacggggtttcgctgaaatgccactcccaaaagtggtttcgttaaaatgccaccctcaaacaggggcaacttgttgcaatgccattccatccatttcttctcagtttaatttttttgtaatgtttttttttgctgagatgaccaaaatacccttgattctatctcatctctcctctctgtcttcctcctctccgttcggctcggcggcacaactagagacggggacggcggtggcgtggccggagacggggaaggcggcggcgcgcctggggacggggaaggcggcggtgcagacggggacagtggcgacgcggctggggacgggaaggcggcgacatggctggggacggggacggcgg

SEQ ID NO: 18068 - DNA, 724 bp, Oryza sativa
aaaagccaagtagttttcttcctcactggtcttatttgttcaatagttctttttgatcgtttgatggtcatcataacctcacaataattttctttcattgttcatctttaggtatgcaaagaagctggatttggaattagtctttttgagagattggttgtactggattttgaaaaacatttgctgaatatacaatatcgcatggatcctcgtatcagcttgtttcctaatgttcaattttatgggaggaagattttagatggtccaaatgtcatgtcctctgtctataacaaagattacacaaacctcccttttggtacctatgcttttataaacatcagtgatggaagggaagaaaaagagggcactggaaacagttggcgaaacctggttgaagttgctgttgttttgcacctgatccaaacaatttttaaaagtatatttctttttctcatcatggtatttctaatgtctatatgaaactacttggataatataacattatatctttatttcttgcttacatgagatattgccctacaaattagagtgttctttgcctacgttgtacagttggctcagaatttcttcagcacatggtccttcagtatttattgtattgtagagaaatataactttactgacttattagctgtcagctgcaacaatttgtgattttgatatccaatgttgagtgtgcgttgtaaactgctttaatctgggt

SEQ ID NO: 18069 - DNA, 662 bp, Oryza sativa
taggagggaagtacttcaaaagcttatcaaacttggtgttggctggaggacaacaatgaagaatttgaatttcaatgtaattgatcctttccagcttgcaaaagtatacaaagtcagggacctttatcttgtttggagtaccgatatagagaaaagcgaaaggtatgttcagattataagaatttgggacctgttgtctcaccagaatgttgcaagaactgttcaacgtcttgaaaatctgttttccatgtacacggatgagtacctcgataagtgcagaagagtaaagactgaggggtatgtgcttttttgttctgccagtgtttatattcaggctctgtggatatcttttccttttgatgctctataaacagtgtaatctggtatcctcagaaaaaaatcactaatcttattgacttaatatatttaatgaatgaaatgtgcctgtacatgtcaaggattcttgatgcttgcaaatgaactaaatataatgtgtcttattttgtgcttcatttttattgtggatactaggaaactggaagtgcctgttatttgggatgccgagcatgatattattcgctatcggaaggttctggaagttgatgctcaggaagaccatgatcatgtggacatatcatatgctatggagaattcgggagtca

SEQ ID NO: 18070 - DNA, 648 bp, Oryza sativa
gagtcttctgtactactttttcccgtcatgtgttgacaaacttaacccagagattgggcttgtatatggagaagcacctgtgctgcttgaatctggtaatgatgagaacgcaattatgactatctttggagaaagcaagagtgaccctggtaacttgcaagggtttggtgccgaacaagttatattagttcgtgatgatgcaaccaagaaacaggttgttgaccttgttggtaaacaagctcttgttttgacaattgttgaatgtaagggccttgagttccaggtatgagccttaccacttaaatttcaattgtggttgttgataagcatttttcctgtttactgtaagaagccttttaggactgaattatgttgtattaaataaatttctaggatacttatttatttttaaaatatcattttgtgtaggacgtgctgctgtacaatttctttagctcatcacctttaagaaataaatggagagttgtgtatgactacatgaaaggcaaaaatgttatagaatcatctgaagagatgtcccactcttttttcgacaaaaacaagcattatcttctctgttcagagttgaagcagctctatgttgcaattacacgaactaggcaaaggctgtggatatgtgagaatgca

SEQ ID NO: 18071 - DNA, 3002 bp, Oryza sativa
  unsure (1)..(3002): unsure at all n locations
atgaaacaccaaagagcctcttgtgtatacttgactcagcgactacatataacctgctctctgattccatctgttcatatcttggttcaagaaacaataaaatgactcatagtcaagttgggagaataactatgcttcttctccatgcagcaaggttggatgattcgttgatttcacagcttgtggaatatctagacagaggttctgagtgggcaactttttttctatcgttgaagaagtatcttgacaatggtgttagcagagacatcttactcttggacttcaaatttgctcttgattgcacttataaggcaaactggagggctgaacactacatatccccgatatgctatgtagatctcattgagtgccttggctttttggctacaacgcatcttgtactgaatgactatatgttttgcacaaaatctctgttggccaaaatgatgaagtgtcgcactaccaagggttactttgagacatgtatggctcctagcacagatatcgatctgggctatgcaggtcattcagcacggtgtttcatatacctgtcagttaaggatcttttgggaagcaagcgtatgattgtagagtgggttcagaacacctctactccaactagttcttatgttccaatccttctgagattagttatcacactttatcttgtgactgtaaaccaagacgatggagatttgtatgaggttacagctttcctcgagaaaaatcatgtttttacggatttacctcctgagttctctgaaaagattagaaatgctttgaggatgaagtctcgcacagtgaagaacttcatgagggtatttgctgatgcccttgcagcaataggaactcgcatggtagttatgggtgatattaagaaggcaatggcacataaatgccagccagacttgaatgctgatatgattagcagtgtggatttgagtgatgctaagaaagtaatggcacttctttcaacagagaagtcaagtagtttaaagcaggaacctcagctgccagagatcaaatctgtttgtaacaaaatttgcaacgctacttctggtcacttccctttgacaagtgtaggaggtagccagaagagtacaagtaattttaatttgagtgatgtggatcatcctttgttggagaagtttgaggcgtttcaagtcaatatgcctcaaaaggtgagttgataatttggtaaattcgtttggtcatcttcccttttgttcaattgtttaactacggacagcgtttttctgcagaaaaatggaagcttaatttctcaaattcttagaagtcccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctattatgtctctttttcaaagttagaacttgttaaaagtttgataaagtttatagaaaagtgtaacaacatttataatactaaattagttttattaaaccgatcattgaatgtgttttgatagtttttgttttatgttaaaagtattgatatattttcatacaaacttgatcaaagtttgaaaagaagttaaaggaggttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtgggctccccgtaaattctcccccgaaaccgcccgagatggcggctgcggcggcgcggctgttggagagggcgacgagaaccgcggcatcctgctcctccgctcttctccgcagtcctctggattctttctccggacgcttccnnnnnnnnnnnnnnnnnnnnnnnnnnnnnnnnnnnnnnnnnnnnnnnnnnnnnnnnnnnnnnn

SEQ ID NO: 18072 - DNA, 698 bp, Oryza sativa
ttcctgcacccccgaatcgccatggcccagcccggcaagccttctggatggcttgcgggctaggaactcagcgccaaccattatggcgctgaactaagggacctcagcgccagcccacctggtgctgaggtgggacttggccgaatcggccatggcccagcccggcaagccttctggatggcttgcgggctaggaactcagcgccaaccataatggcgctggaccccttgcgggcttggaactcagcgccaggcataatggcgctggacctagggacctcagcgccagcccacccggcgctgaggtgggacttggccgaatcggccatggcccagcccggcaagccttctggatggcttgcgggctgggaactcaacgctagccataatggcgctggacctagggatgggacttggccgaatcggccatggcccggcccagcaagccttctggatggctgggctgggacctcagcgccagtgcacctggcactgagggtgaaaatctcagcgccattttccctggcgctgagtttgcagtcctgctaaaacttagcaagactgctctctgtccagtcagactttgcacacaacacacatcacaggcaataatatattcacaggcagtaatatatccagagaaccatacatccatccatcaattccaacatcattccatacatccatagaatccatcaa

SEQ ID NO: 18073 - DNA, 1174 bp, Oryza sativa
cagcaagctcatggagcctaccatcacctttgtatagcatcgaaacataagaactaagcaagtcttaccaccaaaaaccaaaacttttagcggaaaaagttaccctcaagatctgaaggagattggtctgaccagagtaaatcagccggtccaactgtcctttgtggtgccaacgcctatcgccatgcatcgcagttctgaccggaatagatcggccactccaaccatactttgcaccaccgatgcttgtcgccgttgctggtccaacaacccattatgccaccggtgttaccgccgaacccgagcaaatacaaatcaaagaactctattagtgtttacaaagtgcacaacaacactcatctctaaaaaattgactaaactcgaaaccgtaactttttctttcaactcaactctcaaaaaatcgataccgagaggtctcaaccactcttctatatatatatacccgaagtagaagcctaaaagccacgaatccaacttgtacaagtcatcctaatccacaaggaaactttcccatataaatatgtaacttatctcattacaattcaaactctaatcttctcaaatttggcctcctctcaaatttgactctgctttccatacatacacaatctcccatcatatgtcgcatggaatcttcaccaaccacgcacattgttctttagcctaagcataccacatgatatcctgaatgttcggacgtcatcttctcccaagttgactcccaatcatcactaacaatactatcccgaggcatcaagacacacctacacatgaatcaaagaagaaaccatatccgagcataatttttttcccaacttgactcaacattagcacacaacagtattacatatatatagaaatcatccagaagtcataatcatgaaataatcatgagtatccaaataaacaacccgaaaccaactccaaacaggaaccagccgattagaccgtcgagctagccagtctgatagcatgctatacgccggtctgactggccttctctacctagtttgaccggtccaacacagtcagctcaccaattattcaccaaatattaaaatcaattatctcatatgtcgattattcatgacaaaataaataataagaaaaaacactttgatttcacacctcatggatcggaggctgcaggaat

SEQ ID NO: 18074 - DNA, 30377 bp, Oryza sativa
  unsure (1)..(30377): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatatttccatcaaacttataccgaataacatcattgaatgccatcacaaagattttggccatagttaatttaccaaacttttaaacgattatatcatttgcaaccacaagctctgtagcacacatatgcccgttacgccatttacaaccacatacaaccgtgttgaaggctctggtcaatccaccccaaaccattttgttatcaattggccagcggataaaccaaacaaagctattttgcatacaaattggccttctgaaaaccatccatagatgaggctgaaagtttcttaaccaaaggccaccaccgatatggaacttttgttacttccatatgcacttgattgtgaaggattgacaactaattgtaaaatattaacataatcttgactatcttgtaagtgatatttacatgtatagttatggtatggagtagcccataggctaacacggtgtttaactaagctgcctttttgttttaactttgaggaaaccaaactgacctaaaatggttagattgcggcaatttgtttctagaaacggttgaaatcaatctgcaagagtataggagaatgtgcatatgtagctgtagaaatcctctatttcaaaagtagctctacaaatccaatagaatagttggtacacaaaacgtattgtacgcttgcaactaaatgagtatatgtaaattagaataatactatactctatagcctgacaaagggaactattaagactgcaggaatctaaataatgatgagcgccaataacagtgttaaggatctttctgcacagtcaacatatgcattatgaccaaccactggataaatggcgaggatgcacacatgacattcatcctttttcaaaattaataactgagctatcccaaagaaattaaacgattgctaaaatactttgaatataatttgtgctcataattacaaatggtgttaccacagataaatgtgttattttcttcagagagaagaacctggaagacttgtggtagtttactcccttggtcataaacatcggttactgaaagaaaatgcagaaatgttagaacaaattttattattaccttgatggttattatgaattgaagcctcatggtgatgaactgttcatatggcctcatttgcacataacagcagagtttgtactatacaaaatgaagaaatgccatcaacttatgtgtattcactcaaatgaaggccctcatcatcccataaatgctacaaaagcatatgcaaagccatggaacctataaaagctaggtgttacacatgcagttcaacaaatatatcactgattgaagaccatgaacctgacagtccatacataggcctcgtaatgtaagcaatcatggcatcatactgcagcaagcggttgcgatcaagttgaattgtgtgccttttgtactaaacatcaatattatctatgaaataataaattatcttccagcttgaatcaacactttattcttctcatttgtatcgccatgaagccaattaggaacactgaaggaggtagcaaaaaacaatcatcttatgtacaccaaagcagtaactaattattcctgtgcatgcacaaatagaacatgtgcaagcggacaagtagcacactgatttttttataggttgacctttcatggtgcattgttttgtggcatcctgcactaaccataggcatatggtcacatcgtacaattatatagggaaaaaatcaggccaatatctctttgtacatgatattttgctgtgtgtaaaaaatgaaaatatgtgctataacaacaaatggctgctaaacaaatggaatcccagcaagatatataaaactatcatgcatccctgaaacaatggggaatcatgtattttgaaagaaataggaaaacttgattgttgtttgcactttaggccaattgtacgggtagcaagcatatcagaagaaatatttatggattagtaggaatcatacctgtatagagagcaaagcaaagctaatctgagcagtaaaatacctactacagaaaggaataggtatatagatcaacaatatgaggaaaacaaaatgaacctaataagcatcagtgtatacaaagtagtagaggatggcagtaccaattggagaggtgtggaggagccgatgagcagcagccacaagaagcgaggagatggccatggacgagatggttggtggcagtgctgaccattatattggctccacgagaagacgacagcggcagtcggctccacagggaggtggcgcagaatagtggctccaagggaagggagcggcaccgctggctcgacgatgacgaagcggcaccgggtcgctggcaagtaaggcaagaaggcgacaatgctggctggctcggcaacacggcggttgtagcgctcactgcttgctctgcgagaagacggcggcgccggtcggcagcgaggattcttggggcggaggtggtgaggattttgggatggggattggggatttgagagtagcatgggtggggaaatggggaatgggagagagaatctttcggagccacaacgtgctgatggatggtcggatggaaccgagatggcgagatcgcacggtgcatgcatacgctggtactgtgaccctgcagcaaaggatagctgcgctgtggttcactggtagtgggttatgaaaactaaggatttaatatgatatcttgtgcgtacaaaccggatttcagaacgtttacctggtagttgtctggcgatcgcatggtattgtccaatgttagtcgcatagatttcggccgtttcgtcgatctgcggttcttcgaagacgttgctgaggtcctatcagtgcgagagcaaggcaagtcatgcattacaaatgatcatgatgtactcaatttacaaatgttccgttttctattaaatgttatattattttacaatatcatatgggatgggtcctattactcagccatatgttgttcaccttatgccattgataatttgggtattaatcggataagatgttggtttagaaaatgcttagccatgcttagatccactagctcacataattagataattatattattagacatttagcttcatgacgagctgcgtgctcgagacatccggccatgtttcattggccgtaattatccaattaaaatgcgattgaatggtgggctgtggatgcatggctttgctggtcgcacccatggcaattaaggaccggttcacgggaaaccctaggagacttatcgtgcttattaccataagcgggagtgggtaactgtttgacttgtaatatagctcgaccctttcctaggcaccggtggcaagggagggcatgatggagttaggtcggctgggtgtccggttgtccaactgctgggttcaccgcggcgcacgagggggctgcccactgcctgttgaggggtgggggtgaaaccttagcgtggtgtggatggttagaggagggttatgcaaagggtcttgtcatgattccaccatttgcagtgccatggtggtactttggggcatgacgacatgtgtggaatcatgtcttatgggtacagttgtacacctctggccagagtaaaactattcgaatagccgtgcccgcggttatgggcgatcaaccagattcaccgtgactagtctcatccttaataattggcttaatggactggtgtagttcaggtggttggttgggcctgttgcaatgtggtgtagtgttggactgtgatgatcagtattgcttaatttactacaacagttttactgctttcaactactgcttttaaatgcctgctttatgcaaatgagcctttagccttctttggatatatcttgcatcgtgccttctctcccggtatgacttgctgagtacagtgggtagtactcagtcttgctctctcttccccacaccagagctagagtccttctcagttggagccttctcagagaagttggtatcgtcactgccgtcaaggattgcctgtagagtggagtcgacccgttgcaggagtcaagctttcaagtttatctcgcctttatcttttccgctgcatttataatcttttatatttttgtaagtcgtggatctgtacgtcaaaaattatcgtttgtgtaccctggttggtcctggaaaggggttttaatgcacatttagcttaaaaattctggttcatgaatttctagacgtgacacactactacaaaatatcaaataggtgttgccactataggtgccggtagtgctaaaaccggcacctataggccttttcccacctttgcgggttgaaatcgtaaaaaaccggctcctttaactaagtataggtgtcggttctaaataaaaactgacacctattatattttgtgttggttttttaaaaacgacacctatagtatattataggtgccggttaattaaaaaccgacacctataatatattataggtgccgttttttttttaaaacaccgacacctgtagaaatcgagccgagccagcatcggatgagccgaccgatgggccccaccatgacgatcttctctctctctccctcccttctctcccgagcgctgccagctgctggccggcggaggcggcagcggcgaccgcgcctttccctccgctagatccggtgagagggctgacggcggcggctggaggggaagtggcagcggggagctggaggggagcccgcggcggcccgactgctggaggggagcccactgcggcccggctgctggaggggagcccgcggcggcccggccgccagagggaaggcggcggcgacgccctcccctccaatagatccagcgggaggggaggtagcgcctccgctccgctagatctggccaggagtggagtcggtgacggctcggcggcaggaggggcagcagtagtaagtggcgtggctcacgggccgcggcggcggcaacctcccctccgctatatccggcgggaggggaggcagcggcggcagcggagccctctccgccaccagatccggtagggggcaggcagcggcaacgacgacatcgggctccccacgggctcccttgtctcttctgccacaggtgagcacccccaatcgtctccttcattgttgatgtttgatttgatgatccaatgatgtttgatgtttgattcagtgatgtaaacttgttgatgaatatttgattgtgtgatgcatgaatgttgccaaattttgtgattgtgtgatgtgttcattcttttcttgcggatgtggttggagggactgctcggctcgatcgagctgacgcatcgagccggcttttttttttattcggcaaacctaaaaggtgccggttctacacaaattttgatgatttgaccctttgcaaaaaataattttacaaacgaaccatggccaaaacttatttcagaaatgacccttttgttcagggtcaaatcgtatggcgctaaacttagacaccttaacaccacgtcaactggcgctaaatgccgtgccactgcggatgggaggctgagtcggtgtgccaacgtacattcagtgtcggttggtaatactaaccaggactaaagatcccaggcggcctaatatcctctgacatgaggtgaaccgcgactaaatatcatatagttccgttgcacttataaaccgggaataaaagtgctttttagtcgtcctggtttattaaaaaatcggggctatcgtgggatttggccgacaccgacaaaggtggtttctgcagtggtgccggttcaacaacgtacgtacgtacgccaattacaaactcttgtcgtgctgtgtttgtatatatcttgccatttgtttattaacacgttttctatctgtcctcgcaaattatctctgctgaagtaaaaccagatcaatgatcactgaccaaatgctgtactagaaagatcaataattggataacttcgaaaggtttggcacgcatgctgcgatttggtggttcatcgcatgtttgcagttgcagggctaacttacggcagcgtacgaccgctaaaaaatcaaacacgtgaagagaaaaacaaaggaaagttgtgtaaaatgcatgcaatcgtactgcaggttaagtactatgtgctaattacgactagaatttaatttcaaaccccacaaaaaaaatgagacgtaacgtacgtaaccggcttgagaccacaaaaattaatgtttctatgccgaattaactaaattgggcaacatattctaatcactcccttcgtcaaattttaagcgcagtcataagtttcgatgtcaactttgatcgcccgtcttattttaaactattttatgattaatacttttattattattagatcataaaacatgaatattactttatgtgtgacttaaagtgtctcatttttttaaaacaattttaaataatacaaacgattaaaattagatacgaaaactacttcaaatgggacggagagggagtattatccttgcatagctagctagctagcagaagtagtatgtccattaattgctctatatatataggctgggtggcagggtggttaacttaacttgctataagcattaattagcagagctatctagatcatatactcgaccgatattatggctcaccgcttagcgtgtgctttcaccatttcgcagccaccgccgcctgcatctgcctgcgtgcggatgaacaccaccagcactaccgcggcagctggaaataacaacatcgcgtgcattaagcatcgcagcagcagcaagcgtgtggtgtcttgtcatgcagcaccgtcatctgccccggctgctgcccaggctcccagtttcaagccctccgtgtggggtgattttttcgtccattatgaacctcggccaacgcaggaaagtttatattatctataccgtatgtgtgtgtgtgtgaatttttctcaaccacaaacaacgtactgcttaaatatttatagataattgtcatgcattgagtcggttaagttttatggaggttaataattactacctctgtcgaaacaagaattcggcaaataataaaagagaatagcgcacgagacctaaaagtggatagatacggagacaaggttttagacagattcaggctctcttgatgagaggtaatatcctactcttgttggaggatttgaatccgccgggtgtatattgatctgacgatctggttgtgtcacatgccctctagagggccttctgctcaccttatataagatgggggcaggattacaagatagaaaccttaaccaatacagtatcggtttcctaaatctactttacaatattatcaaatcaggactttagaccgttccataatatacaaggaaacgtaatacccaaaccatgatccgttacatatttcatagatataagttatcccctataaccagtcggataaccatgtcgtatgtgtacggggtacccataatctccacagtagcccctgagacctttacagtcgaaaaaataatcttctctcaaactagattactccaaagccgagtgcttcaatcatctttgccaagatctcccgagtacttttatcaaatctgaagactgtggagggctgagaaataattaaatgtaatcttaggtgcatcgactagatgcacctaataggtgtagcccccgattatgtggttagttgaacaaactgaacatatagtcaaggagtaaataatgcaaccaactgagtggtttttgataattatagtcaaccaagtggcttgatattaatatatagcatatgcagtgtgaatctccgaataacatgatccaagtgatataccgactgctttgtaaaatatgatgcgtgcaacctaaagttgacttcatcattgaagattcaaatagcagaacagctataaagaagcttgtatgttgtgaataaagaaatttccagagtatcgggcacacacaccatgcgcacactgctttaacagatgtacttaagaacttaaaagacacatggttttaccactggaaatgtatggcacatgtgatgaaaaatccgactaaataaactcataaaggatttaccaaccgcctggaaaatgacgtaccataatatataatcagcctaagccataatattggtcaataaaaatgcacacttacatggcaaaaaaaacaacgatattgtatccaatcaattgctttataaaaccaaacagtgccttgactaataaaaagtcaacggggcagctatataaagcttcactgttcgacaccttttaaaatgcattgtaccaactcctaaaaagttgagtaactgcggtataaaaggattttaaggtattgggcacttaatctcccgcacctttgcctaagcaaaaaaaaatgcctaagtccctaaaagaacgtgacaggccacacctgaaaatatgagctgcagacgtattaggcctagacctaaattatgtataccgatacccttaaaatatgacgtatagaacacaccaattaatatgactccaagtgatgaatatcatgcatgatgtagatcaagcgtaattatccctcataaagaataccaaagtagatgtgataattgaatcccgactggcgcaaacactcagctgatgtccctcgtggggaataatgaattgtccagtcgtttgagcatgagaaatcgactcatgaccatgaatccatgttgaatgtatctggaacaagtccaaattgaagatataatcctcgcgcttgtgttgatcgcccctaagcatgtagcttattcttctgttgtagtcacaattgtccattgatggtagttgacgcagtcagtatggagacgaaatgaccaacatgaacatgatatcacccatcaaagctgacaaagatgatggtggtggtaaagataatgacaccaatcaaaggtgatgaagtcacatagccatggaggcgaagaaactagttggcagcagtcatgtcagccagtagtgaagacgaaggcgcccagcaacggcgatagagttgtgcagccatggcagcgaaataatcagtcgataacagacgaggcgcccggtgaagaagacgaagatgcccatcagtagaggcataataagccagccgtgaaagcgaagaaaccatgggcggcggtggacgcaagccggtggtgaagacgtagacgctcatcaatagcaatagcgaaatccatcaatcatgcaaaagaagaaaacaattggcgatggcaaatgcaatcggcgataatgaccattggcagcaataaagatagccagctatgatgacgaagttgaccatcaacagtagcagagtaggcataggcaaagaggcaaggtaggatgttgatgaagttgatgatatcgttgatccagtgaatagtagtgtagcagtcaatgataacaatgaggtgtcccatcgacagttgcatagtaggccaaccatgaagacgaaataacaagtcggcgatgaaagtctatgatgataaaagcaaccgacgacgaggacgtagtcaccccttagcaagacgccagggccgatgaagtagaggtgctgatgatgatgtcagtgataataatccatcaaactgttgagaagaaaaccatgctcaagtattttcttaatgttggcatgtgcgtgacgaagattgatgcaacgcctcttgatttataaaggtagcagtaaaaattagtgttgtagctattgcagatgcttcacttggaagaaagtagaaactgttgtccaactcgttgaaactgagctgattggtcgataactccaaactccctgacaggtcatgtagattaaatcttggacttgatacttgagaaactttggagaagccaaaattgccagtgaaataattggagttgctgaagtggaaagcctgctctggagcaaaacttttgattcccgaagtagattgcatagaactcgttggctgattagtcgattgttttgtcttgacataaaatttgtcgaattttgaaagtcttgtatttgtgtagcccccgactctttgattagttgggaaacaactgaacatagagtcgagaactgtagcttcttgtcgtcgagtagtcattgcttgagtgaagatgcatgttgaagatgtccgagtagaaatattgaagattaaaacaccacttgttgtaataaaataacacggcatcatatttggtgatgcatgccaagatgtcgaagctcctgtagatgtcgtggatggtgaagtagcaaagcttgcgaagtagaggcaatagagtttgccggtgccgaagataataaagatgaagtcgctccaccatggtgacaaagttgcatagccgtgatgaagtgaatacaagtcggcggtaagataagcaaaccggtagtgaagacgcgtagttgtgaagataaaaacaccagtcgacggcggcataaccagtcggcgatggaagaagtagaatgatgacgaaaacgaagacgtccttgaatggcggcaaaataggccagccatgaaagggaagacaccatgggcggcggcgaaggcaaaccggcgatgacgatgacgctagtcaatggtgacgaagacgtgcaaccgtggaggcgaacaagctagtcggcgtcagataaggcggccagcaaagaagacgatgacgtccatcagttatggtagcggtataaaccagccgtagaggcgagggcactagtcagcagcagatgagacgaccggcggtgaagacgataaggccaatcaacactggcagaatcatgcagccatttaagtgaagaaactcgtcggcagaagaaatagatagcttgtgttgaagatgatcacgcctattagcggtggcggcgacgtggccagccgtgaagacgatagcaccagttggcatcatacgaggcggccggtcggtgaagatgtaaacgtccaacaacggtggcatgataggccaggcgtgcaggcagagacgccagtcggtggcgacaaaggcaagccaatggtgaagacatagacacccaacaacagtggtgtgaccaaccaaccgtgaaggcgagcacaccagccggcggtggcgaaggcaaaccggtggtgaagacgtagacacccaacaacggcggcataataggccagccgtgcaggcgaagacaccagtcggcggcggcgaaggcaagccagtggtgaagacgtagacgcttaataacggtggtgtgaccaaccaatcgtataggcgaaaacaccagtcggcgacggacgaggcggccggtcggtgaaggcgtggacgcccaacaacggcggcataataggccagccctgtaggcagagacactagtcggcgatggagaaggcaagccggcggtgaagaagtagacgctcaacaacagtggtgtgaccaaccaaccgtataggcgaagacaccagtcagcggccggtcagtgaagacaacgacgcccaacaatggcggtgtgaccacccaaccgtataggtgaggacaccagtcggcggcgacgacggcaagccggtggtgattctgactgatccattcctagagcgtaggagataagcttaaagccatgaatcccttttatgtatatctggatctggatcctacagaacaaacatataggatgagtagtatctgatgtaaatataatactcgagaaaaattcaagaattttaaaatgtttaaaattcaagaattttaaaatgtttataaatatgtatttcttctcttgtcaattttgatctccccgaaccgatgactccttacgtttaaacactttgcccgactagtcattgctcccacgcatcgggagtcggcggaggcacttcccagacatgcaaatgagtgacatgagttcgtcattaatggaacaaagtttcacggatcagaatttactacttggatacttttgcaattgttaagaccagaaaataaattatcttatctctatgcttttgatttcttccgattaatacttagcaccttgcgttacttcgtccatccaacgagccccgggtgctaggaatcggtccaaaggcaactatccatcgacaaacaaaacggaaagcatagggaaaaagagctccataactcgataggcactttattttactcagattatgtcgcaagcaatcaagatagatatatgaaaattgtagaaaaaatatgatataacatctttagcccccgactcactagtcaaggcgaaccagttgatgtagtgaggcagaggaaaaggaaaatacatataaagaatagaactaacaaagacttagctttttagtattcccgctggtgacggcggaggtagtcgatgtgagaacaaagtcgtccatcaatggcaatgaaagcaccaaccgtgtaagcggctgaggcaaccagcgatgtaggtaaataaatgcccatcaacggtggtgtgaccaaccaactgtgtaggcgaggacaccagtcgacggcggcgaaggcaagctggtggtgaagtcgtagacgcccaacaacggcagtataataggccaaccgtataggtggagataccaatcggcggcaacgaaggcaagccggttgcagaagacgtggacgcccatggacgatggtgtgaccaaccaaccgtataggcgaggacaccagtcggcggtgatagaggcaggccggcgatgaagtcatagacgcccaacaacggcggcataatacgccagccgtgtagacggagacaccagtcggcggcagcgaaggcaagccggtcggtgaagacgtgaacgcccatgaacggtggtgtgaccaaccaaccgtatagacgaggacaccagtcggcggcgacggaggcaggccggcggtgaagtcgtagacgcccaacaacgacggcataataggccagccatgtagatggagacagcagtcggtggcggcgaaggcaagccggtcggtgaagacgtggacgcccatgaatggcggtgtgaccaaccaaccgtataggcaaacacaccagttgacaccggacgagatggccggtcggtgaagatgatgacacctatcaacggtggtgtgaccattcaaccgtgatggcgagaacaccaatcggttacggacgaggcgagccggtggtgacgatgaggacacccatcaatagcgatggtggcagcacacagcccttgacaaattcatgcaaaaatcctgacggcatggatgatcatgtgtgttgatccatacatgctactgtgaatcccacgtaggtgatacatgtgcatgacagtaggttaacgaccatctcgcctagccacggatgaccgattgatcttgattgtcgtatacttacatgccaaagaaagcaataagtagaataatcttgtcaaaaagacaagagcatataaaatataactcagatgagaatataaaattaatgagaaaataaagcgacttagctattcggaatagttcgtagtatccagctcatgcatcgttgcacgattatattattactcttgtagcatatcaaccaatgcatgcatatttgtttgagcgctcctgttgctcggtgatgacttcttggcgagtatgcatacatgtacatgcacgagccatacatgcatacgggacagtgcaacacttcaagataattgctcaatcaattgggtcggctgattccacgtcgactccgattcaagcaaacacgctaaaaattggatatcgccaggagttttgatgttgatgagaaaagacgccgattcttgggaatggatctgttgcttgatagtttgatctcgccagacaaattaaactggatgctgatcgctgcagtgctcttcatggaaactgatcaaggaaagaactcggcagcgagagagattgcattcatcgaacccgtcgggattgatcttcccggcctaaagcaacgatgaggccgacaacttctgagatttgttccatcgcactcgtcgacggtaaactcgacgcacccccacctggcgcgccaactgccgaaacaagaattcggcaataataaaaggggtagcgcacgagacctaaaagtggatggatgcggagacaagcatttagacaggttcaagccctctcgatgagaggtaataccctactcctgtttggggatttgaatccgctgggtgtatattgatctgatgaactgtttatgtcacatgcactctagagggcctcctgtccaccttatataagatggggggcaagattacaagatagaaaccttaaccaatacggtatcggtttcctaaatctactttacaatattatcaaaccaggactttaggccattccataatatacaagaaaacataatacccaagtcatgatccgttacatatttcatagatataagttatctcctataaccagtcggataaccatgccgtatgtgtatggggtacccataatctccacagtacccctgagacctttactgttgaaaagataatcttctctcaaactagattactccaaagccgagtgcttcaatcatctccgccaagatctcccaagtacttttaccaaatctgaagactgtggagggctgagaaataattaaatgtaatcttaggtgcatcgattagatgcacctaataggtgtagcccccgactatgtggttagttgaacaaactgaacatatatttaaggagtaaataatccaaccaactgagtggttttcgataattatagtcaaccaagtgacttgatattaatatatggcatatgtagtgtgaatccccgaataacatgatacaagtgatataccgactgctttgtaaaatatgatgcgtgcaagctaaagttgacttcatcattgaagattcacatagcagaacagctataaagaagcttgtatgttgtgaataaagaaatttccaaagtatcgggcacacaccatacgcacactgctttaaaagatgtgcttaagtccctaaaagacacatggttttaccacacctggaaatgtatggcacatgtggtgaaaaatccgagtaaataaactcataaaggatttaccaaccgcctggaaaatgaccataatatataatcagcctaagccataatattggttaataaaaatacacacttacgtggcgaaaaaccaacgatattgtatccaatcaattgctttataaaaccaaacaatgccttgactatataaaaagtcagcggggtagctatataaagcttcactgttcggcaccttttaaaatgcattgtaccaacttctaaaaagttgagtaactgcggtataaaaggattttaaggtattgggcacttaatcacgcgcacttttgcctaagcaaaaaaatgccttagtccctaaaaaaacgtgacaggccacacctgaaaatatgggctgcagacatattaggcctagacctaaaatatatctaccgatacccttaaaatatgacgtatagaacacaccaattaatatgatcccaagtgataaatatcctgggtgatgtagatcgcgtaattatccctcatgaagaataccaaagtagatgtgataattgaatcccgactagtgcaagcactcagctgatgtccctcgtggggaataatgaatagtctaatcgtttgagcatgagaaatcgactcatgaccatgaatccatgttgaatgtatctggaacaagtccaaattgaagatataatcctcgcgcttgtgttgatgtgcccctaagcatgtagcttatccttctattgtagtcacaattgtccattgatgttagctgacgcagtcggcatggagacgaaatgaccaacatgaagatggtcagggttatggataccacatgcctaattgtagttgactaaatctcggtaggacccaccacataccatgtcttatatagaaataaccttcgaatataggaggagttctgcagaaggaaggatgaatagagttctacatggaaacgacaaggactactcggattgtatccatattgttttccctagttctacttggacaaggagacacctatgggtataaatacaaggccctctaggaggagaggggacacgaaacaatagatcaagacacaagatcaacatacaagccaacatgcgccaagacaagacgccggatatcgatttcagacataagcatggctagtcccctacaatgtctacggatatagtctggagagacatagcgctgtctttgatctcgccagatgcggattcgaggaggaacgctaccctgttgtcgactacgagtcagcacttcagaccgccaagtcgacaacagttagataggctaccccaaatattgtactggtgtattatggtgaataagagcaacgaccggcttcggccaacaggagtagggttattatctgacaattcagtggcccgaacctgtataaaaatcctcgtccccatcttttttaccttaatctcgcatataccctggtaccaacgatccccatactatccaaataccctagtcgcggtaccacgcgtcgacagtggcgcgctaggtagggggtcttggtgcttcaaggttacgacgagatgggtttaagagatgaattctccaacaacaagctactcgacgacttcggttgtggggagatctaacccaaccggagtatgtcttccaacaagatcggagctatcgccgtcaataatttgacctatggagatcaacaaaattcaagatgccgacgccgcagagaagcaatgatgatgtgcttgtggtcatcggggagccgtgcgcggagccttaaccatgcatgttttcatctgggttaatgcaaacataccaggccagcaatctcttcgaccaatcggataaaagcatatcccaatgcccgatcacaaagtatgtgacgtggtatcagttcatgagtagagccatccgactacgcatgttagtttcatgggagttggattctgctacgtttgcctggtcctgtccgtccattgttaccaacagaccccggcaagactaccagcaagcccagatgcattgatgcattggtactccccaactagcaggcgttccgagacatggacagaggcaatacacgaggccacaatggagttctactgatacagctgtccaccaagccaccatataaatacataggtatttactaaattgattttttaaattaatttactaattccgtagatatatccggcatatatctaaaaaggtacgcaatattttatttacattttatcgtacctattttcgagatcatacaatattatcagatcaataatttattatgtttacctagaacatgttctttatacaatatctattatgtgggcattccctatattaggccgactacggtttaatgctgggggctcattctattttcttctgtataaatcatgcttttttacggtttacataatgtctaatatttaatctgctcgttataccctgataatactagaagattcatgcagtcttttgagtacatactcgatattttttgctatatatcttgtcttctagacaatatttttcaggaacaattgagcactcgagtagtttgtggtcgagcacaccccattatcgagaacgttctcgacaaatgcagagttgtcgcacccaacctaccaacgaagaccaatgatctatctcatagcaccggctatggctgggctatttgagaaaagggttgttaacggataattgctcgcgaacgatgtcggcttgatcacccgacatgattgcggacggacatccggatatgctacaagttgggtatgtgagtcatgctggccacatgagatgcacatgtaataaaccaactctagtgcccccattggtgttcgagagataattctactcgctggttctcgaaccagtaaatcatagcaatctctcgcaccttaacttcagatggtcgaggtacgactacggcaatagcgtagcggtcctcgcaccacgacttcagatggtcgaggtacgactatgagtggtcttcgaccagtagcgtagtggtcctcgcaccacttcaattggtcgagaaataaggctactcctggttctcagaccagtaggccgtagcgatctctcgtacctcgacatcaatcggcaaacggatgaggctactcctggttctcggaccagtaggctgtagcgatctctcgcacctctacttctagtggtcgagttaaggctacacctggttttcgaccagctatgtagggatactcccactagctttacttctcgtggtcgagttaaggctacacctagtttccgaccaagcggtgtagcgatactcccactagctttacttctcgtggtcgagttaaggctacatctggttttcgaccaagcggtgtagcgatactcccactagctttacttctcgtggtcgagttaaggctacacctggttctccaccagcggtgtagcaattcctcccactacatcgacttctagtggttgagttacaactactacatggtcctcgaccagtggtatagcgattctcccactacctttacttcaagtggtcgagttggggctacaactggttttcaaccagcggtgtagcgatcctcccattacctctactccaacaaagttgatatcaggtacacaatatcgccaagtgttttacccagagatcccttaccacgacaacacctagagttgaaaccaatcctactgtccctttacgccgccctagcaaggactccgaggaacctaagggaacttcgactggggacgcccagagcggataaggccttgtcaggtaatgcagagacgaatgaccatgtaagatctggtcatgtaagagttctcaccgtgcgtattaaccaagccattaatcggaaattgggttttccaacttcacggctgggggctagggtaagcgctttttcaaccaaggccggtcaagggtccaagagccttatccttcgagaacttatctctgatgacaaggctgggggctagggagagtgtatgactcaacaaactgacttatcgaagtcggtaaaagagaagacgctcatatacaaaacattggtctgtaaatttaattcattttcagttttccatacatattataacatgtcaccctttgagcgttcactcgggggctatttctatctaatattcttttctaagaattgatttcaggaaaattctattcgacattgtcaaagactccatgtctctatggttctataccaagatcgactaaggcgagtacgacaaatgttgacaaggctccgtcgcagactctgccccttctcgattgttgacggtcgttatcgatcagtttcgaccgttaatattaccaaaatagaggagaactagtgatgcttgcaatgcatatgtttgttagaataataatattccactagtattaggtatactaaccttttgcagagaatgacaataaagtggaggagaatcgacatcaactcaaacgataaatcaatcggacgatgtcgaaaaccagacttatgtatgaatgggccaagaactcagaattgacacaacaaattgggccaaaattcacaagtctgcggagaagaacaacggagaaggccaccagccgaaattgggctggatcgggccagcaccaggttcggccgaacctggtggttcggccgacccttcctcgcctctgttggatccaggttttggctggacggttgagatgaagccccaatgacggttggagggtattaccgaccattccaaccgtcacaaccgtcatagttcagctataaaaggacttcaccttctcacttcactcacacacctcaagcaatagctctctcatttctctcaagtttagtttagtagtatctagctggtggaataggaatagagtagaaatcaggagtccggaagccttcggaagaattcgggtatggctctagtagcttttcttttctcttttgtaagatttgtacttttattagaatactcttctaaatacatttatggtattgaaatactttccaagtatatgagtacctactttacattatgttcatgttatactgaatatatggctagcttatctgggagatgctttggtgtgggtataatgtttgcttatgcaattactctatgtcatgactatgatattagagtagtatctggtagtttagacgtggtgtctagattacgggatatcattatttagggttatatattgcggatgagaggtgggccgctgatggtgacagctctgtacggatattcctccacgccggtttataatccaaagttaattccctggggagggtattcctccatatttagccccggttgtatggtcatgacgggctgtcgtaagtaactcggcagtcaggggtggcttctcgaagtactaggagggcatcggatagagggtattagctagtatatcagttaactagaatgtatgtatactatgtatattagaagtataggaatagattttctttctcttttctttccacttaactcagataatatattatgagaatgagtagtaatgcttgtgtgtcactctaccctttgattatcttaacccctgcttagaatataaatatcacaagtaatatataaattattaattgagttctctctacatgatcttcccacgggataaaataaatacaatacccttggaatactctcgggtgaaatgctacaatggtatatccgtgcgcttgcggataaactctgtgaccataatatacctggagtatttctacgtcattgctgagaattatatttctagtaacgtcgttaagaaataccaacatcgatcactcgagaatggttggtggatctcgacaaggaatacggaatgaagagatggtgtatccgccgagataaaatttcttgacttcaatccaaattctcgattacagcaagacgggagacttagtcgtatgctctgtacattcctagttgacgtcagagattgactcagacaaaccctatacggtgcccgcacaaggatgataagggaagtctaacgttatctctgaactcaccgagaaaggtcacgtgagatcgataacagttattccgaggtcttcggatggagaatatgaactcattcatttgcattgaagtcgagggctactgtcagggttatggataccacatacctaatattagttgactaaatctcaataagacccaccacataccatgtcttatacggaaacaactttcggatataggaggagtttcgcataaggaaggatgaatagagttctacatggaaacgacaaggactactcggattgtatccatattggtttccctagttctacttcgacaaggggacacctatgggtataaatacaaggccccctaggaggagaggggacacggaacaatagatcaagacacaagatcaacatacaagcaaacatgcgccaagacaagacggcggatatcgatttcagagataagcatggctagtcccctacggtgtctacggatactgtcaggagagacatagcgttatctttgatctcgtcggatgcagattcgaggaggaaggctaccctgttgtcgactacgagtcagcacttcagaccgccaagtcgacaacagttagataggctaccccaaatattgtactagtgtgattatagtgaataagagcaacgaccgacttcggccaacaggagtagggttattacctgacaattcaggggcccgaacctgtataaaaatcctcgtccccatgttttttaccttaatctcgcatataccctggtaccaacgatccccaaactatccaaataccctagtcgcggtaccacccgtcgacaaagatgatatcacccatcaaagctgacaatgatgttggtggtggtaaagacaatgacaccaatcaaaggtgatgaagtcacattgccatggagacgaagaaaccagttggcaacagtcaagtcagccagcagtgaagacgaaggcgcccagcaacggcgacagagttatgcagccatggcagtgaaataaacagtagataacagacgaggtgcccggtgaagaagacgaagacgcccatcagtagaggcataataagccagcggtgaaagcgatgacaccatgggcggtggcagaggcaagccggtggtgaagacgtagacgctcatcaatagcaatggcgaaatccatcaatcatgcaaaagaagaaaacaattggcgatggcaaatgcaatcggcgataatgacaattggcggcaaccaagatagccggctgtgatgacgaagttgaccatcaacagcagcagagtaggcataggcaaataggcatggtaggatgttgatgaagatgatcatatcattgattcagtcaatagcagtgtagcagtcaatgataacgatgaggtctcccatcggcagttgcgtagtaggccaaccatgaagacgaaataacaagtcagcgatgaaagtctatgatgacaaaagcaaccgacagcgaggatgtagtcaccccttagcaacggcggagacgtcagggccgatgaagtaggggtgctggtgatgatgtcagtgacaataatccatcaaactgttgagaagaaatgcataatctccacaacctccgttaaggttataaaaactttctagcattgcccacattagtatagatgttaatgaatcgaggcacacatatatgtctagattcattaatatctatatgaatgtgggcaaaactagaaagtcttataatatgaaacggaggaagtaaccaattaccattgaataggtagtaatctagattactacctatatacatatatactatctccgtcctaaaatataacaacttttagctatgaatatagatacacagttgtccagattcatagccaaaaatgcttatattttgggatggagggagtactcacttgactagagaacattttcattttttgtattgtaggcaaatcagcaaaagactcattttttctcgttcaataattttaatatttgctttaatataaattagtatgctttaaacataaaaatggtgtgtacgtatatatatatacatttatcttgtgtacgtgatgtacatacacaatacacaccattcttattttttgttataaaagtttaaaaaatctttcaaatgtatacaccatttgtatgtttcaaatgcatttatatattacaaatgaatgcataaatgttctaaacttttctaataaatttgtcatacataaatgcaaattactctcgtaaaattgaatcattttttaaacttctctaataaatatattgtgatcaaagtagcatctcgtggttaacactacgaaaaatgtgtggcatgttccattttatcggtgtgcaagatattaccaatttcatcattttcgaaaacaatgaagcgctaattaacagataagatggcatggaacagaattttaggaacatgttatgacctaaatgaaacagagatgagtataacaatacgttgagtatcatacataagagctctgtatggcaaattaattaacttacacaactgaaatatatttttcaatgtaaacttatcctattgcatgcaatattaaccattagagtaatttgcatctagattacatgaacttgattggtggatatgatgcgatccagtgaaaactttaaaaattagcatattggtcagcaactgagctagcacgaacatttaggatcgatatgtcacacataagagtcttttagccatggaagcacgccatgtcgacgaaggtctgcagcttttgcttttgattggtagtgttcatcattgcaacgaggctagcatgtgcaaggaaagaaagcacagcgtgctacactcctgcataacaatatattaaattttatcgtatcgacaatgcagttttctcatgattcattgattcatatctccagtccagttgcctaagtcatgattcacaacttactattgttttaagactcagaacatgcaaactaacataatttccaagtaattcaactcctcaaagatatcttaagaatgaacactgcaaaatacaaacaatctagctgatatgtttagaatatagaaaaagaaaacagaatgaatcgtcggtaacattatttttgacaaacgcgcgtgattgccaagtccatgtactagcatgcttatttttcaagttgttgtactatatgacaactgcctgctaagttcttgtacgagaatacaatttactctaattgttatgtttcccttgttcatatattgcatctaaactattgttactgcttttgatgaatcttcaagtctatctttttttttgtcctgcaatccaaactaacaaatcaatacacattcatgcagcaatcggcggaatggatgagggagaggaccaacaaattgaaagaggaggtatgcacactatttacaccctctaaggacatgttaagaaggatgtacttagtggatgaaatagtgcatctgggaatcgatcacctctttgaaaaagagattgaaactgcactaaaagacatccatgaaagcgaattcgctagctctaacctccacgaggttgctcttcggtttcgtttgctcagggagcgtggtttttgggtatctccaggtatttctctacttagttaatggattgagtatagttgttttggaactgttgattacaatcacaaggaccatatatataaaaatgttcaaattaaagagattgagcataacatgccaagctaaatgttggaacttcacaaacacttttatatcaaatctcacatgcagatgtattccagaaattcaagggagatgatggtaatttcttaaatgaattagctgatgacccaaggggtctaatctcgttatacaacgcagcccatctcttcatacatggtgagcagaattcgaggaaactatttcttttgcaaggaaccatctcgaatcaatgatttgggatagtgttttgaagggccctttagctgatcaagtgaagcatgcgattcgcttgccactgccaaggactctcaagagagtggaaatgttacattatatgtttgagtatgaccaagacaatgggcacaatccggttcttcttgaactagcaaagttggatttcaacctcctgcaacatgttcacttgaaagagcttaaggaaatttctaggtactaatatgcataataactttgttattttgtataaggataatatctaaggataggtaatgacagttcatggctagctgtacaaaactcaaagaaatatgcaataaaatcaatacaaatgacaatcttttattataaattgttacaactgccaatggattcaaatatgtatatcatcgatagatcataggtagctccagaatagtcggaaagatatagaaaataatcgcactatggagagaatgtgttgcacattttatagaaatcgatctgatatgacaaatatattttttaagcattatgggatacatgtatgtaccgtgctatatatcatactgaccgcttagtaaattatgatgacaacaattaataaaggttttagtttgcaattattgtccaagctagatagattccctatatatatgttgttaattatcgtcctatttaattagttcgtcagcttaattatgtatataagaaaacttggaataactatttttcaggtggtggaaagatgtttctggatatatgggtctaaaccacatccgagaccgtgtgatcgagtgctacacctggtcctacgcagtgtaccatgaggaagaattgtcgtttgcacggatgctctttgctaagatagttgtgataattaccctattagatgacacatatgatgtctatgcgtttacctccatcgaggagtgccggacactaaacgcagccattcaagggtggggtatttctacgtctcacatcgatctcaatataatcttaatatactcattattgtatgatatttgagcatggatatgtattaactggttaacacctcgcgctagttaattaagggcatatgttctattcttcaatttaacttattcgcagtatatgttattgtgtaatggtttattccacgctagcttcaagaaacatattttctacaagaaaattcttctagtattgtattacctagaccatttgtttgaacttatttgttaagtttacatttgaaaatataatccacacagattaacttataattaataccgttctgactaatatatataatatcatgcagatgggatgacagcgctgtctcccttgtaccagaatacctgagaaagttttatgaaataatgttgagcacctttagggagtttgaggatcaaatgctaagcaataagaggtacctagttgctttcaacaaggcagaggtaaacgcataaaacctacctacctatatatatatacacacacacatattttgttgtatatttggcgtaattaatatatagtatatattggaacaatatcaattactagctagctagtactccctccgtttcaggttataagacattttaactttggtcaaagtcaaactattttaagtttgactaagtttatagacaaatataataatatttataatattaaattagtttcattaaattaataattgaatatattttcataataaatttgttttgggttgaaaatgttagtacttttcactataaacttggtcaaagttaaagcatcttgactttgaccaaagtcaaaacatcttataacctaaaactgagggagttcatttgtttcatggatagctacattccgatcgttaattaatttaatatgttctgtgcatatatgcatatgcatagttccaaaagttgtctagttattatctggaggcagcggaatggtcccaccggaattacaagccaagcttcagtgagcaggtggctctcgcgaccgagaccacaggcgcgcgattactagctgcgggtgtaatgctcggcatgagcgatgcagcaacaacaagagaggctttcgagtaggctgtcactagcaccgacgccatcatttcgtgtgcaaaaatcgggcgtttcatgaatgacatttccggatataaggtaattaatcgatcgatgcataggctcgaattgattcacctgtagtattttagttaggaagtaaatttcagaaatcaccatgcatgttttgagagtaataatgtaacatatataaccatgcaataggtttgacaaaattaatcttcactggaccatattttaccataggttcagatctaagatttcttaggattgtctgtttctagctctagaaactaaaactatatagatttcctctctgtttctatttcaaacaaaacaaaaaacatggtgtgcgtttttcctctctgaagtttacttttgttatatccctcctctaaattaattatagcctcttacatatcgcggatgcgtgcatatgaattgcttgcagctcgatcgggtcgcagaacaaagccgatatgccatgcgcggtggagacttacatcaacgagcacaaggtcacggtcgacgttgccatcgccaagataaatgagctggtggaagatgagtggaaaacaactaaccgggctcggatcgacaaccaggctgttcttccagtggcgcagcgccttatcaacttaacgatggccatcccgatgttctacggctatgacagtgatgctttcactttcggcgagcaacttcgggagattcttgagaatctctatgtcaagcccatgcccatatagaggccaaaattagttactgcatgcccaaatgggggtaatgcaaatccatctttctcataatgattatcatggtgggttgctctattttttatctatgtgcgccaaataatattactgtatttattggcgctatactcttaaaattgctagctaaatctatgtgatttagggctacttaataaataagatggagttgagggtttgttccatcatcaccgtatgtttttattcattgaacaaacctatggttgtgtgccttatagaagttaaggctacttaaaaaacccacatagggaccggccttataggtgccgattcatttaaaaccggcaaatatagcattttctcacctcagcacgatgaaaaaaagtagaaccgacacctttaagcaatatatgtgtcaattctaaagaaaaaccggcatcaatactcccggtttttaaatagaaccgacacatatacttgtattataggtgacgattcttttaaaataagtataagtgccgatttttttttaaaaaaagggcacctattagaaaactggggctcacatttttaccgagcactatcacccacactacaagagatcttatgatagctaggtgacgtttcatttgtgtcacaaagaatgaaaattgtgtcacgtttcaaactttgtgatgatcgcgtgacgaaaagtcgatcgtcacctatcatgcctctctaatcatgttttgtaacgaaaacgtatttaatttgttattaacctagaaacgatccttctttcaccattgctttatgatgctcatgttcgtcattacgaagcctagaaaatgtcacaaatcactaggcttgcagttgccatgtaggacaagaaacatcataaaattgtagtacaatgtcccatctgacatggcatgttaattgtgacgatattaatcgtgatgaaatttcttgtgggctgttatttattgttatttatggtccatgtacgaggcaatatgtttatgtgttaagcccaattataggtccaataagatattggaatgacccatataagacagctatttaaacactattttagctcataagcccattacaaaagcttgcataagcttgagatataacaaccatttaacagagtatatataagcccaattaacattcaatatagcacaagtccatttatcaaaccagtacttacaatcaaagcccattcacatatacaggtgatcactgacctcatatcagtacagaccatagcaaaataataacatgtttagtacatcttcaccaaatccagctacaattgcaaactaggtttggttttagcaattccaccatatcctagatagcaaaataaggtcctatgttaactgaccaaatgcaaccacaagaggaaactaggttcactggccaagtccacactatgtcgagccacaagtaactcaccaaaatgaatgtcgaaatcagcaaaccaaaatactccgcagcaacctgaatgtagtcctcctaggcatctgtgagacaaaaataatttgaggaattaagccccagtatgcagaatataaatttcaatttaaatggacacctatttagttgcacatcacacaactttttcagtgtcaacaaccctcttatcccctgaactttactaattttgttactaacttcaaacaaaatccatccatatatcaattatactttaatactatgcataacagtcaactttaataaagaactgctaagtactcttctgcataacaaaaccacaaaactgactttaaatcgtataacaaaatgactgctaactactatacttaaatttaccctttaatggataaaaatgctatatgccgttcatgtgaataggattaagaaaagcaacataagaagttttggattgaggaatgaattgcacaggtctcacctaggccagctccattctcatatgctctcaccatcacctattggtcagatcgacctacaaagtataagttgagaattggagaggagagaaagaacgtctagaactaaaccaaacccatgaataaattaattatatcttttatttttaacattaacaagcatcatattgtgatgaaatattcctcaaggaagtaatgaaataagtttttacaagttgttgcagtcagactttaaagttgatttggctatttcattcataatattgcaaccagtctatggggaaaagcactgttaattcttgtcaatgataaacgaaaatggattccgcatacgaaccaaacatttatgattgatggttgtcggcatacacacataagttgaaagttcagtttagtacttgtatggaccaccactagaatggataccctcatctcaatcggacggtaagccccatctcaatcgggcatggcgtccgtcacaggctagaagtcactgatgtgaagagttatctcaatcggacaaacggccatcacggatgattctatctcaatcgggccctaagtaaagcccgtcaccgataactttgatccagacga

SEQ ID NO: 18075 - DNA, 3550 bp, Oryza sativa
gcccgtcacagatgagtataatccaaaaataaaaattttattttttggctagccctcactcgtgtgcacccacgcgggaacttcctgatcggtcacccattctgaaattgctccagaccaagcacgcttgacatcaaagttctttgaagattggcttccgaaaaagtagttgtaacatgttggtatgagtattctattaatcctattatgccctaggccaagatatcaaattagggttactaaatgatttcaaatggaaaagtcaccaaaaccaaagttgtagaactcatcgaggtgcaaaatttttattttggtcatttctccatttgactctatttaaacaatttgaaatttgaaattcaaagtttgaaaagttcaaatagaattttagatcagtgaacgacttcaactgaaaaagtcatcaacaacaaagttatataactcataaaaatctataacttttattttggtcatttttctatataacattttttgagtttaaatttgaatttgaaaatatgacaacttcaaacaacattttcgaatactaaatgatatcaactgaaaaagtcatcaaaaacaaagttgaataactcatcaagatctacaacttttattttggtcatttcttcatacgacaaagtgatagtaacattgttcacaaaattgacatatctcttatctggttttataaactataacacatatatgtaaaatttatgaataatattactaacatttcatcggatgaataaataacaaaaataaaagttttagatcttgatgagttattcaactttgttgttgatgacattttcaattgaaatcatttagtatttgaaaatgttgtttgaagttgtcatatttttaaattcaaatttaaactgttcaaaaaaatgttacttgttgcatacacggtcggatttgtcctatgctgtgggtgtagtgagcaggttcatcgagcatcggactgtgatgcatttcaaggcgatgaagaaaattctcaggtacctcaagggtacaatcaactgttggctcacgtttgctggtggtaaaggtgcagtggagatcatcggattcacagatagtgatctggctggtgacagtgatgatcgtcggagtactagcgatatggcattttatctcaacaatagtctgatttcgtgttcacaaaagcagaaaacggtggcactttcgtcctgtgaggctgaggcagccactgcagcagcttgtcacgctttgtggctcaggggattgatgattgagatgattggtgcagacgctaggccggtgaagttgtatgttgataacaaatcagcaattgcactcatgaaaaatcctgtgtttcatgggagaagtaagcacatagacacccgctaccatttcattcgggagtgtgttgaaagtgggaagatttagattgagttcgtccggactgaggagcagtgggcggatgtgttaactgggttgccaacagcgagattggcgacagcacggcacctgctaggtgttcgtgattttgggtcatagcagaattaagggggaatttgttgactgttatttcagctatggccccaaggtgttccagactgtggcagttgcaacggctggatgaataattcaggtttgagtttgttatgcgtgcacgagagatgtggtgcgctgcaggagtcgacgaccgcgtcaggcgtgcgttgtgggcgtgagttttgcacggcattggatccaggagttctggatcgtgggatggcgcaattgtaggcttggattccttttttctgttattggagtataagtagcagtagctaagttttccatttgtaagtttttacaattcagttgaatggaagaaaccagaaaattaccccacaaattctctctctcccatgattctctgaaactctgaaatactctgtttatctgttctgaatttctcctagcattcttcagtcttctcgtctgttgccgtgccggacgtgtgccttgtgcgcacaaagtgttcgatcgggtgattagcagctaacactagcattatttgtccatatagataaatagaggaaagttgctgcccaaaaaaagttcatggacacgtacatcgatcatcatgtgaattagataaaaaaatatatatatggtactgattgagcaaactacgagacagatggatatatttggcattaatcattcccatgcatgcaataactaatcctatcttactgtaaagttatccccactaactccttaagcttaacattaaaagatgccacatcatcatccactaacaagatgccacatcatcatccactaattaacaagatgtcacatcatcatccactaacaatcatcacatttaaacatcatgcaaacatgctatatctttatagtttttataatttaagagtttttcaaatacaaacatgttaaattatcatccaacataattcacataatgttttaatgtatatcttcatgcaaagatgccacatcatcattcactaattaacaagatgccacatcatcatccactaacaatcatcacatttaaacatcatgcaaacatgctatatcttcatagtttttataatttaagagcttttcaaacacaaacatgttaaattatcatccaacataactcacataatgtttcaatgtatatctttatactaaattcccgcagcagtgcgcggggtttcacctagtttcagcctctataataaggacatgggcttgacatagagatcctcaagaacctcctgaagctgtttgccgaacgtgaaagcatcacagtcgttgccgtagaacaactggatgcccagcgtgatgttgatcatacgctgcaccacaggaagaacagcccggtggtcgacgcgagcctggttggttgttttccattcgtcctccaacacctcgtttatcctggcgatggcgacgtcggctgtgaccttgtgctcctcgatgtaggcctcgactgcgcatgccatgtcagctttgttctgcgacccaagctgcatatgcgcatccgtataaatgaatagtgattaataattaaacagttatatttcagaaagaaatagagaaacggccagagttctcataaggtggtacggcctgggttcgaagcctctccccttttatttatttaatattaggtccttcccttatactccctccgtcccatattataagtatttttagagtttggcacagttattaagaaagtatatataagtgaatggtggagagttattattggttgagtagtggagttaagtggaaaaattgaatggtggggggttgtgattggttagggattagtggagaagttgttatattttgggacaaatcttgagagctaaaagttgttatattttgggacggagggagtacttgcgtttttttatttcagaaacaaatacaccatgttttgaaagctatatatatttctcaataaggaccggatttgaaaatggcaagaaaaaggataattaattcaaatgctatcgacatagttaaagctctatggatttctagagctagatagcaatcaaaa

SEQ ID NO: 18076 - DNA, 27171 bp, Oryza sativa
cagcttttggaactggcatgcacacatgcaagctagtaaattaaggattcaaatgtattcacgaaacaaaactaactgcatagatagatatgtaaatatatagtacgtactactaattgatatcaattgctccaatactattcattactacaaaatatacaataaaaattagtatatatatgcagcaggttttatgctactccctctggtttaaaacactttcaaatacttcttctatcgcggacatatgtactgtattgtatatataccccataatttatctcccgaaatattgaaatagtacgatttactccctaaactacaatacagaacatttgacaccccaaactcttaaaaccggacaaattaccattgtaactctattcgatacgattttcagcctatatggcacacacgtcgcgatacagtcagaaaacaaataaaaaacaatggggcccacttgtcagcgtctcttttttttccctccttctcagcctctctctctcggtgagcagaggagagagcaccggtggccagggccaatccaacagggagggggaggaaggggctccacgagctcggctagctattgctgctgccgccggcgctctaccaatggcaacctatgcggatccgtctccgtggagctcgtcatgggcatgaggccaccccgacgactccatcttccttgacctcagcaaggggattgctttgattcgatgctgccatggagttggatgccgccccggttacatcaagctcgctgctgaccccgtcttctctgagctcaacaaaaggggatgggattcatgcctgagtggaggcaggaagaaggagaggggtggcttggtgccatggtggtggtttgccgtcgctcggagaagggggtgcttgttgccggagccacgtgcacgtggactcgcactaggcggagctcgagcttagcgaggagagttgtggagctcacaaccaagggagggaactcgaggaggaggagctcggtagtgccatggcttgagaggaggagcttgagcccactcgtcattgctgtcaggaccgtcgccttgattcccagggctctgcttcctcctatgccagcactgacctcatcgccgtcaccctcgtcccccaccggcccacggcgggctctggatctaaggcaccagctgagctacacctccgccgctggctgcctagtccgcctccgtcgtcaatagcctgatccgcattcactgtcggtcgtcgggtccgcctccgccaccagctgcccgggcgagctccaccttagttgcccactgcccaggcgaggtccgcatccgtcgccggctgcccggtccgcctcctccacccgctcgggcgtggttctcctccaccaccggccaaccgagcacgtggcaagagagagcaggggggaatgtgaagggactgggttgaggggattgagggagaagtatgacaagtgggcccagttttttttgttttgctgactgggctgccacgttggtgccacgtgtgtaatttcaagtcaaaaccattcaaaacaatagttgagggtatcgaatgtccaattttcgagttcagggtataattcggtctaccacgattgttcacggggtaattcatactttttcctaaagtatacaccaccctacgatacgtcattcatcaaattaaaatatatgattaattttgattaatcatatattgattgtttgaaggttattaattactccatctgtcctcacatccacccaaaatcccttatattatgggatggagggagtaacggtcaaagttaaaatattggtcatcaaaggtgagagtaaataaacaaggacggtctaagtttttttctgggtcagaagtaaagagggagtgagtcatacctctgccttggagaaagcagcaaggtacctctgatttcttggtatttgatcctcaaactccctaaaggtcctcaagattatttcataaaactttctcaggtactctggtacaagcaaggcagcgctgtcatcccatctggaacggtataacattattagtcagggcaggattaaataatctagcagttacgtcaggggaaatttaattaattatccaaaacttaagattaattggatgcataaaaattaatgaagtgtccaacccttgaatggctacgtttagcatccggcactcttcgatggaggtatacgcatggacatcgtatgtgtcatccaatacggaagttagcgcgactagcttagcaaagatcattcgtgcaagtgccaagtctttctcgtggtatacagcataggaccaggtgtagcactcgatcacacggtctcggatatggtctagacccatatatgccaaaacatctttccaccacctgagaaaaaaattaatactagttattactttcaggttcttaaatatatacacacaaacagttaaaggtcgtagcatagcacggtacatgtatcatataataaaagttatattaatgttcaggttattttctttttctatatagaaaacataattcatgttccgcgaaacttatgcttgtgttattagatcatttattctataaaaactgcaacacactctatacggtgcacgtaagtagtaattaaggagtatgtcttttctaaatcaactgacagttatagctatttgcagtaatggtcatcaaatcttttgttctagactatattatagattaccatttttattgattttaattattgcatatttctttcattaatttcgtacaccatgaattgtcttagcctttgattttattttattcaaaataacaaattaaagttagcattcatattagtacctagaaatttccttgagctctttcaagtgaacctgctgcagtaggttgaaatccaactttgctagttcaagaagaaccggattgtgctcattctcttggtcatactcaaacatataatgtagcatctccactctcttgtgagtccttggcagtggcaagcgaagatgccgcttcacttgatcagctaaaggggccttcaaaacactatgcgaactcattgattcgagatggttccttgcaaaagaaatagcttcctcgagttctggctcaccatgtatgaagaggtgggctgcgttgtataaagatagtaggctccttgggtcttcagcaaattcatttaagaaattaccatcatctcctttgaatttgttgaatatatctgcatgtgagatttgatataaaaatgtttgtgaagttccaaggtttagctaggcacgttattcgcaatctcttttgaacatttatatatatatggtcctcaatcgtcgtagtaatgaacagttccaaaataactatgcacaatccattaactaagtagagaaatacctggagatacccaaaacccacgctccctaagcaaacgaaaccgtagagcaacctcgtgaaggttagagctagtgaattcggtttcatgtatgtcttttaatgcagtttcaatctctttttcaaagaggtgatcgattcctagatgcactatttcatctactaagtacatcctccttaagatgtccttagtgggtgtaaatagtgtgcatacatcctctttcaatttgtcggccctatccctcatccattctgtcgattgctgcatgaatgtactgatttgttagtttggattgcaggaaaaaaaaagatagacttgaagagattcgtcaaaagcagtagcaatagtttagaagctatatatgacaaagagaaacataacaatttgagtaaattataccctcagtacaagaatatagtaggcagtggtcatctagtacaacaacttgaaaaataagcatgccggtacatggacatggcaatcacccgcgtttgtcaaagatagtgttactgatgattcattctgttttctttttctgcattctaaacatatcagctagattgttttgtattttgcagtgttcattattggagatagaagatatgtttgaggagtcgaattggttggaaattatgttagtttgcatgttctcagtcttaaaacaataagttgtgaatcacgagacttaggcaaggactggagatatgaatcatgacaaaactgcattgtcgagagacgataacatttaatatattgttatggagtgtagcactgtggtttctttccttgcacatgctagcctggatgcaacgatgaaaactagcaatcaaaagcaaaacctgcagacctttgttgagatggccagcttccatggctaaaagactcatgtgtgacatatggatcctaaatgttcacgctagctaagttgttgaccaatatgccaatttttaaggctttttctagatccaatctagatgcaaattaatctaatggttaatatttcaatagaataagtttacattgaaaaatatatttcagttgtataggttaatttgccatacagagctcttatgtataaaatatatttttatgttttaaagcatactaatttaatatttattaaagaaaatattaaaaaaattgaacgagaaaaaatgtgtattttgctgatttttctacaatacaaaaaattaaaatgttctctagtcaagtgagtacagaggtagtaaccttcatgcaggaatgcaaattcgatggtaatcggttaaaattattaacctctgtaaaacttgaaccgacactcaatgcataactcgatccatgcatgcatgacaatgatatatatttatgtagtactccctccgccccaaaatgactcgattcctgggtttccgtgtttaacatttgaccgtccgtcttatttgaaaaaattatgaaaaaaattaaaaagataagtcgtgtataaagtattgttcatgttttatcatctaacaataatgaaaacactaattataaaaaaattcatataagacggacggtcaaacgttggacacgaaaacctaagaattatctttttggacagagggagtatattgtctgtggttgagaaaatttcacacacactgaggtacggataatacagtataaactttcctgcgttggccgaggttcatggtggacgaaaaaatcaccccacaccgagggctcgaaaccgggagcctgggcagcagctggagcagacgatggtgctgcatgacaagacaccacacgcgatgatcgtaaacgcttgctgctgctgtgatgcttgctgcttgcgtttgggctgcacacgatgatagtgcttctattattcctagctgcagcagtggtggtggcgttgtgcgaaacctgcaggcacatgcaggcacatgcaggcggcggtggctgcgaaatggtgaaagcacatgctaagcggtgatccatatgcatcgatctggtgtagtagtacatatagatcgagtatatcatctagctagcttctgctaattaatgcttatagccagttaagttaaccaccctgctgccacccatcctatatatagagcaatggacatactacttctgctagctactttctccgttctaaaatataagagattttaaacggatgggatacttcctagcacaacgaatctagagagccatccgctgtgctaggaagtgtctcatccgtccaaaatctctaatattttaggacgaagggagtagctagctagccatgcaaggataatactccctctatctcattttaagtgtagttttgcagttttcgtctcaaactttgatcgtccattttatttaataaattaaaaaaacacagatcacgcataaaatactattcgtgttttaccatttaagaacaataaaaatactaatttaaaaaaatttaattaggacggatgttcaaagttggatagtgactgtgtttgaaaggtactaagggagtaattaggatatgttgcccaaattagttaatttggcaaaaaccattaatttttctctgatgttattggatctgccattaaaatagaaagttgatgtgtcgtgcatcttgatatttatcctacagtttttcctccatatcgtgagctaggggggcgaggctttttttttttaattttcacacctatgacagttgatgaatgacaatctgtcatctgtgacaggcaagaaagagccatatgtcatacaggtgaatctcacctgcaacgggatatttcaaaatggcccattagagattttttttttaaaaaaaagtatcagcctctatatctaaccggatatatacgaccattgaaataaggtacttaaccccgtaaacaacccaatctaaaattcgctctataaaagatttaaactcaaaaccttagagtattactcaggtcactgtaaccactagactacatggctcattaaagatgttaatcatcactaaagggcttccaccgattagagatgaggtgcaatcatgactaaccactgttacctgatgaggatcaaacctgtcagaggtaacgatatgggctcaacagcggtgatcggatccaactttgtcagggttgaacacactaaattaatttaatgattaacacggagaatatgctcgatcgattaaactttccatgcctgaatcgcgtgtttgagtaatatcaccaataattaggaagcacgatacttacgtactccctcataaaaaaaaaggcaaaccctgaatttacatgtccaacgtttgaccgtccgttttatttgaaaaaattatgaaaaaaaaagacaagtcaggtataaagtattaatcatgttttattatctaacaataataaaaatactaattataaaaaaaattcatataagacggacagtcaaacgttagatacgaaaatttagggtttgtcttttttttctttcgaacagagagagtagataagtacattttgcccttgattcatgcatggcttcatggtactaatagctggtacagtgttttttttttaaaaaaaaaggaacataatatctcatcgagattcatcttggtactagttgctcgtatagtagagtagtgaatacttcgtacaacattatgttttcattgatgtgacacgcttatatattattagtttatagcatgatggcagggaacaaagccagcgctgccacgctgcctctccattatactactaattaaagcttgattttcgttatacatacaggatgcgagtgagaaaaataatcaacaaaagaacaggataacaggtgaaatccaatatatcctatatataaataaagtccgtcctataggtttaatgttatttctcttttttctaattaagccatgtcaccttaattacttttagtcattagatgattaatatatggtccaaattaactccctcattttattcacttattgtcagggttatggataaagcatacctcctaccctacgacttatggaatacactaataaggtatacctttacgcacacggatcgttcccatgtataccgtttggaattcgttcaaaattacggaaaatatctctacgagtcaagtgatttctaaagtcctactcggaagggtagagtttctgttataccgtaccagatcagatattaacaggccttacttaagggtcaagatgatccacggtagaaaagggacccccagggaggggtgcaaggcatcaaatttcatcgccaacacacacaccatagttacgaagccagagtacgtggagcctagtcgccgggagatctcatcggattcatcaactacgatctcgtcggtaccgtctgtttcgtctacttcctttgtaatatgtgattcctcatcatcaatctcatataaactggactagggctattacctgacaaggggcctgaacccgtataatccttgtcttttgtctgcttgatgtcgtactacgtagaccctcgttccaacgtaccccaatattcagctcattcggtccacgagtattactcgtcgatagtggcgtgccaggtagagggacttggtgcttaaggttctgccagtatgacttcaagccttcacgacagcagtaccaacaccagtgtcaatcaaggagcctctacctcgacatcgttggtgtggactcaagtcggatctattgtgtttccgatctataccattacgccaatctcgaatggcccaatcattaccgggaacgagaaaggcacggctacgactccgagaaacgacaccccgccgacgattcctcccatgcaagtggagaacggaacatcgagggccccaacacctgggaggaatcctcaagcggccgaattatgttctctatacaagagatcagagccgacaaggatgacaacacaaaaaccgagatcttggtgtcctgttcataagacatccaaacatactctcgaggactacccactgatagtccatgtgaaggctaaactctacgcttgttgggaacgtggaattcaacgcacttcaccaacgggcgccatctactgtccaattcacaaatccagatctcacgatctcacaagctgcaagatcttcctcaggaccttcaaagtgccgcatcatcgtgtccaacagccacgagttcaagctctgtgtgttgccaaggaacgagatgtggagccggctccagatcggtttgtaggatatgttggcactaatccaaacgagccatatgtgttacacctgctggaagactatgaattctcttcggagtcaccacgggatgtgaacgtggtcgacaacatcgagacaagtccgtccgcagcagcgagaacgcctgtcaacagttgtgaaacctagatgcgatattgagggaaagtccctttgatcccgtaacaaatccagacgtcggccaatgagccatcaccacgagatcagccctgagggaacggcgagccaaccgccgagaatgcggaggcaaaaaacgccaacagagaacatccctccggtaatcgatcacctcgggcgacacgtgaacctattgaaccgcatcgcgagaatcgcgatctccgcgaacacttggatgactgacggagagacagaagagatcggaacaataatgatcgtcatcgacaccattccccttctcgccgcggagagaatattgttcattgacgacatcgtcactgctctccttcgcgaacgaggaaggaacgacgaccgaggaggtggacctaacgaagaccaaggccggcgggcccacagcgaccgccgcaatgacaccaactacaacaaccagcaagatcaggggggccaatcgctgagttcaggacgatgcccaagatcaggagcgagacggcaacgaccaacgagatcacaattcgcaatctcccgcgcctagtcgagatcggggacacaatcattgttcgagaagccgggctcctaaaccaagcgacccctcatcctcgtcttcgtcattttcttcatcagatatacctcccctacgacgtcataaccatgggccgccttccgtcccaggaggcaggtgtagagcattcacaccctcactccgaaatgtgcgatggcccgagaagttccgaccaagagaaatcgagaaatatgatggaagtacaaacccagaaaaatttttgcaagtctactccacaattctctacgctgctggtgcagacgacaatgcactggcaaattatttaccagctgcattaaaaggatctgctcgctcatggctattccacatcccgtcccgcacaatctcctcatgggaagacttgtggcagcagttcgttgctaacttctagggaacttacaagcgccacgcgattaaggatgtcctacatgccctaactcagaacctaggagaatcattgagggactacattcggcgattcaatgagtgcaggaatacgatcctcgagatcaccgatgcttctgttatccgcgcattcaagtcaggcgtccgagatcgataacaccacctaggagttggcgacgcgacgaatcatatctgctcggaagttgttcgagattatcgacagatgtgcccatgcagatgatgctttaagagaaaaggagggaaagagcaaggtgggtgaggagaagaagtcaaccaaaagagacgcaccagagtcgagcaaaaagagaagtcgcaaaagtgggaagcgcaaactctcgggagaggtcctcgctgctgagcaaacggacccacccaggcgcccaaacccccagaacgacgactcacgcaagtaatggtgcccgatacacaagactaacaatcacgccacggaggattgttatgttttcaaaatggagctcgcgagacaactagcgatctagagagggaagccagttcgtgtcgtcgaaacggctaaggaagccgccactcttgactctgactccgctttcccagagtacgacctccatgtctctcatatcttcggcggttctacatcgtacacctcaaagagggagtacaaaaaggtagaacacgaagtctggtccacatcgcaggcggctactgccaagatgaaatggtctcagcataagatcgagttcacgaaggcagaccaccccaagatcgcaaccacaccaggtagatatccgatcgtagtcgaacccactattcggaatatcaaggtggcacaggttctcattgatggcgggagtccaatcaacttgctcttcgccagcactttggacgttatggggatacctcgaagcgagctgacgcccacatatcagcccttccatgtaatcactccagaatgatcgtctaaaccgttgggtaacgtcacgttacccgtcacctttggataggccaataacttccgaacagagcatatcacctttggtgtcgcagaattcgacaacgcgtacaacgccatcattgcactacaagaatctatttaatctatgacaaaaaaattcgtcatggatcacagaaaattcgtcacaggaatttgtctgtgacgattctacttatcgtcatctattgagcatcacagattaaatctgccgacgttttctccgaaatcgtcatggatcagcacaatctatgacattttttaaccgtcattaaacgcttttgggctcgtgtagtctagcccaggcccaacctttgtgacgaaatttaacgtcatagatggttgccgcgtggcggccaacatggcaggtgacgtggtcgttgacacgtgtgtgatgacgtggcagctgacgtcagcaaatttttttatatggccccattatttttttaacggcccattaattttttaacagcggcccattaatttttttaaactggcccattttaaaataggcccatttcaaagctaggcccatttcagaactggcccattttgtcaaccaactatcaaatcaaagcccactaaacagacccattaaatttgagcctaccaaattcaatccaatttctcataccatttcagattcaaacctaattacagataccatcgcagatttaactaataacatatacaataagaatacaacagaattcaaacaatagttcatcctagattcaacctagttacaggaaatctgaaaacagaaaaccaaaacaaatctttcaaacattcaatggaatcactccttgcttctcgtcctccactcatagcaaatagaggattgaattacagcaaggccttcttgttgatgtgcaaatggattttttttgctacatcttatacatagctgcaaaaatacaattttagtgtcaatactgggagtcaacaatattaagtcactaaacaactcaacaatattagtcctccctcctaatcttctttttctaaatgtgaataaatataggttaatggagttatttttgtggcatatgtttagatcgtaaggatcaatgcagcagtggtcgatgtcaagtaacttgtgtgaattaatcgaaggagcaccatcaggtacggtatccaaataggaattatatgcagctatgcaccaaaagataattagtaacacacggcaagaacatacatgcaaagcttgagataaaaaaaaactgtgtgcttgtatcatttaagtgtatgaattaagtctcctattttgcacatatcatatttccattacttaactctagtgccagcgtaacagctctataatataggaaacacatatttccattgaaagctatccacgagaccagagttgctcttaacaactggcaacaatgattatggctgtgtttagatccaaagtttggatccaaacttccgtcattttttatcacatcaacctgtcatacacacacaacttttcagtcacatcatctccaatttcaactaaaatccaaactttgcgctgaactaaacgcagcctatagaacctagagatgaaatccgtaggctgtagacaactttcctgctaaacttaaaggttatacaactactttatcacgagggaaagacctctggttcaacactcttataattaaactttataatagaatcttatgggactgtagaagacaacgatgggcaaggtagattactaaaccaaccacccaaatatcagcattcagatccaatttttcatttcaaaaccaagttcaagatatgtgtgaactggcacttacctcagtcggctccaacctcccttaccatcagccctaccttgaccagcaacatccatcccgtactagagacagacggagcttgagttcatgcagcatatgcagatggcctcagccatgcgcccacagggcatgtcgacagtgatgatggtcgcactgcgaggacaaaaaaattttcagtaaaaggcaaacattttcttgagcgaagctactgctgtaaaagaaagtgatggctcaatgatctacagggattaacaagcataaattctctgtttcttgcagagtaaattgtactcctaccaaattcccttatcttattatgaactgtctaacatcataacctaggcctttttttaaccatcgtacaattgtgtcacctgagtacatcatcagtaaagcccatacaaaaaaaattgtgcagctggaactgaagagccaagcttgaacaatttcaggtctgacactgatagattgttgcaagtaaatggtaatatcacttatataagttttactaacacagaagtacgaaattagaaatagattgcatgcaaaggtgaaatctgaatcagcacctgatatttccatcgaatcttaatgcttgtactaccagagaaagtattaacccaaaaaactgggttcaactaatataaatttttactcgatcatagctaggcacaagcttcgtcgcagtgccactcacacacccccactcatctggcaacctccccatcaccctcccgggaaatcgaattgagcaagcccccttcttccagctcaatccgtgctgataccgaggtctacgttgttgcccagcctgccgaggtcgagctcgttgccgccgctgagcacctcaccccatccgatgaagaggaggaaggcgcggcatcggagaggatgacaccatggggagaggggaaagggcgacgccaaccagcgggacgacagtgacaacggcgacaaggcaccggtcctcgtaggcataggggagacgagaggggaagaggagaggagcactcacctccccgctttctccgcgtccgccttgaagcccgcgcttggcgacggcaacggcgcgacgaggaggcagaggcggaatcgctcggagacggcgacatgacggcggcggcggtagaggtggaggcggagggggcagcacgtggcaacggtgatgatgatgatgacggcacgatggaggagacagcgcgaggcgccggaggcagtgcgtggcagcagcggcggcggcaggagagggtgagtgagggtgagggagagacgatgacagtgacggcggcgggataggtttcaccaccgtgccggatccgccgcgcccaacctcgccgccgccgcccgctgcagtcgttgtcgccgaggtcatcgtcgccgcgtccgagccagaactttgttgtggatgactttttcagttgaaatcatttagtatttaaaaatgtcatcatgctccccctgccacctcagcaccaccccgcaatgtcggcaagaggacggcgccagagaggctagcgctgtcccattggacgacggcgccaggcactctggcgcctcaaataggaccatttatgggataagtttttctaggggtctatttgcaaaataagtttttctagggatctatttgcaaaataagtttttcaaaagaaccaaattgtgaaaaatctaggacgacagcgggagtcccgctagtcgccacctcgtcaccgctttgggcggagatcgttgaggccttcctgctgacatcaaaaacaccctcaataaacttgtagacatgacaacaaagggggtcaaagatttcacttacttgtcggtggccctcttcagtagtctcctcttcggacgaggagggagaccgctcgtgtcctgagtaagatagtaaattacgacctcattccattatcccgcgaagaagaaaagtccgacaagatgagaatgatgggtcctcagagcagctgaatttctgccgatatctggcagtgccgctcgcccaggcccagggtatcctcttgatcccgctgcctcccgcggcagcagggacggaggaaacagcagtgacctcctccgcaaccttctccttgagggaggcggaagcctgaacttcttcgattgtttgcaggagcaataatccttctagaaaggttgattgcatgagagcgtgattgataacgactatacgtgtggctgtagcggttgtgaggtgacgatcggctgatcgcaggcctcaatgcgtgaacatcttcacctcaccaaatcaaacctatcagaagataggacaactatccacatcagtacttagagactgttcatttgtcttacaaataagttatatatcatgtgcgtacaaatctgatttcagaacgtttacctggtagtttgtctggtgatcgcacagtattgtccaagttcctccaagcatgcatctttactatgttagcatttttacagcctcacgttcatataactaatcttgactagcaattcatatttcattcaagcacccctacaacctcactcgccgctgccccaaagattccagacacaaggagatccaccttgccaaaacctctctcacctccagctgacctttccactatgagggcgccttcactgcacaggtatcacaactgtggcacacccctggccctagtactagggtttctccgccatgtctcggccatcaatttccccgccggcaacctgcgttggcccaccagcagcgagagtctatttttcagattggagagtgcctcccattacttgtggggaaatttgatgcatgcccaaattgctttgaatctatataggaagatgcaagtggcagaaagcgggttcctcataaggtgaatattgatggatgtacacaagttctattacgaaatttgttgattcgtcataaagaaactaatgtgacgctccattttttaagagcacacaaattcatcatagaaatttcttaatgacaaattcagtatctaccatgacaataatgttttcgtagatgggcacatttctactagtgttggtttcatctctaaattggcttcgctaaccggttttaatcttttgtaaacccatcgaagtcaagagtttttctaaattaagggggctcatgactccattaacatcgtaaatctttaggtgggtccatgttgacaaaatagatgccaatatgaattggcaactccgctagagaattcaagttttcagccttcctctgtagtttcttctcatgtaaaatcgcacatagattcgcttttaacatgattttaatgagttcaggaatttaccatatgtctccatttttttgagagtatgctatggacgcattcgtaggtgtgtaagtatagtgtaccatgctcgcgtgcatatctttagagtaatcaaagaaatgcataaatgcaatattgtcaggacaagcataataattgagaataactttcctaattttcaaaaaatgcgtcgacatctttacacctgacatgttcgtacttttgtcaggttgtcactagtcactcatcttattcagtggaacaaactatttttaatatatatcgctccttacaccatctatatttctaaagccggtcattcggtccagattcgattggtccagatgtccctataatctagcgacacgtggagcaatgtgagaaagagtgttgtgcgcaacgatcaggagtgtaagtgggtcagctgcacacccacttataggttaaaataagtaggttcgcaacttattttagtctataaatgggtttcacgagttatccacttacacccctaataacgatagaatttccgagttcctccgcacgccgtatgcgcctttgctaaatacccatctaatcatccacggctgagccacattaaccggatttggatcgtctgacttcaccctgtgaaggcacgaacgtgtagtcatcacttatccaccgtccatgcaatgcaacggctcctgtccacacaaacctatggccgcccaacaagaggcacgttttccagacttcagggtcagtttggtagacgtgtagtcccgccatcgctgccgccgccgacgaatagcctggagctcgtctttcgctacgtgctgccaccgccgctgtcttaggcatcatatggaagctttgccattccatcttcctgctaggattggatgtatcaatcggcagtgatgcagcatgcttgctacttggaatttggattatggaacatgattacaatgagcagagcagagcaaagaatgcattcgattcaactactcagcaagcaaagcataaatcattgcatcccatcaggcaattcataagtttcaaacaacaccattcattactaagtggagtacaatgaagagtaagccacatcataaatcaaaacagatagtgaatagagatcgtaaataaaaaaggattgacaaaacaaaagcaacacactagaaactacagtctccatagctaaaatatgtctttagtaccatcaacagttgaacaaagaaattaacttagcaaatttgatactttggccaaaaaaatgaagaacaacaaaaaaaaatagttgggccgaggcgatggctggtgacgacacgtgcgtaccggcaaacaagctctaagctagctagtcaccgccatcgatgacatcgacggcggtggcggcggcagcgacgacgagacctcatcggattgccttatcaatttgtcttgttggctgccatggattgttttaacaaaagttaagtgcacgtgacgcgtgagtcgttgattgcatgaacagtggaaaaatgatgactgcacgcccatgcctttgcagggtgaagtcagacgatccaaatccacactaaccggcccatggcaatacgtgcacagttcgcccaagccagcgcatgtacatgcgtgtgctttgggctaaaccggccacatgcatacatctatgcatctattagttggtatacatataaaaatctctgtgacaaataaatagtgtttagattcctattattttagtagttattaaagatatagtattataaaagcaactattatcagatttaacaataataccattttaaaatataattacgcacgcgatttcttaaacgaaaaccaattatttaaatagtactccctccatctacttttgatagtaatatttccaaatttgaaaaatttatttttgataggcatatttcaattcaacaacatatcatcttaataactttctcggatttaatgcatgacttttcattcttccacgcaagatcagctatatggacatcgagaaatgtaaatattaatgaattgcttgtttacgagaaatgactagtagcattttaaatggatgataagtagaattacttatccttggtctgtgttccaagatgaaatatgactatcaaaaatagcgagtaaaagtaaatttacaatagcgagtataaacaaatacaaatgaaaaatgaaaaaaatattctgctaattttacaaattgtaatagatttaaatgtacaaaagtacgataaaatattcataaaatactttttttgtcattacaataacttattcacctgtttgttggtatcattaattactacccgtcttaatttgattcttctcggtatactttaaaactaaacaactaataattccattaaaaaaattaaagtatgctttaaattgtatgatgcttatagacaatttatgattgttaaactaattccattaaaaaataccgttttcttaaatacatgcttcataaaaataattatacacgggttaaattacttagtgtgccttttggcgcattgatattctagtaatatatgtttctcaagtcgatgtgacacagtctgtgtcctaagagcatcaccaatgtatatggcaaagtgatccatatagatgggacctatataaatagtttttacctatgacaatctccacaatatatatggatacaatgtatcattaggagaagagagatgagtagagatagataatataatttattccatatgggtagtccatatgtatatggataccttttgttattttttctataggactagttgcacaatggttataggtggttggatggaatattctattgcttatggactacttttacaccatattgtggatgccttaaggctgtgttcttaggtaaggcttgagggtcaggaaccctcacttttgacacggaaaacagagtaatgaattaatacatgattaactaattattagtttaaaaaacttcaaaaatagattaatatgatttttaaagcaatttttctatagattttttttttcaaaacacgcaccgtttaatataatcttcccaccgatcacacagttcacaaccaaatataatgcagtcgatttattgttaggtgaaggtaataaacaaacaaggctgtgaagccagtcagcagaccacatgaatatagatttagacatgacactgcttaatttcaaattttgaacaaacatgtcggcaacaaaaaaaaaatgtgacctcagaactttatttattattcgcacacgtactgcgcacaaactaataaaaccacactttacaacaccactagctaggttttagacacaaacaagcataagcgatggtttaacaagagcgagcaacgcgtctgatacaatgaacacttatacaaaatctggtgtgtgctctgccatttgagctaaatttgaaccgggattttgtatttgaacatatgaaaacgtttactctgctttccaagacgacaatggaggggtctcagaatccttccaagtgccggccgtctgagcatagcggtcaccttgaacaacatctgtgctggcataggactcaagttcagtcatttccccaggggtgagcttcacagatagagctgctacattttgattgaaattctcgatttttgttgtcccaggtatggggcatacgtcgcttccctgatgatggacccaggccaatgcgagttgtgacggtgtgcatccttttctggctgccattgcgttaacacgctcaaatatttcagcattcttctcgagattcgctggttgaaatctaggaagatgctgcaaaagtataaataaatagacgaggcgttaatatacatcacaaagtttggaaaatgagagtacacacgaaggtatttagtggaaactcccaatattcaaactatatataaggaatataattaaattacaatgtttcaaaataagaggcatgatacctattttcattacctccttcatccccattcttagggaaaactgaatgagtagtatccataagaatttaccttgcgaacatcctgaacagatagactccactagtttagctccaccagaaaagaaccctctaccaagtgggctgtaagctactattccaattccaagttctctgaaatggaaataagaaaaatagttaaaatggggcatgtgatttttttcaatggataaactaatttggaattatatcttcttccacgtctctagaccataatgaccactcgagctgaactgcagtgatagggtgtacagcatgagcccttctgattgttgatgcagatgcttccgatagaccaatatattttatctttccttcttcaactagtttcttgagttcaccaatctaataatgaaaaggtaaacatcaactagataatattgggaagaaataaaggtcattacttaaaaggcagacaaaaatacaatgaaaggtagtacactttatttgtacacaataattccatccaacggtttggaaatatcataagtaatagtagttcaggtgctagtatccgctttcagaaacacagtagttcatgtgctcgtattgatagtttgtagttagacgttctgtaggtcctattttggattctcacattttctgcaagaaaacaagtcctcttcggcaaagatatttgcaccaatttcagtcctctcatatctatttattttggttatgtattgctgcattggatcttaaaattgttaaactttgaaatgttggtttggtttgtggttaacatctcagctaatacaagaacagcattgtatgttgcaactgccgagtgagacatgcatgtcggtgaaaattaattattggctcagtcttgtctttacgtcttcaccttcaaaatcccacagctattgtctaataaaacaagccctcctctgtatctaagataaatgtactatataaatgaaaataaaacatttatcaattatagaaaaccatcgagaccaaatatggagtaatgtaaccgtccagtcacatgtcatcgacagtgaaagatattcatgtaaggttttccacgcaattatgatttatggcacacagtccagatcttaatgcaaataattttgtgctacatatctttacaaatgtatggttcatatctttacaaatgtatggttccaaattcttctcgagaaaaaagaaaaagaaatttatgcttcatgttgctattacaacaaaacctaataacttatcctttcagaattaagagaccaagttgctgcgaacgaaagaaaggatgtcaaatgtataatataatcagctaaacaaacttaagaatttaagtgtgcttcaagccgggttcaagttttcctttgatcaaaattctctcttacattttttttcagtaacttcctaatcctctctccattctagttttactaatgaatatgaaattaattatctacgagatctagaaaacaaactaaatgccttttttttcattgatagaaagatgtccatttttctggcagttgtcccaataatactactacctccgttctaaaatgtaacaacttttggctatgaatctggacacacagttatattttggaacggagggagtatataccacatcacctcaaatttttataacccacggatgattaatctataggcgaaatcgtcttcctcttttttcttctccgatgaatccacaacaccgcagttttgtctttggatgatccatctatattatttcccttgtttttcttctctcatgaagttacgtaactttagttttactttaaatggtcaatttatataagatttaaattatcacaaaccatatcatctgaattatttataacttttttaacatgatcgatcaaatattcagtccagctaaaaaacaaacccatcttacatcttatttacaaaccttatttctatcattatcatgcaaactttccccactaccacgcatctggttatgtataatcttgacaccaacccattgacaaatcaacacatcactacctactttccctttcggattcatcagccgtcacttacacatgtatgcctttcatccaaaaaaaaaaagatatttcctccgtaaaaaaaatcaaaccactttccatttaaaatctattcaaaataagtaacaattttataatattatatttatcttattagtcaccaatcattcaattgttttttacccttataaccttgttcacaaacagcccttatttaatttaggccatataagtgatattttttctgtgacggagaaagtagtaaaaagaaaaaaagtaaaaaaaaaagcagaaaggaactgaaagacaggagagagggaagggggggcactcaccgtgacctcgatgggcaccttcttgtcgacacggtgctggtagtaaaggtctacgcaatcgacgccgagccgccggaggctgccctcgcacgccgcccgcacgtacgccgggtcgccgcggatctccaccttcccgtcggcgaacgagacggcgaacttcgtggccacctccaccttctccctcacgccgccctgcagagcctgcatgcatattggcgcacatgagcattccgtcgagcaccttcagcgcgtatcccagtacccaaaaaaacaaccgaagcgtgcacgaagaaacttattataactgaccttgccgaggaggagctcgttggtgtgggggccgtacatgtcggaggtgtcgaggtgggtgacgccggcggcgacggcgtggtggatgagcgcaaccatgtcggcctccggcttgggtggcccgtagaaggcggacatgcccatgcagcccagcccctgcgccgagacctccagaccctgcgagcccagcttcatgcgccgcaccgccgccgtcgccggagcagcagctgccatggccggccggaatcggatcgatcgatcgatcgattaatttctctccgccgcgcgcgcgattccggtggtgatgctacgtgggctctggccactcacatatataggggttaatgctagtaccatacaactcactgcaagcgtcgctgcacagtgtgcgtaagagcttacgcacgtgcttctccgttcctaaattagccaagagttactctgagagctattttttatcacaagaaaataacactttaataaaatagctctaagttatttggatcaagtgttattttgagagctatttggctttaatgtaccttcccatgaaaagagatagagagaaaagacactttttcagaggacctcacccgaaatatcctcaattagcacttcttggatgtgatagttttttggtggattattttcaaatagccctcaaatagctcacccttttggatctttttgggctatttaagagaggactaaaaaatatcccttggatccaaatagggccttttgaccatcaatttattacatattgtatttcttaaaaaaataaaattagtgtcatataaaagtatattttaaaatataaatctagtgatatattatatagtatgtataatacttagtatatagtatatatagttagtatgattattagtcgaaagttaacgagtttaattttatttaaaaagatgtcatcatatagttaccgagaccaaggagtatcagtttttccatggccatacgtcggattcacattcccatggccgcgcgtgcgggtaaggagtgtcgcggtcgaagacttggaagtctttcttggataatgatggtcgttgggcgaccgggcgggggaggaaaaatcgttcgctacccccaaccctgtccccgcgcgcacgctgatgtcgctggtcccaccacaatacctgcctccacctctaacaaatcaaccacatattttaaaaaccctctagtaaggaaaatttggtttattttttgttccaccaaaaatattccatctagtgtactcataatgtttcactatgtatagatgtaacgttgcagtgaattgaaatattccattgcaacaaaaaaaacccacatattttagaaacccctattaagagaattcgttttatttgttgttccaccaaaaaatgtttcgcctagtgcatttataatgttttactatgtatggatcaaatgttgcaatgaactgaaacaatctttcgctatttgctgaaacattatttttatatacggtgaaacaacacccaatttaaacgagtgaaacattttcgatctacttagcgaaacaattccgatatatctggtggaacatcgtacaacatttaaaaataattcaataataagcttaaaaaagttgtcgccggaatatatctatgtgtggtcttgttttgaagatttaattgcaacaaatttaatggtgcaatcggatcatgatttggataagtaatttaagaaaaaaatcagtttaaagtaatttttgcacgtaaatcaggcgcggacgtcagcgcccgatttttctccgaatcattgggcgtccgagccgtaggcagccccgtctttcttcgcgcgagaattctcaggcattatccgtggcaaattaatacagtagcatattaccccctgtagttttggataatacgagaaaaaaaaataaggtaaagagttccaagtttttttttattcttctcaacgtaagagatgaaaggaacgtttcagtttgcaaaggacaaaatttcatacaagacactaaagaacataaaaacgcgttacggctaaaaaaacactaaagaactggtaatttgttgggggacaaaagcttttgagttaagactagagtgaagatggaatataatggatcctaatgatgtacttggggtgatggtaaatttagatttttcataatttctaaatttttactttaacatcatgtttgaagcatgtgattttaggggctttctcgttttattaagaatttatcattccagtgtcatctagtaaattaccagtcttttaaggatgtcttttagttgtgacatatttttttatgtctatcaataaattacataaaattttttgtgtgttttgtagcaaattttgccacaaaaggtggtcgtgctgccttaaatttccaactgtgtcgctttcctttcttttttttcccctcacgataatagcagatggccagatgctcatatatacgctaatacgcacgagctcactcaccatatatataacatacacgcacacgctatctttacgagtacctctaaacactggactgttataatattttaatattgacgaagtaattaaccacatgaatgcatctcagtatcaacgggtacatcgtctatcgatgatagaataattagcttaaatatgagcacctattctggctagggacttaaactcggattacccagatagatgttttctctttctaaacaatattgcataggggtcatcccttaattagttaatctactttgttttaggtaaaaaggggatgaaagcaacataatgctttcatttgtagacatagtaatatgccgtggtaacactacgataccatttaataatacaataatacgcgagtctttccaaaccatgtaacccccaatatacaacttcataatcagtgagtggacagatgtaggtttttttttctaattgtacagagagctgggattttggaaaaggaatgtgaattcgtaaaatgcaatatcttggtcccgcacagcggcgaataaagctcccaggccggacaaatggccgcctgggctctgtcgctgggacctccatcatttatttattaacaaaaagtatataaaaaataatgttaagagccaatctatatatctctatctatatctatatctatatctaaatctatttctgtatctttatctatatctatatctatatctatattatatctatatctatctatatctatacactttctattagctctcatgttaatcagcaaaaaaaattgaccattgattaatatcatgatatatcatgaccgttagatcctaagatctaatctgcatgtaatttatgggccaattttcaaacccaacatcgatctaatctgcatgtaatttatgggccaattttcaagcccaacatctagccaccgtacttcctatttccttctactaccaatctggagtaagagttactctctccttcctaaattgatcgtcatatctatttatacacaaagacgaaaaataatttaaatcacataaatcaagacactatgcacacattctctcacaatgtatgcatcgattaaaacactatgccaattacatgcacacattctctcatgctacattaattgtattctgataaaatccgtgtctatgcggttatatgatgatcaatttaagaaatgttgaattttataatatgatgaccaatttggaaaggagtgggtatataatacagatgggcatgtatgtgtttatgatatatatatagctaaattattgcacaattatgctaaaaatacagatcttattgcaaatagtattatactacatatctttataaatgtatggatcaaaatctttttgtggaaaaactcttgtggggttatttaatgggaattgctaattactactaagtacttcctgataatagttccgtgtgtgcgaggtttcatctacttcctcattatctgcattaactatatttcttgggggtggcagttacttgtcgagttgatcgtgctatcactactataaaaatattagattggtgtcggttgagaaacccttttagatgtcggatttctcaaccggcaccccgcaaaccgcactgatgatgacttcggtcacttcggtgtgatatgtctcaaaggtgtcggtttttaattagaaccggtatctctatataacagtctgaaacatgtcgattttaaagtgggtccgaaagaactactttgatagaacaggtatcaattaaacgtaccggtttctgttaacaaccgacacatacgtctgatataacatatacgtgccagtccttcttaaaaaccagtatctatgtcaccatataggtgccagtttaaaaaatggcatcccatagacgcgcattcagataccaaaagcattataggtgccgattttaacattttccgtacatgtaaagccgtgtttatcttgtgtggttgtttttttaaaaaaaacttgcctaattttcaaaactacgtgtgaacacctttacacgcagagtgttaaaatcaggttatcactggtcttattcagcggaacaaagtatttaaatatatatcactgcttataaaataatacaggtccagatgtgatgaaggtgttaggtcctgatctttcgaaatgtattaataaacagtcgatttgggcggagtcgctacacaactcgatccgacttctgaacgaacacgctactgagccccgcaagcgcagcaccacgtctcctttggttatcaatcgtgccaaaacctggttaacctcgccgag

SEQ ID NO: 18077 - DNA, 3672 bp, Oryza sativa
tgcatatgaatgattaagcactcgaatttatggttctacaaaccgatctagcggcgaaactgttcttaacagaacaatctaagctaaacccgactctaaacaatgacgggtactgaataaatatgattagggacgttctggggttgccctagggcacacacccccttggggtaagcccatgacataattataaggcccaaaacacaaatcaaattcggactggataaggtacatggcttgttttgcagattcccggtagctcggtaggaattttgacgtgggacaaaaaccatctaaaagtagactccataagctttccaataagtactcatgggtccctaaattccttctagatcagcggctaggtccatttgaagttaatgctgttaggaggcccgaatccgaatccaaaacgtgtaaaactttatctcttgtctcctatggaccaaaagtgacgtggtgatatgaaaaaagacttggagaaggtcttggtttggtcctcaatcaacttcttcaatcatccatgcattccttacgcttggtctcttttctttcgcccaagaaagtacctctgcaaacgaaaatacacaaaactcattgtgtagcaacatttgttcaaatatatagcaagtaaatcaaatatagaacatatgcacctttggttgattaatatataagataatcatggttatatccgagctagtcgtgtcctcatcaatatggcattagctcagtcatggcaacggttttcaggctaatttcaccaccccactcaataatcctcccaccggtcacaattcacaaccaaattccggtcgaacttttctttggggaaggtaagaaacaaacaaggttgtcaaggcagtcagcactcaacagaccatatgaatatagaataagacatgacattgcttaatttgaacaaacatgttagtaacacaaaattagtgattgcaaaacattattttattattagcacacgtactgcgtgcagtgcacaggcttatagaaccgcacttcacacaagtaggttgtaggcacaaacatgacgaaagcatagaacataacacaatacagacagacaggacatctcattccaaatatacgtgatgtataacaggagcaagcagcgtccagcgactgatgaatacgttctacaaaatcttgtgtgcgctctgccattcagctattttggaccaggactttgtatttgaacagatgaaaacaattactgagctttccaagatgacaagggaggggtctcagaattttgccaagtagtgttggccatcgcctgaggataccggtcgcctcgaacatcatctgtgcttgcgtaagactcgagttcagccatttcctcaggtgtgagcttcacagatagtgctccaatgttttggtttaaattctcgatttttgttgtcccaggtatggggcatacatcgcttccctgatgatggacccaggccaatgcgagctgtgacggtgtgcatccttttctggctgccattgcgttaacacgctcaaatatttcagcattcttctcaagattctcttgttgaaatctaggaatatgctgcaaaagtatcaatacaagttcttagtaaatgagaactcattgtagttctatttaatttttcaaagaacaaatagacaacacagcacaaagatgagtttaataaaggtttgagtccgataaatgcagagtaaatatttctattgaacataagtatttcgtgttaccaatgtagaaagttcagaaaatgagaatacagaagaggtacttaatgggtattcccatcattcaaactacaaggcatagaattaaactagaaggtttcccaatataaggcatgaatgcctatttgatgatctttttcttgtttttctctacattgatcattcatctctacacgatgtatgagtaaacacaccaacaaaattggtttcaagaaaggaaataaattaattattctattcttcttaatctgaaagacaataacactacagatatcacagtgttttcgctgtcatgctctgctattttcatgacctcattcatcccaattcttaggaaaaactgagtagtaaaccatggaatttaccttgcgaaaatcctgatctgatagagactccactagtttagctccagcagaaaagaaccctctaccaagtgggctataagctactattccaattccaagttctctgaaatggaaataagaacaatagttcaaatggagcatgtgattttcttcaacagacaaactaatttggtgtttttttcaatacctgcaagttggaattatatcttcttccacgtctctagaccataatgaccactcaagctgaacagcagtgatagggtgtacagcatgagcccttctgatagttgatgcagatgcttcagataacccaatatattttatctttccttcttcaactagtttcttgagttcgccaatctaacaatgtaaaatgtaaatcaactagataaacttgacaaaaatacaatggacggtagttcagtttatagcatgccaaaataatcaaaacacattatcaaaatgttatagtaaattttgctagtttgtagttagatgttcagaaagagaacgagtcctcttcagcaaacatatttgcacaaattttcagtcctctcatgtttacttgttttgatatttgtgcattggtttattaaactttgaaatattggtttacttggtgcttcagatcccaagctattacaaaaacagcattctgtgttgtaactgcccagtgacatgtaaatgaaaattattggctcaatctttactttgcctcgtcacccatcaaaatttcacagctaatgtctagagtaaatgaaatactatatatctaaactaagtataatatttaaatagaagaaaacatttttgaattatagaaaccagcgatcaaatagggagttatgccaaacagaaagatcttaatgcaaataatattgtaccacgtatctttacaaatgccctagtatgtttagtcaaaatttaattggtacagccctaagatgaggtagaaaaacaacaataaaaggataggtgccatgaaatggaggttccttttatcctttctctccattacataccctgtcctttcagaactcataccaaattggtctgaataaaagaaaggtcaatgtacaaacagccaaacaaacttaagaatttaagtgtaccttaagctgggttaaaatttcctctgttcaaaattgacctctcttaaaaaaaatttcaacaacttcatgatcctccctctagtaagttttcccaatgaatatgaaattaatcatctagataagtgggtaacaaacaaatgctcctttttttttcttttttgcttttcatcaataaaagatgtccatttttccggcagctgtcctaataattattgtagaatattgacaccaacccattgacaaaccaacccaccaccacctactttccctttcagatacacgtgtatcttttgcatccacacatcacaaaattttctaaaagaaagaaggataggagactggggaagtggcactcaccgtgacctcgatgggcaccttcttgtcgacacggtgctggtagtaaaggtcgatgctgtcgacgccgagccgccggaggctgccctcgcacgccgcgcgca

SEQ ID NO: 18078 - DNA, 2461 bp, Oryza sativa
ccaaagaagcaagagagcgggcaggacaggaggaaagtaggtacgtaccttgccgaggaggagctcgttggtgtgggggccgtagatgtcggaggtgtcgaggagggtgacgccggcggcgacggcgtggtggatgagcgccaccatgtcgggctccggcttgggcgggccgtagaaggcggacatgcccatgcatcccagcccctgcgccgagacctccagaccctgcgagcccagcttcatgcgccgcaccgccgccgtcgccggagcagcagctgccatggccggccggaatcggatcgatcgatttctctccgccgcttcttggttcactccgtcacttatataatggtggagtacatacaaatacagtgcagagcaatcgttagtggttggtgggagaaggaatgtgtcatgtgttcaagagcttacgcgtgtcggttattattatcagggaaaattgcaaaaatcaccccataagtcacttgaagtttgacattccaccccgtaagttattttgttgcaaatgcccacccacctactcaattttgttacaacaaccaccccagtaaacacatgcttcaggggcgtcccggtcaaatcaggtccccgtgcgaaatattaaaataggccatagtagcctagtaaatttttttatagtaaaattaaaaacgggcgtgacgattagctgatcatcagcgatgaagcagaagcggaggctagagggaactggggagaggagatgaagtggctgcggcatcgggactttggcgatacgcgacgacgcgaacgcctggatgggagcacgatggaagatggatcgattcaccttctgcagcgttttgggccttgtgtttgatactatttggactgcaagttaacaaaattaaagcctctaatattattatatatatggcatacttaatattttaagggcccttaaaatttgggggccctgttcggtcgcacagtccgcacgggcccccgggacgcccccgtatgcttaaccgaatcaacatgtttttataaaatgtgatctatcaatgtggtccttaccaaaactaaatatttctagagtattattgatacattttatgtaagattccacaaataaaattgtggacgagagtttaaacattgtcgcactgagtttcgctatatgaaaaaaaaacaatcaaatatggaaaataagtctaatttaagcacttagacaagattgacttggctagcttagcatgtggtaaccctacatccgcaataacaaactgatttggttaagcacgtgcgcattgggtagggttttcaattctgaaattggattttatgccggggattcctgaaatttcagaaatttctggctgaaattatttgaaaatttgactgaatttgaataaaatttgaccaaatttttttaaaaaatgcaaaaatccaaaaattttgggcgagacttgagcatgccggtgggatggcgaaatttcggaaatttcgaaccaaaatttcaaaccctagcattgggtggtttttcaacaaaacttagtagcgggtgggtatttgcaacaaaatgacttatgggatggaatgtcaaacttcaagtgacttgtgggtgacttgtggggtggtttttgtaattttcccttattattattattattattattattattattattattattattattattatttccttttgtatagcctcggttttttatgtctcttgctactagggggccctaacgggcgatcaatcgccagcgatcgatccaagcgatcagatccggcccccctccccctataggcaatacctcctcccactcctcccccttcctccttcccttcttctcttcctactacagtacaccacaaaaaaaattttaaaaaaaataaaagttagaaaaatttatgtatagaaatactatatataaaaaatttaaattcaaatttgaatcgaatatgtaaacttttgacttataaactttgggtctataaactttaggtgtataaactttagatgtatagaaatactatatatagaaaatatttgaattcaaattcaaatttgaatcggatataattcaaattcaaatttgaattgggtatataaactttaggtctataaactttaggtgtataaactttagatgtatagaaatactatatatgaaaaatatttgaattcaaattcaaatttgaatcggatatataaactttaggtctataaattttaggtgtataaactttagatgtatagaaatactatatatgaaaaaatatttgaattcaaattcaaatttgaatcggatatataaacttttgagatataaacttttggtctctaaactttagatgtgtaaacttgagatatataaactttaggtgcataaatttactaaaatagaaaagtaatgcggtgccaaaaaaggaaaccagaggtggagagagggagggggaggggggg

SEQ ID NO: 18079 - DNA, 7557 bp, Oryza sativa
aggtggttgaaaggagaggggagaaaaaggccttgacatgtgtgccccatagaattttatttcctttgacttaattgatacatgagccacataggattaaaacttcttcgaattgagtaagagggggtaattcatccattttgataagttcggaaacgtcggacgtccaggtattacagttaagggcgtaaatcagactaccaaggtttatatgttaattcagacttttccttatataaatggcttgtttcttttcatacaagttttcctgcagcaacgtatatataggatatcataatgttacatgtgcatcacgaaccaaagatgcaagtagagcattgtaagcagcagcaacgtacagcacatcgtcaagttacatacacatcatgaaccaaacatgcaagagcaaaccatagcaaacaagaatatatattttcttccgctattcatgtgcaaccaggagcactacttcttgaagagagacccaagcagctactcctctttccatgaggacaacggaggggtctcacaatccttccaggtgttggccatctgagcgtaccagtcaccgtgcacatcagcagcagcagcgtaggattcgagctcagccatttcgtcccgagtgagctccagggacagagccccaacattctggtcgaaattctcgatcttcgtggtaccgggtatggggcaaacatcgtcccccttgtggtgaatccaagccagtgcgaactgcgcagccgtgcatcctttcctcatcgccatcgcattgacgcgatcgaatatcttggcattcttctcaaggttttctggttggaatctaggcagattctgcaacaagtgaaaggtcgtactcagcaaattaagctgccaattgattgctcaaaggagtttaaaaaatgttagagtttttgtcaaaatatttgtacgtagtcggttatagtttagaacttggagttgtaggaggtaaaagaatagagagtaagaattagacgctattatagactctctcttagatagagagacgaacatgttgtaaccatatgatgacttagcatagccgagaaggagcggctgcaggtggcatccaaccgatggtcattataactctagttcactgtaatatgttggatcggggaggggtgcacgtaaagtgcctcgaagatgtaggcttcggctgaactccattatcaaatatcgtgtctcggtgtcgtcatcaggtgtttctttcttgtttagccatcaatgatgatttcggggctggtttgtaacaaaaaagtttcatgatttcagacctgtttttgaaatgtaaagcgttcggaattgttttagaacttttcaataacgaaaacaaatttggaattattttttcttggaacggttttggatttgttttttcctaataatgtctactgtctaaaaagatgataagttagatttgacaatgtgatctctgaactgtggtattatcttatgatagtgctattttttgttgctaaaatttggaaattttatctgttgttttaaaaagatttggaagctcattttgacagttttttatattcccataaatattagttaccgtattcgcttttattcatattcgctccattttttatttgataatattttattctgtatatagggatttttattccaattttaattcctaaaaaatatgaaaatgaaaatgaaaatggtagagttggttttctaactgtttccatccctataggagaccgcttaaggaagtcataaagatcatttctattttcacggccagccacttgattttcacgggtgggtgctagcagccacttgatttttacaggtaccagtgaccacatgtggtaacacgattttaccctgtacgaaaatctgtttatttacacaagcagctccattcagatagctacccatgtccacgacatttttcagacattgctcttaaatgcccgcctatgtcttgtcttttctactattgattatcatgcgaactcctcacaagacgaaccatcggatgccaatcaagcccgccactaccacactacgcctcctcacctcccatgccatgtctattagagagcaatgagaaacctctccataatctcccaactttttccactatctacgacaataatgtactcgtcgcgtcagccgtagtacatcgccattagcgaggaggacaacaatgatatataggagcatggggacatctcatcctccttatcgtcactggccgtattgtcaggcgaaattcctggggataattagcatagcgaggatgaccggtggtacaacaggtcctatcaaaggactccaacgagggcccactatcgctgaaggaatagaacgaggacaaaagtggcaacgaggctgacgactcggatgagggcagcagaggcaggtgcgaagaaagagataacctccttgatcaccatggtcatggcggcgatggcagcctatgaggatgacaccatctaagaagaggcacggctagagccgatgccagaggcatacccaacatggctgaggtgccgaagctgatccccagcttggccaaggtgcaggaggagggcacctatgtggctatggcaccataggatgaggcgaaggatgggccactggctagagtcaagcatagccgtcaacagaagcagagattgaggagaatgcatggcccttccccattgcgctggccctatcgcgagctctgacactgggctaactgtcaacgtttgatccacaacgatggtgaagcgccgccgccacaactaattgtacatattatttttttagtataggcccaaagtacgacaagtagcctcagtagtatgtaattaggggcaaatttttgatttgtattatagtactgtgttttctaggttaaatcttttgtagaaattgaaatatatgttaaatcattttttcatccaaatcaatatatattaaatatttcatctaatgtagtatccagagcatttgacaggtggacaatttgttgtctcacttaaatgtggtcccaactttttcccaagcggctttcataagccactgcatatgaaccaggtctacttgttattcaaaatttcataataattttatatgaaggctgattgaaattaacagaatttcagagtgatccttgctacaattcctttagtttaattcagtcaataactctttcaactacaaacttagtagggattaccactaatatcatgatatctgacaaattaaagtcaaatggtatgcaacatataacgatagtaagtaaccctagtaatgcagatattttaatgaagaaacctaacatagctggaacacattacacatgtgtagtggggatcatagtgataagttgtttatctcaatcagagttcatatgaatttttcaaatctttgaaaattgttatcgcaggcggcgacttgcatccgcttggaaaaattatattccaatgcagatatctgaagacgccgcctgtaaaaatgatttagacataataaatggccaagagtgattcaaagctctaactccatgaattggaaaatataatccgaaatcgtcaacgccgccactgttgcccactagatctgccaacacagccgctgcccaccagatttgcacttgtcacgacatgaggccatgacgggataaccaacgctaggaggatagccagtagcgtcggctactgcagaagggagcgcatccatatctaggtgagtgttgtcctgttggatctcccaccatcaccgctccacatccaagtacgtcatcctgtttatccgacggtttgtccggtgatcatgtggtatgtattgttcagcattttttgcagtcccacatttcatgactaccttgtctgatagtccacgtttcgagaaaactgagcgagtagtaagcatatgataatttaccttgcgaaaatcatggtctggtagagaatccactagtttagctccaccagaaaagaactaaccctctaccaagtgggctgtaagctactattccaattccaagttccctgaaacagaattaacaaacaatagttaagatggagcatatgattttttctcaatagacaaactaatttgttttcttttcactacctgcaagttggaattatatcttcttccacgtctctagcccataatgaccactcgagctgaactgcattgatagggtgtaccgcatgagcccttctgattgttgatgcagatgcttcacataacccaatatattttacctttccttcttcaactagttttttgagttcatcaatctaatggcatccacaatgtgagtagaaaccaagtagtaagtattaaatatcaccttattacttggtagtaaatattttaaaggtggtatactaccggatggaaggaaaaacaatcttatgtgaacaatgtctccgacacacccggtcacaatgctatcagcaatggataatttttttctcaagtggcccccaccttattcatcacccgtacacataagcattgcagatgcagtaaagacctactacccactattgtttgggcccacactgataccgagtttagtaagaaacattgagcatgctctaataatgtgaaaggactacaagataattgagctattccactaaattatcacaacaaaaaataattcgtgccaatatattgtactattgcaacgataatttttctgtgacaaataactatattttattgcaacgacttaccatcattgttttatttagtatttttgttgcaatagaaaataagatattgccaaaaaaaacattaccgttgaaaaaacatgttctatcatcacaattttaattttgtggcaatttgcatagtacatggctgtggtatgttactttttactattttctattgccacgatcaacaaattcgttgcaataaaaaattgtcatctcataatttaacttatttttttcatatggacatggattagaacaaattttatatgaaagttatagctctcaacgagatctacaattttataggtgataactttttcatttgaaatcttttatatatttaaatccgtgattcaaatcttagttagatatgctcaaatggaacgatatgcattttctaacagaattgatgcgtaggtgagttggtaaaggagagcacacgtgaaggataggtcttgtgttcgaatcctagcaaagacaaggtatcaaataataaatagttatgatgtagaacaaaattagttaatatttaaacttttaatttagtatgtagaactaatgccacatatggagtggtggcaataattatttattacaacgatgtgaagtgttgcaatataattttttggccacatccattccgtggaaacatcaaaatttattaccgctaaataaaaatcgttaaaataacctattaccacgctatttattaccacggctagtaacgattttaaaattgtggcagcatgtatctatcgccacaattttagtattgatcgatgccatgatttttttcatggcaacaaattatttttctagtagatcaactagataaacttgaaaagaaaggtcattacttaaaaggcatgcatagctctcaagataaaaaaatacaagggaaggtagtgcagtttatacacaataatttaaagcaacaattcaaaaatgtgtgctagctcgtatgcgttattagaaagatatagcacaccagaatgatcaacacgcatatactgtggggcgtgttatagtaattattgctagtttgtagttagatgttccaaaaggaaaaaatgagtccttcaatcaaagttttttctttcccgaaagaatatgaaattaattatatagtgaaatcgataaataatcaaatgctccttttttttgctcttcattaataaaagaagagtaaattgcactcacggtgcatcaacttagcaggtgggtgtaatttggtgaaaaaacttgagaaatgagcgttctagtgcaacaacttggtaggtaggtgcaatttagtataagaactttataagtaattatataaatgtaacaacttgtaaggtaggtacaattttgatacaataaattaagaagttatgagacaacttaattatttggagattttttttatagattcaatttttaagtacttattttgataatatactagcgtgtatttgtataagcatatttatatttttatcctaataactaattactaaaagtcaattaaactggatgtaaaaattattatatttcggttgatatttgagaaggtgaagaaaaaaaaattcttaaatgttaattggatgtaaactgtatgtgcagtataatttttaaagattaaatctaatattataaggtaatatatgtaggattatatgttaatgatatattgacatcgtgaaaaaaaaaatcaactagcatatgcttagccaagttgatgcatcaaaatattaaattgtcaagttcttgtactagaacacacccacttgtcaagttgttacacttatacgttcatttctcaagttctcatactttatcgcacctatctaccaagttgttgtaccatgagtacagtttactcataaaagaattaagagttaattatccgtttttccaacaactgtccgaataattatgaaccttgacaccaaccatttgccaaacccttcaccaggccaccaccaactttccctttcataatcagcttttcatcactcacccgtttatgtttctcataacaaaacaataaacacaaaggcaaaaagaaaaaagaaaagaaaagaaaaaaacagaaagagagacctgagaaagggaaggggcacgcacagtgacctcgatgggcaccttcttgtcgacgcggtgctggtagtaaaggtctatgcagtcgacgccgagccgctggaggctgccctcgcacgccgcccgcacgtacgccgggtccccgcggatccccaccttaccgtcggcgagaaatttaccgaacttggtggccagtgcaacattgtcgcgcacactgccgacctgtagcgcctgccttttttccaacccatatgcaaacaagcattccgtcgagcaccttcagcgcaccactactcgcgcatggcgcaaatcaacccaaagaaagagagggacaccagtggaaggaagaggaaggtactatacgtaccttgccgaggagggcctcgttggcgtgcggcccgtagatgtcggcggtgtcgaggagggtgacgccggcggcgacggcgtggtggatgagcgccaccatgtcggcctccggcttggacggcccgtggaaggcggacatgcccatgcagcccagcccctgcgccgagacctccaggccctgcgagcccagcttcacgcgccgcaccgccgccgtcgccggagcagcaggtgccatggccggccggaatcggatcgatcgatttccctccactgtacatctgtacccatataatgctgtgcgatggcaactgcgtagttgggaggagtacccttttttttgacaaattgactctttttaaaaacttatttcgaaactaacccctgcgaaaaacttcaa

SEQ ID NO: 18080 - DNA, 3205 bp, Oryza sativa
tagggtttgtcgccctctcttctcccctcaccaaatctcccccaaatcaactcaaatcgaaggggatttcgtcgggattgagttgaggatcgattgagaaggtaaactcctctagaaaccctaatttcccccatgttttattggatatttcgcattgtttggttccaaccgtgggttgataatatttggctccgattgcgatgttaattggataatgtgggtggggatgtagtgcggaagacacatattaatcttgctccatttggttcatgtgtggtgatggttagggctttgttggattgttgtgtggtgattgaaatggttgcaaggggttgatttgtggtgatgtctaggcactttgtaggagaagagaaattttttttgtgaataatgtgtagtatatgagttgaaacaattatgttatgttttatggaaaaagttggacatgttgataggtttggaagttttgggattgctatggtatttagagattattttcaattaattaatgtttatgtatgggttaaatattgtagatggatagattggtccggcttcattatggtggttgtgtggtagatgaaagtaccggtggaagccaatttgagggaatgattgttagacagttagtgtttcatgcgaagcctacatttgaggagttaatgtctcgcattaagcatgaattggattggagtgatgagtcagttggtatgcaagggagatacgatgtgggcgccggtgtcatgttgcataagtttatgttagacttgaatggagagatcgaatggcaaacatatatagatatagtattggggtcacatttcaaagctcttgaggtgtttgcatggaagaaagagggtaggaaagggaagaaagaacttatagacctgaatgaaagtccactcatagaataacccattagttcccacgaacagtcggagaggtgtagtaggaaggaagaattaattgaggtggaggtgggcgagggagtaaatgatacagcggatgtagaggtcagggaggaagtacatggggaggagaatgtcccggtaagggaggaagtacatgtagaggagaatgtgccgttaagggaggaagcaaatgcagaggacaatgtgctgttaagagagggagttaatgtagaggagaatgtgccggtaagagaggaacgagatgttgacgatggtcgggaggtaggtgatgatgtggagttgcctgaggaagaagcgaatgctaaggatgtaagtttgggccttagggagttggttaggctgaaaatctatacccgacaggagtgtgaggaggttatgatacgcagtggattgaacccaggctgattggagtatgatacagaggatgaattggatgagtccgcttctgactccgatgatgatcgtccagtgcgcaagatgtcggagcatgaaaggactgtgtttgagaaactggtgggtagaaacccggaaataacacaattcgaggatcttacaagagccgggctagcaattgctgatgaagatccacaatatgacggtgccttcgaaccaatgtgtgatgaaccaaggaaggggttggagttttgatcaatggaagatctgaagatatggctgcagagttattctatccgtgtccaccggccttaccatgtcaaggaatctaacgcgtcagtaaagtatactgtggcttgtctcgatcgccgttgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctcctgtagctattgtcgaggcagttgagcaaatctggcactatcggcctacatatggcaaagcttggcgtgctaagcaagttgctatgaaggtcatttggggagattgggacgaggcgtatgttcgcttgcctacactgatgcgtgccatcaaagcaaggaaccctaccatgagtttccgtgttgaggctcaccccgagaagtcaaggatggtggagggagtacagaggcgagtatttggacgtgcatattggatatttggccagtccatagaagcattcaagcacttgaggccggtgctagcaattgatggcactttcttaaccggtaaataccaaggtacattgctcatggcaataggggtcgacgcatggttacatcttgttcccttggcgtttgctctggtagagaaggagaatacatccaactgggagtggttcatcaacatgttgagacacaagctgatcggtcctaatagagaagtgtgtataatttctgatagacaccctggcattttgaactccatcaaccacaacatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacggctattgggtgtggtcggagagaggccaaagaagtggctagaagaccatatggcacttaaggtcaaatgggcaagagcatttgataccaacgggcgtcgccacagcataatgaccagtaatatggccgagagtttcaataatgtcttgagaggcattcgaaaactgccggttacagctattgtggcatacacattttcgaagtgcaatagttggtttgttgatagacacaaagaggcaactgtagatatcctgagtggaaagaagtggcccacaaaagttaaggacatgttggaggagcagcaaagacgaactttggggcaaagaacagcatgtttcgatttcccttcgatgaagtatgaggtcagcgagcaaggcggagtcacggcggctggggtgcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaatagggctgtgcaggacacgtactcccctaggtttgaaccttacctagatccatcgcagtggccaagttatgatggagagttcttcgtttc

SEQ ID NO: 18081 - DNA, 18641 bp, Oryza sativa
caagaaggttcaagaacgacatggacaaagtgtacaaaggctcagccaaccgacggtcacaaaagccgaacaatacaaattcagagccggtcatgcaaaatagatgctcgctatgccacgaactaggccataagaaaactaggtgcccgaagcgagacaagtttaaggatcgaccgaaaaagcgccgtaggacggggggaggtggtgagggtagcacacaggtgggattggatgacattcatattttttaatgttttaaatttagtttgcattacatttgttaagttcatattgttgcttcaatgtttactttctgttgtcctcctttccgttctcattgtgatttttccatttattttttttttttttgcaattactgatgattccattttcatttgcaggatggagcactttccggggttggaggatttctacgaggagaagcacagggctccccagattgtgagcggagaggttagcatcaacaatattccattttttttatggttgaatttattttttcttctttgatttgattctgtatagatagatcaaccatcatagagatatctcaaatcaaacacacacaaaaaagaaaaaaccccattttttttgttctgtttttttcacactgtacatagagagagatcatgattcatgagcctcaaagcagagcatgtaaacacacacaaacaacaaaaactgatctgaatttgtttgattcattttgaaatctcagcttctctttgtccccgttccagaacgcccaaatctgagcaggaaatagttcgatttccgtatgaagcaggtcccaaatgggccttaaacttgatgagttcagttaagctgcctgaagtgtgacacaacaaatttgatgatattttgtacgtcactgtatatctgttttgcttgggaacacaccagttggacgatctggcagcctggcacaattcatcaaattttatcattttgtttatttatttatttataacgtatgcaaggatgccatagatcttcttttcagttttctttttcctagaaaaatggcgtccatgcaacaaagcatcttaatcagataagctaattttcatatggctaagataatcttgccactgaattaagatgtgctttttccatgactttttttagtacttgggaacatgcttaccagtatggtaagtattagtgctggtttttaaaaatagtatttgagatgccaattctactggtcatacagaactagtacttagctcaagattgctcataatgagtagtagttgcttgtattacttgatcataatcacagagattcctgctgacccaatcccaaaattaaagttcccagttgcttgatatattttccacaacccttgtatatgatatattgtcgctaactatatgttgttatgtttgtctattgatgcagcgcttgaagaccctttgagttagaggtcacacggcgcacatactgttcgacgaccggtacgtcccgtacctacagcgggcgaagctcttggcgttcgtgaccatggcccagcgaccgatgcctctatacaacgccgctgctctgacggccctcgtggaccggtggcgtccagagacacacaccttccacctaccgtgcggggagctgacggtcactctggaggacgtcgccatgatcctgggtctacctatccggggtcaggcggtcacaagtgacacagcgtcagggaactggagggagagggtcgaggagtaccttggtgtggagcctccagtggcacctgatggtcagaggcagacgaagacatcaggggttcctttgagttggttgcgagccaacttcggtcagtgtcccgccgaggcagacaaggccacggtacagcgatactgcagggcgtacgtcttgtacatcttcggcagtattctgttccctgactctggtggagacatggcctcttggatgtggctgccgttgctcgcggactgggacgaggcgggtaccttcagctgggggtctgctgccctagcctggtttaccggcaactctgtgatgcttgccgaaggcaaggcggggacgcgaacctagcaggctgtgtttggttgctacaggttagttcacgcatattatgtttcgtaacatttcaatttcttgctaaaaagttggaagctaacgtatgtgacgcaggtttggatgtggatgaggcttcctgttggttggcccatgtggaggacccatcaggtttggccgcaccaggatgccgaccgacgtcccactgtagctcacctatgggaatcggtcccatctccagtagtaggccgcaggaatttggcctactaccactacacaaacgagatggactatctacagccagaacatgtaagcaattcaccattctatcacacatgaagatggtttcttactatatagtactaaatgtgcttcaatgtgttttatttttgttgctgcaggtggtgtggatgccatatgaggcacaggaagtgctcgagctagaactaaatcccatgtgccatatagaggatgcgttgaagaccctacggtgcccactgatctgcttctatgcagtggagttccagatgtgccaccgcgtgatgtggcagttcgggaggcttcaaacaatcccgcaccgtttctccacaagtgtcgacctacacaagttagtaatttcacttaaaaatttattttgcttgctcagttattttcacatcaacatttattaaatactcgagttggatattttgcatatgtgcagggtggaccgtcggaagaacaagaaggtgactgattgggcttactaccatcaggatcatatcacgcaatgggagaagttcgaggagaatggagtaccagaccagggtcagcacaacaggacagagttcgacgtgtacttggcgtggctccacaggacctaccgtcttgtcctacgtccggcctggacgctagccgacatagcggatgaccccgaggatgttgagaagcagagcgagtacgatactcgtacccgtcaaggtaccacggtcgagacgggacctgttcgcgacagagtggttagttctagcattaatgttgtgacttacttcatttcaacgccataaatgttgtgacttacttcatttcaatcctgcaggctcgagagctcttgcggaccgtcaacgatgcgggagtggcgctaggcacggctcctggctccgaaggagagggcggcaccctccgcaacgccctacaggtaatcgttggaataagagatgaaactacgttgttttcttccaaaatcgataacttaacagggattatttttgatacagagactacggcagcggtgtcagaagttggcaacaaggctcggctgcaggtcgaccgatgtggtcgaacatgctcatgcccaccaagagagggatgaagaaggggaggtgggtgacgaggagggcgagcaagacaaggaggcggaggaagaaggagatgaggaggaagaaggggatgaggaggaagaatgggatgaggaggaagaagaggaggcggatgagctcggtccctcgcagctggaggacgcaccagagtcatcacagctagatctctcgcaactcggcccgtctcgaccacgacgccggcaggctccttcgcaggactggaggtacacccccgatgtgcctcatcctcgcactagaggtaggaggaggtgagtgcatggttcaatggatggatggatggatggatggacttgatgcatggttcgatggatgtatggactagaacttttgcttgttgtgcatgaatggatggatggatggatggatgggatgtttttatttgttatatgtatggagttaatgtatggatgtattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatccagaaggcttgctgggccgggccatggccgattcggccaagtcccatccctaggtccagcgccattatggctagcgttgagttcctagcccgcaagccatccagaaggcttgccgggctgggccatggccgattcggccaagtcccacctcagcgccagcccacctggcgctgaggtccctaggtccagtgccaatgcagttggcgctgagattggccatcttagcgccgatgcagctggcactgaggtagctgccacgtcagctgggggatcggcccggccgccacggtggcacgatatcagcgccagccccattgacgctgacacgaccaacctcagcgccaatgcgcttggcgctgagtcgacggcctatttttggttgaagtttttgacaggggttagtttcgaaataagtttttgaaaagggtcaatttgtcaaaaaaaacggggaggagtacttgtgtaagaactaagaatattgtattgcttcagtttaatacaataaatcgattttgattcgttttcttataattttaaagttaaattaagtctacagataaatgtagtaatatttcttaacacaaaacaaatatattatcagaatatattaaatgttacttcccctccatatttttatgtattatgacgttgttgacattttaaccaaaatttaactattcattttatttaaaaaaatttatgtgattattatttattttattttgacttgatttatcatcaaatgttctttaagcattacataaatatttttatatttacataaaaatttgaataaaatgaatgatcaaatgttgataaaaagtcaacagcgtcatatattaaaatatggagggagtagtatttaggaaactaatttacaagtagtatgaaggggagtagttacaattatttctgtaatgatgcccacacgtaataccatatatgtcatgacagagaagctaattaagctgatcatttttatctctgctacatttgtgtagaaaaaaccgactaggggaatgacgcattggcgacgacaaaggtgcagcaaacaatgctctctctttccttccccttcattgccaagtcagatcgatgagcgccagaccacccactgccagatctaagggacgtgtcaggttcttgatgttggtggagcttcggaatagatgacgtcacgacccgcaccctctttatatttttcaaactagctaaagaaagatctgggtgcccaataaatacctatatacaaaaaaatcatttatagggtgggcctcttaacagatccacctacgaaaataaatctattttcgcagggcagcccgtcctccccctactcttttctctcctctcttaaaaaaaatctaagccctcactactctcccatcctccaccggttagcgacgacaagagcagccgcgatgatgggaggggtggcgatggcagctacaacatgagcttgagctggcgctggtggccccgtgcctagctgattcggtattgtagtgggtggatctgttggtggcggcctcatggtgtgattctggcagtagctcatgtggcgggttctaggcagctgactctgggaggggccaatccggaaatggtggccagcgcttcgaggggtggaggcggtgggctactggcaatggcggcaaagcctgggcgacgacacttcatttggtgagctctgggcttcttgtgggcctcaggagttccaggaacaacgacgatgggggagtggtggatccaccaccacggagcttgagttcaaaagtaggatttcatgattttggaacttttatttatgttattttgtgttttattttgtgaaagcagtcaatataacttaatcgtctgtgaaaatcactttttgcatacaattgtgcagccggcttgaaaaatgctgatttctacatatacctgggttcaggcagttgctctacccatttgcaaaaatgacttttgaccatgtataaacatcaattttcctcatatacctcttcccacgcatcaagcagtcaatactaagggtgtaagtgactaatccacgaaatctacttatggaccaaaataaatcatgaacccacttatttagacttacaagtaggttcgaggtttatccacttgcacgatgagccaccgcatcctcgttggtcaccacaaccgcatctaagttctccttaggcctggtttagttcccaaattttttttctaaaaatattacatcgaatctttggacacatgcacggagcattaaatatggattaaaaaaactaattgcacagttagggagaaaatcacggacaaatctgtttagcctaattagtccatgcatgattagccataagtattacagtaacccacatttactaatgacggattaattgtgctcagaagattcatctcgtggttaatggatagtgtcggtaggagtggtaataaacctaactttttaggttataaaattttgagagttgggtctaaaataaggtgggctcaatttctataatgtttctttgtctaaaaatatctgaggtacctagagttgtgaaaaaacaaaagggtcttgacccattaacatctctaagtgtccagtgtataagttgatggctggatgaaatttagaccagttcaaaaagtttaaggatgtaaaaataaacttccttccatatataaactgcttatttgttactttgtatgctagtggtagtcattagctcacgacaacagttttcagtttaatttcaccaccccactgaatagtcttcccaccaatcacggttcacaaggtaaaggtaacataggattagacatgatagtggttaatttgaacaaacatgttaataacacaaattaaaactggtgatggcaacactttatttaatattaccacacattctgcgtgcaatgcacaagcttatgaaacggcgcttcactcaagtaagttttacgcgcaaattaaacatcacgaaagcatatgacacaacacgctacgcatagatcgacaggtcagctcattccaaatacacgcgatgtagaagaacaggagcaagcaacgcgtctgatgaaacacttctgatgaaatcttgtgcaacgctcttccattttgaaccagctattttgaaccaggaactgtatttgaacagacgaaaatgatttactcggatttccaagacgacaagggaggggtctcagagtcctgccaagtagtgttagccatcatcagaggataccggtcgccatggacattgctagcataagactcgagttcagccatttctgcaggggtgagtttcacagatagtgctgcaacattttggttgaaattctcgatttttgttgtcccgggtatggggcacacatcacgcccctgatgatggatccaggccaatgcgagttgtgacggtgtgcatccttttctggctgccatttcgttaacacgctcaaatatttcagcattcttctcgatattacctggttgaaatctagggataagctgcaaaaggcaccaatacaagttgttagttaattgaatgagaattcattatagttctacttcatttttcaaagactaaatagacgagacgtgaatatgcagcacaaagattagcttaattggaaaaggcttatgtccgatcaatacaaagtaaaaatttctaatgaacataaatgtaatttgctctactgaacatataagtgtaatttgtactaccgaatataagtgtaatttgtactaccgatgcagaagtacagaaaatgagaatacagaagaaggtacatatataataattactcccatcatccaaacaacaaggcatataattatgttacaaggtttcaaaatataaggtctgaatgcctatttaatgatctttcttctcgtttttcctacattaatcattcatttctactccatgtatgagtaaactcataaacaagatttgtttcaagaaaggaaacaaattaatttctgttcttcttattctaaaagacattaacacgacaggtatcacagcattttccctaacccgttctgctattttaatgacctccttcaaagccattcttagggaaaactgagtgattagtaatcatggaaatataccttgcgaaaatcatggtctggtagagaatccactagtttagctccactagaaaaaaaccctttaccaagtggactgtaagctactattccaattccaagttctctgaaatgaaaattagaaaaatagttaaaatgcagcatgtgatttttttttctcaacagacaaactaatttgttttttcaatgcctgcaagttggaacaatatcttcttcgacgtctctagaccataatgaccactcaagctgaactgcagtgataggatgtacagcatgagcccttctgattgttgatgccgatgcttcacataagccaatatatcttatctttccttcttcaactagtttcttgagttcaccaatctaacaatgtgaaagggaaatcaactggataatcttgagaagaaaggtcattacttaaaaggagtgcatggttctcaggacaaaaataaaagatagttcagtttatagacaataattacatgcaacgattatatttgtaaagaaaggcaaaacaactagataatcttgagaagaaagattattacttaaaaaaagtgcatggttctcaggacaaaaataaaagatagttcagtttatacacaataattacatgcaacgattcgaaaatatcaggagtaatagcagttcaggtgctacctcttatgcgctatcaaaaagatatagcacaccaaaatgatgaaaatgcatgtgttggtggatatgttctaataactattgctagtttgtagttaaatattctgaaagaaaagaagtcttcttcactgaagatatattttggttcatgtatttcttcattggtttttcgattgttaaactttgaaatgttgggttggttggtggtggttaagatcccagctattacaacaaccacaatgtgtgttgtaacttcccagtgatatgtcagtgaatttactttatgttctttacccttcaaaatcccacagctaatgtctaaaaattgaaaccctgccctatatctaaaaaaatgcaatacataaagggaaagaaaacattgttaaattatagaaaccatctgtcacatagggagtactgtaactgcccagtgacatgacagttacaatggaagatattcataagatatttttcacgcatttgtgctaaacagagagatcttaaggcaaataatattgtacttcatacctttataaatgtatgattcaaacacttgttatgaaaaaacaaaaagaaatatatgcttcattttgtattacaatgaaaaataatagcttattacaatgaaaatttaatacatgaggttaaaaaaataacgacaaaaggacaggtgccagaaaatggagcttgatttggccttccagaattcaggccaagttgctgccggaacaaaaagtcattgtacaattaaccaaacagacgtaggattttaagggtgcatcgagccgggttaaattttcctcccttcaaaattgacgtctcctacattttgttttattttaacgaccaataccacaaagtgcgatgattcattaaatagaataggaaaaaaaaaggctagcaccctggaaagcagtagctaggaaaaaaaacaacaccaccacgcaccgatgatgcctatataggatccaagaaaaggctagcgtcgtcggactggccgccgctagactaataaagaagctaccaccaaaccgcccaaaaccaaaacctaaaaagtgaacaacacactcaactctatacgtatcaaaaggattggaggggagagggaaccactctccccctcaaggcccaccaacatggtcagcttgcattggctaggtgctgccgcaagcccgcaagaggataaacatctagagagagcacgcgcaagctatcagagagaggtttcagcaggggggcctcctagacgacgtctccaaggagaaaagcgacagaacccaagagggaaaacgatgtccgaaacgccatcacagccggctggcaagaccaggctaggttttacacctgccacgcactccctatcgatccgcggatatcactccattgctccaccaccagccatcctccatcggcatgtggccaatactacaccgaccccccttccacccctggtcagtcagcctcggcatgccttgtggcacacaccaccatcaccggcctcattgttgtcaccgtgtagacctcccgtgccgtcggctgggctagcctccctgcagttgcgcacgccaacctcctaacgccttttgcgccgacccgcccacattgacctctcccaccattgccccgtcaccgccaggcgtgcctcctagcgccgctgcgtcggcctaccaccgccaccagctgctcccaaccagcaccacgcttcctcctatccctaccattgtttccagtacctttctcccgccgacggcacttcacgagcgtgccctctgtcgacggcacgtcgtcgtgcccttactgcctcgccccgccacctccacgcagccgtaccccttcgccttgtcatcgttgctggctcaggagttagcttcccaaggcgaggaggcaaaatccggatgggatgggaccagatttggcagctgcacccctgcggcctccacgttcacgcctccgcatccacgtagccgtgccccgctgtcttgctaccgcatccggcttggggaccgacctactgcaccggggagcccggatccatccaggacggggctggatataggagtcgatgccagatccagtggcgccgccttgccgtcgtcaccccggtccacctaggcatcgacgctaccactctcctctttaacgccggcagctccatcctagcaccattatggctgtcgtcacccggagctagtcggggtcgtgggctccgaccccgctaccacggaaaaggaaggcctcgctgctgccgttcttgtggccgcacggtttatggcagcccgctcgaccctgccctagagagcgacacggagccgttactaataatgagtcttatagtttgttttcagcaacatcataatcctccctccaattagtttttccaatgatttttttgtgtgtttggcgggtgttgagggtgggggcagggggcatcaataaaagatgtctcttgacaacaacctaccaccacctacattccctttcagatacagatggatgtttcacttacatataacaaaataaaagaaagggaacacaaacatagaggggaaggggcaccgaccgtgacctcgatgggcaccttcttgtcgacgcggtgctggtagtaaaggtcgatgcaatcgacgccgagccgccggaggctgccctcgcacgccgcgcgcacgtacgccgggtcgccgcggatccccggcttgccgccggcgaagaacttgccgaacttggtggccagctcaaccctgtcgcgcacgccgccgccctgcagcgcctgacatttcgtcgagcaccttcagcgcgcgctcgcgcatgcacaaattaagcccaacccctacccgagcaatggcggggacacagtggagaggtaggtacgtaccttgccgaggaggacctcgttggtgtgggggccgtagaggtcggaggtgtcgaagaacgtgacgccggcggcgatggcgtggcggatgagcgccaccatgtcggcctccggcttgggcggctcgaaggccgggcacatgcccatgcagccgagcccctgcgccgagacctccatcccctgagagcccagcttcacccgcggcaccgccaccgtcgccattgcagcagctgccattgccacggccgctgtacttcttggctgatgcctatatatatatttttctgctgtgtgtcactcacttatataatgctgcacactgggagatggaaaaatggctatattcaagatgattgaacatttcaattgctgctgctgcaggcaggaccaaacatgtcagcatcgaccaacaactggctcactctggcctgcttctgaattttttgttgacgaataccaccctctctgacagtctgactgactacctgaagaagataagctgatatcctgtgaagcagatagatctttaaatttgcttgtgaatttttgttcactgtaggttcttattttgatggagtgcacatatagttttgacagtggtgcagtagctcatagcttacacatagctgaagctgagtacacttttctttggtttgaatcatatatatatactgcaagatgtggattttaatgcttcggtttcaggggaaagtgaaatcatcccgatatcctctcgtttcgtgcatatcacctaaatagtcatcaaaaaatatgaaaaaaaaattggcaacatagactaatatgaaatatatcaaagtttaaattcaacttctacaagttgtaaaaaaaataataaatatagttgcgaatgtgagataactattttcagtttaatttattatttttgttgcaacttatagaagttgaatttggtcttgtatgtttgtggagtgatatatttcgtattaatctatgttgtcaatttttttcaaattttttaacaactatttagatgacatgcaaacaacgaggggatgtcccctagggataaaaatccacatcccggtttcagatatgtttcagagatatgcaactttcttaattagctggttcttgtttgtagagattaagaaatatagaaattcagacatgtttcatgccaaatgcaggtactccatgtccgagccagcttcctgatataaccacactggattctgatgctacatccgaggcggcaacttctagtcgatggggctccggcactttaaagttacaaatagtttccatttttttggcagaaatttgccatgtgagtatgacgaatttgaattccatcagtattatggaatagtgccagtagagtgatctgagcatgacaaatttgtactttgtcagtatgatatatagtaattgtttccgtgatgccgattggaataatggtggctgctcgcggatggaatctaaatgtcagtttgtttaattgcatgtttcttcgttctgaatgacaatctgaatgtctgaacaagtgccaactgccattgcattagtctgaagctactcacaacctagaactacatgagtgaaattgaagctactgattgcatgagcaatctgaatatactgaagctatattcagatatctgatgcttcatgagcatcatgtgattttttttaatatactgaagctaaactgaaaatgttctgtcttttggactcctttcacacatcaatcaaggtttcacaataattagtactccaactaaatctaattactcaatacttcaattcagaaaaagtacattcagagagaatataatactagtacttcagttttgaaaaaaaaaatatttcttgtgtcagttatttcattgtgtatgtaaaactgattctaatcaaaacactgctgttcaatccaattcaattactccaattcaacaaaatctacaaacttcgctgctcgtatttgaaacgagcaatccagatcatctggcacatatcatgtgggactggtacatgtcagtgagcagtactgcggagtaccctcactcttgaaacgagtgatagagacggtcgagaagagggaggaagaggcagcagctagtggaagtggttggcgagcccttgaggtgttcattctcaacgcaaaactttccggattcccaattaagcttcttgggccgtcgtcgttggagatcatcacgccatcctgcagcgacaactgtttgctgttgggtttcccggccatcaccggcgatctgcggcggcggccaccgcggcatcgacggaaactctgccactgattgcaaaaacatcaacacaccaacaaacctcgatgttagttaaaacatcactagctctcccatatctatgctcccgcctttgttggagtggcgaaaaagtttgttttttttttaatcaagatgacatacgcccatgcattaagattttagaacgtgtctatctacttccaacgaatatttggaacagagaattactcagaaaaagagaattattttttttctaatccaccatgtcggcctccggcattggacgggccgtagaaagcggacatgcccatgcagcccaggcccactgcgttgagatatccggcccctgcgagcccagcttcacgtgacgtgaggcaccgccactgccgccgtccccgagaagccggctgccgctgccatgcatggctggccggatcagtcgatttcttactttgtagtgatgctacctgggctctgcatggccactcacatatataaggttaatgctataacaatgtaactgtagtatgtaagggtattgtttagaagagattaagattctaaaaagctgctggttggtaatcagtttttagaatatagaaaagtcggggttcccagcttccgactttattcttttttggattcaacagctatagctttttaggatctaaacgaaaatgtcaactgtttagagagcttatgattataagagaagttgcacctgccaaaaactttctcaaacagatcctaagcgtcactgcatgggtgggagcaggagcatgtgtaagagcttatgcgtgcgacgtgactcgttttgaattgctaactatcacccgtagggctatcaaaaaaagctcgaggctcgtgagtcacctcagactcgattcgagctcggctcgaactcttaacaagccgaaccaaagcctagctgcaagctcacgagttttgtcaagccaagctcgagattcttatgagtctaactatgtgtgtaaattttttatcttttatatgataagttagtagctcaaggacaaattagtatatattcatgtgaaaaattagtgtattttggcatcatatataactttatcttcaatattattgattaaattttttttactaaatcttatcaacaaaatatacattatcctataatcgatcgagctcgcgagcctaaacgagctcgagccgagcctgcttaaaagctcaaaagagaattaagctcggctcgagctttgtcgagcttgagcccagacgagcaagctcggctcgctgatagccctaaccattgacttagcatattaattgctcctatagttttgggttatacgacaaaaagtaggtaaacctctctttcttactgtcaacgtaaaccagaggcggatctaggaacaaaaaattaagggactcaattatacagtttcttcaacctccagccatttaggaagctttagtttatcattcatggtgaaaaaattagagggggcgctctgcgggtatatatccatgggtcttgtgggtgtaggggaacctaagtccccctgcaccacgttggatccacccctgaacataacagctggaaggaacatttcaatttgcaaagtggccatcctgccttgaattttccatcttagacacttccctttctaaacgatattgcatataatcagttaactagttactccgtgtgtcctgtgtagtctttggactaaagatttgtccctagagtttagttttatagacctcttcaatagtaattttatcgttttcttctcgttatcaaccattgagacactttaaactctgtaaagagacttcttagaataaaaatatatactaaatgactaaatataagtaactgaagacaaatacatataagtgatgacttgggattgagttggttagtgccttgaagataagtatgatttgtgcaattgatcatgagttcaaggattgcaaaaacaagagaaaatattttattttattttattttttcattaatttcatattattgtggtacaatttaatgtatctagaaaatgcctctaccatcttatagacattttataaaatgcctcttcgtttgtacagataattcaccgtaaggcaattattagatatttttttaatatatctctatagtattgtaaaggcattttaaaagtgtctctatagtattagaaaaatgtctctacaaagcgtttttcctgtaataatgttcggctggaaattccacacccatttcctaattaaaaagcaacggattcaatatacctatgttgcagcttcatttgtactattaaaaatttatcccacaaagactatttatagcgttatagcctatcaagttagagcaggtacaatagggttcagatagctggaagaaaaaactccacgtaagcatgaacgctgagttggcgaaaaaagagaggagagagaccatcagttgctgactaatttgccactagtgccacacgcactctaagaaaaaatagtctcaccatttgatctctgcaccatccaaaagtgagatagaaatgaaaggaaagagaagataaagtaaataaagaataaaacattatttatatggagagatgggtaaatgtattagagcctacctactgtatgtacttgcttttatattatatttacctgacgtgagaaggattggagccagcagcgagcgcttttattagacttgctcttaacacatacacatttagttgaagcctagaaaatggtaccaagagtactaaaagcaaggtaatagtaagtaagtcaactatatgcatatgtgaaaaacagagatttattactcaaattaacagactcataatcggtacaatgagcaaataattattgcaagctctcgataaagaacaatctattgttcaacatggtttgggtgttgccagaactgtcattagttaaaactagaacatgctaatttgattcatgtatgaagatcgcatgagtttagggtttatttatggactgctctatgtggtgttctaactagttttaacacagttgagatgaacatatacatgctcggttttcaaataactgaacaatttaactttactattataaactttaaccaataattacttggacataatacacacttaattatcagtgtattttattagtgtctgtaaatattttgctaaaaaagaccgatggtgtcaaagctcgaaagcagtatatattcgctgactaagcagtatatattgagtaatatctttttttttttggctaggagtattgagtaagaataactcctgtcaatcggcaaaacaaaagcattttcgtgtgtatgcatggataaatagatagtttattttaaacattgagatgatccttcgccctttgctttaattaaaaggctataaccaattattgcataggctataggacgaatgactgcgacttacaaattcaccatttgattaaaacaagaaagctatttaaactatttagaataccaccttaaaaattagatagcaaaataatactcagttgctgcatctatcctacgaagccggccggctgcatggacagataagatactaatataagagtacagagagtacaaatgcttacaaataaattatcagctgagccggctgagagagagttcatgtatatatgtgtgtggatcataaaaagctaagagaagaagagggagcgtacagccttggtgaaaagggtagtaggcgtcgcaagtacttccaccatctaacaactaaaccgcccaaagctgtactctctctcttctccatttagccttcacgatatgatcgtctatcgatctccttctcttagttgctctagaagttggatccctctgggtttatatagcacactagcatcggcaaaatgacactattgtgacgaatccatttattgtaatgcaacaggaaattaataattgcaccctccatcccaaaatatagaatcggatggaactcaacttagtactagattcatcgtaatatgttgagttacatccaatcctatgttgttactacctccgtcccataataaatgtcgctttgactttttgcttacaacgtttgaccattcgttttatttgaaaaattggtgcaaatataaaaaagtataagtcatacttacggtacttttgataataaagcaagtcacaaacaaaataaacaatagttccaaaaaaatttttgaataagacgaatgatcaaacattacaaactcaaatttaaagcaccaagtaatatgggacgaaggtagtatattttatgagggaggtagtaattagttagtcaacatcatcttttttttctcgttcccgccagcacatatatacatacatacggagaaaaagggttggtagagagagcatcattaatgtgtgtaatgtgtggtgatgtggtaacttctaactagtatttaaatattaatataattcatctgttttcaaatacagctagatataaactaggactagataggggtttatactagattgtatttaatctaatagtgttaggtttctatatttatattttaggatggaaatgttatataatatagttacattcacttgttcatgcatacgggtgatacaagttatacttcattaaaaaaaaataaagaattactacgaagtgagcgtaa

SEQ ID NO: 18082 - DNA, 4726 bp, Oryza sativa
  unsure (1)..(4726): unsure at all n locations
aagtcgtcagcgtgtgattccaaccgtaaacatttctaatcgcttgggctaaaaaaccaaaatttaaatttttgaagttgattttaaaattggttttaagatatttttaatgtaaatttttttaacattatataaaaaatttacgtataaattaatttttattttctaataaaccttttgaatttattagggaatacgagctgccacgaggctctgtgtgtgcatgaccagtttcattgtccttggaaaatataacaatggctagtagtgtcacgtacgcgtgtgatggatccaagttgggcatgtggcatgcagtgcaggctgtagctaaggccattccgtcgtttttcgcgagcctccgggctaacagcagccgtccaaaatggccggccggctttggaattggtccatcaactagctagctcaacactgtacaagccgtaaattttttaccaacctgcactacaccgatcctctgcactccaccgatcctctcctggagtttgcattactccctctgtcccattataagtgacaccgtaagttttcgtgcctaactttaatcgtctatcttatttaaatttttttataattagtatttttattgttatgagatgataaaatactttactcatgacttatgtttttaaatttttttaaaaaaatcttcaaataagatggacggttaaaattggacacggaaaatcatagctacatttaaaatgggatgggatggagtacctaatttcgcattacccaaaagggcatatccaacaacctttgtaatggagataacgatgagaatctttaaaagcacttgagaatctaaacgtgtgtttggttcggaatgagttgagatgggtcacaccaatttatgctttttatggaatggttctattatcttttggcatgagattttttttagagatgggagggtatagccagcatgttattgaaaaagaagtgacttagattagtaagctacttaagcttagttagataaggaaacattcccattcagaaatcaacccatcctacctattctcaaactgaacaccccgaaaaataaaaatgaattcccgtcctatcccatcccaatgttcacatgctaaactgttggcaacagctttttcacaaactacctattctcaaactaaacatccttaaaaataaaaataaattcccgacctatcaaaccaaacacccttaaaaataaaaataaattcctgacctatcacatccactgtccgcatgctaaactgttgggaacagctttttcaccaatagagcaaatagattgaggcatggagttcatagaagcttgtagagatctatttagcacggactccagctcttctggaactagagcccaaccaaacagttttacctctacaaaataaaattggaactggatgaaacactctcacaaaacaaactagaagggtggagttaggtttatactactccacaactccacgactgaagctaaatttaggagttgaagcattctatctttaacaaaaagagaataaaaaaggcatataagcttttattgccggaatgcctatctgtatataaaaagagagcttttgctcaagattactatttgtggattccagccgttcagtatgcagtgatctgttcacagcagctattcgccaccaccagatctgcacccacgtttctgatctcgcacagaagaatttgcaaccaagttgtgtgtatagcatagtaatgtttaccagatccaacatacaagctcactggaccgtaagaatgccaaggcttattccaccagccgcagtcccaggatacagagacatgcttaagcaatgttaacaaatggaggaccaaaattcgaccgaaaaaaaagaagagaaggaacacatatctcgactgtcgtattgataatccaccaacaattgcccaatcatatacactctacatttggagaccttcctaaaagatgtagctgtcaccttggggcttggggaggttcgacaacaagcatccatcaaccaaaaaggagatgagactttggatcaaaacagtatgacaagtatcaatatagctcccaccatgacccactggagaaatgaactgagtctgcttctctcccaagaacatctgtgcctcaaaattggccgccaaaaacaactaggccaagcctgcaaaagaataactcaccgcctgcgatcaccgaatcacaggatactgaccagtgccagtgtcacggattggcaaaactggagaaacaaccaagtaatgactctcttcactgcgcattcgccttttccaacttctctttctcaatttcaacttttctttcctcggcatgttgagctaagccattcgcgagtgcctggtagcggaaatctagagtctgcatcaggctctggaacctggctggatcagatgcttgcatacctgtaacagatggtcactaacttgtcaggtaacttcagccatagtagcatagagtaagcacaaacttgtacaagaatgctgttttaccttggatggtatcaacaaagaagatgaatgggtccacctcatcaattggcgattgcaactcctcatcatcgctaaagtcatcatcagaatcatcatcgtcgtcatcatagtgcggctggaaacctcttgcctaaatcacaggaagcatacaaaaacatgagtacagggtacagcataaacatgaaacatttacatgaaataaagatttgaatttcacaagacactatggtaaaaaattagtctagggaagagaaggtgacactttctgtggcgtgctaaaagaagacagcagcaagctcaaaggccagcagagaacaaaggtgattcacgagaaatgtgaggcgctctaatgtagtttttttaaaaacaaatataagggcccctttccccccccatgatggtgccaaacccctccagaattgattcaggggttggcttagaccgtttagcatacttcatggatagatttacacaattttatagtttaggggacaatagtttacaggtttaaatagagcttctcctttttgtttaactagcttttgtgtgtgttatatatgttacagctactgcagtttaggatataaatggccagcaaaacaaactcaaatacactttgttatatatgcaacaactatgcaatttgggattaaacattgctagcaactcaagccgtatatatatagtaatttagtttgtcagctgtaattgtcattattcagaattcagtgatacaacatccttcatagtcaataaaacataagttaatatttatttaaagggaagtatttgtgttactaactttactagtccttttgttgaggggaaaccagactgaaaacacttgttaccagagaccgtgttagttctattaaataataccccatgaaaaacacttgtagaaaaatttaactattttgagcatctaaataaaaaggaacacatttttacatgctaattctacttaagtccatatcacaatacaaacctctcttagtttctgaagattgacactagatacttcatccccatcctcatcatcatatcccatctccttatcagactcaatatcctcatcttcttcatcaccatcaaatccatccaaatcttcagctgcagcctcattttcccatttagattctgcttatgaacaggaatgattaagatcaggcaaaaggaattttaaagacctctcctctacatcgtaattgcaaaaaggagacataagattagaaaattttctcaggtcaacatgttaacagaatggtatcacagagtttttgttcgaagtatttgaattgtcatatgttcatcagaaaataaacaaaagataaaattgaacctgcaacttgatccttgtaagaaacaagaagctctagtgttgctttgaaaatgcgctcaagagcttctggtggaatgtgattagctggaaggctaattagtgaagtcaatcccaagcaacaaaccttcttatcatgttctctgcaaataaagaaaaataatgtacggagtcagtgcagcataaaaacacaacatgtatagtactacaaggtacaaacatatgctaacaagacctacctcttaaagtttgcccttatgccacttttctttacttgctgtaacatgccaaaccaaagattgaagatttcagtagcaactccaagcttatgcaatgttcccaatgtcaatgaaggattgtagtacagtgtattagctatctgcaatcacagtggaaagttttaggtatacatgtcatcagttagcaagagatacagatgccatgtttgaacaaacatgacactacagtgattagattgatgcaacatatgaatatggactaccacattgggaagtgttaggtaaatgcggccaacaaataatagtgattatatgcagttgttctgatggaacataactgaaaattccactgctaatgactaaattgacctatgatattgatcggccagatacagatatgagtttgccccatgcaacatgaaaacctatgttccttgaagacactataatcaaatggttacatcgctttccacaagctggctactgtgctgtctaagctatccctgctttatccctgctttatccctatgtagaaaaactatccctgctttatctataccaaatgacaccctttttgatcaaggagttataaatgctgtctnnnnnnnnnnnnnnnnnnnnnnnnnnnnnnnnn

SEQ ID NO: 18083 - DNA, 330 bp, Oryza sativa
atcagtttcgaccgttaatattaccaaaatagaggagaactagtgatgcttgcaatgcatatgtttgttagaataataatattccactagtattaggtatactaaccttttgcagagaatgacaataaagtggaggagaatcgacatcaactcaaacgataaatcaatcggacgatgtcgaaaaccagacttatgtatgaatgggccaagaactcagaattgacacaacaaattgggccaaaattcacaagtctgcggagaagaacaacggagaaggccaccagccgaaattgggctggatcgggccagcaccaggttcggcaggtggcc

SEQ ID NO: 18084 - DNA, 698 bp, Oryza sativa
attcctgcagccccgagccgctggaggctgccctcgcacgccgcccgcacgtacgccgggtccccgcggatccccaccttaccgtcggcgagaaatttaccgaacttggtggccagtgcaacattgtcgcgcacactgccgacctgtagcgcctgccttttttccaacccatatgcaaacaagcattccgtcatattttaatatatgacgctgttgactttttatcaacatttgatcattcattttattcaaatttttatgtaaatataaaaatatttatgtaatgcttaaagaacatttgatgataaatcaagtcaaaataaaataaataataatcacataaatttttttaaataaaatgaatagttaaattttggttaaaatgtcaacaacgtcataatacataaaaatatggaggggaagtaacatttaatatattctgataatatatttgttttgtgttaagaaatattactacatttatctgtagacttaatttaactttaaaattataagaaaacgaatcaaaatcgatttattgtattaaactgaagcaatacaatattcttagttcttacacaagtactcctccccgttttttttgacaaattgacccttttcaaaaacttatttcgaaactaacccctgtaaaaacttcaaccaaaaataggccgtcgactcagcgccaagcgcattgg

SEQ ID NO: 18085 - DNA, 711 bp, Oryza sativa
tcctgcagcccaaccgggactaaagatgggagcatctttagtcccggttggtaacaccaaccgggactaaagatattttttctttttttttctgcttttaatattgaatattgatttcacaccatcccctcccatatccaaatcatcacatattacagaacatctccaaatcctcaaacaaatcatctccaaatacattacaaactcttaaaaaaattccatcacagggttctaaaaaattcatcacagattcacatctcacgcaaaaatacatcacagattcacatctcaaaaaaaaaagaaaaaaaatccggccggcggccactgccgcctcccctcctcccctccgcgccggccggccagcgccgcgccggttgccgccgagcggccgcccaccgcagccgccgcctccgcgcagcctcccgcgccgccgtgccggccgcccaccgccgccgccgcgcggccccccgcgctgccgcgccggccgccatgcaggccgcctccgcgccgtcccctgcgtcgccgcctccgcgccggccgcctgcactgtggtgaaggaaaaaaggaaggagaggaggggagttagagataaggaaagagataagaagttagagaggaaaaaaagagatagagggaggagtttgttgtgtggacgggaaaagaggatcggtactatggattatatagtgtgttttgatctttagtcccggt

SEQ ID NO: 18086 - DNA, 11198 bp, Oryza sativa
  unsure (1)..(11198): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaccaaattttataattggcataagggagaaattaaattatcactttgcacgggttgcttactgtagtaacttcttttagatgcatgcatataggactggtttggtttgagatctaaattaggcttaccaatatttatcaatttcaatagtatttagtgtctatttggtttgaagccaaattttggcatgcctaaaaaataggccatttcaatagtgaacttaggctattttggcttcaatccaaacacaactttgctttaccaaaattagtcatgctaaaacttgccaaaatttagtattgacaaaatttagtaagatgtatttaggccacaaaccaaaccaacccatagttacctgaacaatggcgacgtgcaggagcgtcccgcggagtccgatggcgattgacgcggcggccatgacggcagggcccgcgaggaagcggacggccatggagacgacggcggctgatttgccacacgcgatgatgctgggctgcagcgccatgaacaatcctggccacgagacagtttgacagcgttagctcgagcgcgggccagtgggcaccagtgcgtgtgaagagggattaattgcggagcaatgcggtgtagggctacgggaagacatgagcacaaggggcgtgggcacccacccaggctaaacatggccatccccaggcctgcgtccgagagaatggagatggacttctcgacgattgctggcatggagacgtgccacctgtgacccatgaacacattgcccgttggttagctcccggaacagtaaatatcaacatcattagccactagagatgataaaataacaacaggtgtgctcttatgatgattagtagtagtagtagatgcaggttactccaaaggaaacggggccaatcgttcatggttccttgcttggaaacgctattgtgtgactgtgtttggtagactggctcgacgacgaccagtgctcgcgcgccgtgcaaattctgcctttttcagctcctacagttcgcgattggtgccgaccgggcccgcggcggtggtccgtgccggcgggaaactcactcacctcgtcggcccaccaccgccgtttggggatccgtaaaaaagctgcttttcggttattcccaccgccacggcacgtacgcccccgggcagtttcggtgcttcctagcctaccgcctacgcgctacccactccctctggcttcgccgagaataatatcgctctcgcgcttatcatcaccaacaccatcgcggtcctcgatcctcgccgaacttgtcgtctctgtcgagtgaaatcaccttatcacccgaactaacttaggcagtagaaaaaatgagtaattgcacaggtcacgtgaaaaaggtaggttaatcttcggagagagggaaaaagaaaaaacggcgtaccggaaggcgacgagggaccaggcgaggccgaggaggctggagtaagtgttggggttgcggatgagcttgcgccacaccattatgaggatgaggcgtgtcatcacgctcgccggcggcatttggtactgccccgcgcccgcggcgccgccgccggcgttcggtccgtcgacgtcgacgaccttcgggtgcagctccgccgtcgagctcgaccccatcttcgtcagcccgtcaggcaaggccgcctcctcgtctactgcctcggcgccgtccaccgtcttgccgcctccgaagctgaagttctctccgccgccgccgccacccaatgccactgcgccgtactcctcgtgctctgaaaatgtagaaaatttgggaaggtctatgtttagagttgcacatggagcccgtgattaagtgacagtactactactgcggcattaatgtcgggacggacctttgcctgagccgttgttctgcggcaggtcggcggggatgaccatgtggatttccttggcgccgacgtcgagagcgccgccgccgccgccgccactgaacacaggcaggccgctgacttctgagacgggagacgcgctcgagctccacacgaacatgtggagctccttggcatcgtggttgagtgcccccgtggtcgttgccggtggtttcggcggccgtgccgagtgctcgtcgaagttggactgcctcggggttgggccccgcgacgattgcagcgagtagagctcggaggcgccgaagctcgagccgcgcaccgcagcgggcgtcgggggcggtggcccgccgccgaccatggcgaagaagtcggcgtggttgaagttggagccccgcggggttgggttccgcgacgagctaagcgagtagatctccgctcccgtcaggttcgacggccgcggcgtgaccagcagcgaccgccgcgacaccgaggaccggcgcacggtgacgtgcagccgcccgtccgccgccacctcggcctccgtctccgcgtggccgccctccagcgacaccacgtccgggtcgacgtgcagggacacgatggacgccgccgtgtccgggaactggtcggcgatcagcatccgcgcggcgcggaactcgaagaggaagagcatcagcgtgtaccagatgatgcactggagcacgacgatctggaccatgagcgagccggagtatggcccgtacatggcgatcagcagcgggatccccatgacgagcgtgttgggcagcgtggagagggagaagagcgtgatggaccagtccagccgcggcgcgccggtccgcgaggggaggcgcgaccacgcggcgagccccgccaggacgagcagcttctgcagcgtgtccgccgccaggaagcggaggttcatggcgtacgggtcgttggtggagatgaagtggaaggacaggagcggcacggcgaagatggcgacgaagcggttgatgccggagcactggtccggcgtgaagatgccccaccaccgcaccgacccgtacgccaggaacatcgccacgtacagcggcaccaccgccgccatcaccgtgtagaagtcgtgcccggatatcatctcctcagcctatctcaatccaacgcgcccggcggtggatcgagtgcctgagcgagctagaactagctagttatacatgcaggagcggccgagtggagtggcttcttgctaactcggagaactcggggtcagccacttataggctgcgtccaagtccaacgagcacagagttgaggagcggtctacattctcccgtcatccaggctccagggtggattttactgtaaaaacatgagagattttgaatgcgcgatcgtgactgacccaccagtgggcgtgtgcttcataagaaacgatcaatgtttcgctcggaggtgcaaattaagcccgtagttcatgcgcgcacatgtacaagctagcgttgtgatacacaatgcaatgggtaccgggggtatatagattgcatcttggcgatggatttgcatcactggatgcgaatagagtcatagaggcattgctgctctgaagatagatttgcattgctccgtgaaaccgatcgattgatcttatcggttatgtacgtggtgggctttttccgtgactatgcaagctgatgatcgagcgcgcgtacgggatactgcagaagttgtactgttggtttggtaccactgtctgcacttatccggctctcacggtgccccgaccgtccatgaatgtttggactcgagaacactagctactccagctagcagctactccctccgtactatattttgggacggatgtagtacaacaatacgtgtgaaagactagtgttccaatatgcaaataacagtagctcggtattgttgaagtactatagcaacaaatcaacaaagattggattagttaaactattgaaattgcgcattttagtgtcttcttggtttatacatgaacaagtgctatacaaccgaatggcgaatggtaaactcgtgcaagatcgaggggatgttccctcatataaatttttctttcaatttcgatataaatagttatgaaagattttttaaaaaattgacaatataaagtataatgatatctatcagtccaaaaaaaaacaagtttaaattcgacttacacattgagaaaaaaagtgacaaattcatatatgaacattatattatgctactattcatatgttggatttgtctcccttttttatatctcgatgtgtgagttgagtttagataaaaaaatttatggagttgtatagatatgttgtatgagtgttatcatatttttttaaaaagaaattcataaccgtttggatggtttttaattaaacgaacaaggcaatatcctcttgaggcatcaaaatagtctcccgcaagattacagaggtttgtctatggatcgccttcttgagagggccaacgaggtacattcttttgtgttgaatggctgaacggttaaatagctgaatgatttgcgaattactttagggcacaaatggatatatttagtatcataaagctgcatactggatttaaaactttttttatgaaatatatgtatgaattttttttacaaaaattgtaatgtttaagagcatgatcgagaagcgtggagtgtggacatccatccctcattctattccttaaaaaaataacaaggcaggctggttgctagcttgcatgaaagagaatgtggccgattgacttggggaagaactctattttaatgtattgcaaaagattgcgcttggctagtgatgattgcttaatcatatgctaagatgtacttatctccgttttcgtgggacaaaattttaaaatcttaataattcattaatatacaaaactttttatattaaaaaatatcaatagaattgtcatgaaatatattttcacattgatatagttttatttcgaataaacacctaattaacaaaaaaaatgtattaaaaactatttgatgtccaaaataccaaggaaaaaggaatatagggacaagggagagagtatgtacgtggtacattgtcacacccagattatgcactgccgtacaacaacacatgacaagggcgtgctgtaggaaaacggcgtaaaccgctccctacgagaccaagataccaataccaatcacatgacacaacattggtactcacagaaacacttatgaatcattgtgatccttaatttaagtggaaggaagcagcaacgacagctgcggacccaaggactaactcccaacaccacatgcaagcaacggttgtgaaccaagatgaaacctaattttcatttcacttcaactttacctttagagcagagagaactatatatgcatagagcaagggtgggtatttacgtacttaacaagcctgggaaacttaggtgttttatgcaaacttttaagggatgctggctattttgcaattgggtttgttttaagggttaattgggcccataccactacaaatatgacactttagataaatgtcactattattcacgatatcggctatgtgccactgcaatttggggaaattgtaaacggtggcactccgtcatgttttccgtcctcaatgtgggatccacatatcagttccatgttcctccatccgcctcttcttttttccgcacgtccggttgaggctaacgaagatttttgacggaaaacgcgacagagtggcacggttcaatttccccaaattccagtggcacgtagccgatatcatgaatagtagtggtatttatctaaaatggcatatttgtagtggcatggatacaattaacccttgttttaaagctttgaataatataagtgtttgcttttccacaacagagaaagacaaagtctactgactttccaagtttgcacaagtagcagagttggcctcaaagcgagtttcctgagccattccatttcagtactcctagagtcccatagttcaagacatccatttactttcatggacttcctaagtcccctgtctccctgatagccatttatttccagcccaagcatcacgtttcccaaaccacaacaatgtttcacaaagcacaatataaacaaaaactatgctaaggaatcacttcacatccgcccatgacccttctacacagtcgtttgaacaactagttaactctatagaggggtacactttacccccaagctgacgctactaactgggtcacacaacctgtgcagaacatccacatatgatgactttgaggctttcatgataaggcattttgaaagatgacacaaggttacctcatgccaactaaaggggtccttggactaacaacaggctagatcctagaccatgctagcaaggaatcccaagggttctcctcgacaccacctcgacgatgcagtccattggtattcaaggcttccctggcctagctagttccttagccgggagtgttccacttaacccatgtggtcgtacttacatgttcggatgtagtttaaaggatagtccttacgagcaaccaccaatgcatctcgcccaataatgaccctgtgtcgcgagttttctcataaactcatattctttcgcaggcactaacccacgtgtcagatttttcaaagctttttagaaacaagtttcacccaagttgttctcagatttaaagattgagggctaccgtcaatattcttacaaggttgcacaaataccaacatacaacaaaggtggttacaagggaacatgatatagctattatgaaggaaagataaaatgcaacagggttaggtaggcatatcattccatcttgtagacgaggcgaaacatttgcaagtgcacgccaattgacgcataatcaatttacaaacaacaaacttaagttcaaatatgggcacaatgtaacgccccgatttttgttcggaattaaaaatcatttaataatgcatttcctagaaattaaataaaaagttaagcaatttatccaagtgaattattgggagaattaaaattttccctttaaaaatcattggccgggaatattttgtagtattctttgtgccctaaaatactctctgaaatttcccgcgaatttttggagctcatgaaataattttaaaagcaccaagttcattttaaccaactaaataaaaagaaaaacaattaaaatctccctttctctctttgggccattttcggcccaagtcttccttccctcccgcggcccgcgcgcctcctccctctctcgggccggctcccttctcccttggcccgcttgcaaaagtctgttttgcgtccctccttctctcccttcgccgacaggtgggaccggcggtcccacctgtcagctcctcctcctacctctcgccggccaaccccaaccgccattgccgcccacgtcgccgcaaaatccggcgccctctcgcacccgagctcgcatccaatgacgtgggcacgatcccctgcacgtcctccaccattttcctcgctcgtcccacaaaaaccggcgccggccgagccgccatcaccccgcgtcggcgccccacttccccggcggttgccgccccgactccgcctctcccgtgctcgatccggcctcccctcccctatagaaacattccccgcatctccctctccattttccccttgtttcccgagcccggcactctctccctcgctctccccacgccgctcccgcgcgccgccacacttcggcgaactccggccgccgtttcccgtcgctagggtcgccgccgcactgctccgccgccaccgccagctttgccaccgcccgggcaagctcagccaccgctccatttcccctctccacctccgtagcgccgtagccacgtgaaccacctctcttcgccgccgccgccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggttgtcggtgagatccttctcatattgtcgcggtcggccgtcgttaccggtcaccccgcatcggtcctcccctccccaactccctcttctccttctgaaggtcaagggcgaccccgtccgccctccgtcctcgcaagccgccatcgggcaatcgtcgtcgctgtcatcttcctccgcgccggctgccgcttccggtgaggacctctcctcccttccttttttttcccgtccccctttcttgccgacctccgcctcttggggtgcgtcgcggtcgccgtgcgcgctgctgtcctccggccgcccgccgccgttccacgtcgccggctgctgccgccggtggccgcatgccgccgccacgccttggctcggccgggccggcttcgtgccgcgcctgtgcccctggctgccgctcccctcggccgcccgatcggctcaggccgatctaggccgtccacgtggtggacgcgcacccgaggccacgtgtggaccatgtccaccgtgcgccctccccctttgactcgctgacgtgtggggcccgcgtgtcggcgccggccgccccttgctgacgtcagcgaggtccttttcctttgtaaaaataaataataattgcgcaataattcgttaataattctagaaattcatataaatggctcaaaacttctaaaattcatatctaattcattcgaactccgaattgagccattcaacttgcaaaattcatctaaaattgagctctacatgtttgtttagtttttatgtactgttttcttggtttttattagagttttttctcgttttgcgtgccagcgtgtagaatccgtcgtttcggaagttcgcggtcgcaaggataagagttcggaagattgtttgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcaatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggttggccggggtgtccggttgtccagctgccggattcaccgcggcgcaagaggggaccgcccactgccttttgaggggtgggggtgaaaccttagcgtggtgtggatggttaggggaaggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccagaaacccctccttgtatccccttgcatgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgcgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacacaatatgttcaaaggtgatttgcgttgctaaggggcttcacaaatcttctcgaaaccactttcgaacgatttttcgacggcccaaattatacgcaaacagttgaaacctacacaaagatcaagaaaaagacatacttaggactagtaatagtgacattttgatatgtcacaattttagagaactacgggaggtggaaggagtcgaccagagctagagatatggattttgaaagtttaattcattttctagaacattggaaataatttattggattttcataaaggaatattcttaggaatattctagacagttcacttacaagtggggcccacgtaactagtgagagggatgcctagaagcatatccacgagcttcattttttaagaaaaataaattaaatccagcctttagctcgtgttcttccatgaaaaaatattacaaaagatcagcattaacattacacatcatgatggtgtaaaagttaacattgtttagatggaaaaatatttaaagcattttttttctaaatctccatccgtagttagcaatatttgcataattgtagtatcacgactgcaatatgccatgcacaatatttctttgttctatcactcttttgcatgtatatggctagaaacagagccaatatgtctcctaaataggacc

SEQ ID NO: 18087 - DNA, 13839 bp, Oryza sativa
tactctgtggttttccatatcaatctcatataaactgaattagggctattaccttacaaggagtctgaaccagtataatttttgtctctctgttcgtcttgatgtcgtatcgtgtagatcctcgtaccaacgtaccccaataccctatttatccggtctacgggtatcctccgtcgacagaaatgttatgtacttctaattgaaataatgtaagaaggttataccacaagaatggtcccctgctggagtttgaggtagtattgcctccgttggtgttgacggaatccttcttctccttgtctccagtgtttgacatgttggtgaagacgaagtagacgttgataaatagtgagtagtcgagccttgcgctccccaaaaacctgatcgcccgcccgtccgtgcaaacgtcgcagcagtgcgtggtttcggaggcctactctcccaacgcgtatgcacacattcgtcgggatgggattaccgtagcagcaaccgccttggaaatggatgaaagtgtgtctcacttctccttagggagatcaaatccattctcattttatatgaggagtggaagatgaagtaagagtcatggaatgggaagaggaatagagtaactaattctcatcaattagccatgaaccatcaaccaaccatcaattaggtgtaattgatgtaggttaccaatggaataggaagagaaatagagcaactaattgtcatcaactagccatgaatcatcctccactacacaaccatcaaccatccatcaattaggagtaattgatataagttaccaattccctaatcaaatggattaattctcaaaactcatcatcccattaatatcccataagataatgaatacacatgaattcctagcataatgagccttggaatttatttgatttaattgatttaaatggatcaattacccaattaaatctaacatcttgtccagtcgttttaccaaatggcttgcttaattagaaaccactctagtttcttcaagcttgctactgattctactgaactaggattagtccaaaaacgtcccttgtcaagttgtcctggcttctagcttgtatcgcgaaataaagcttttgttgtgctagtaacagtgtgtaatagtgagactgccgtcgttttacaattgatacctatgctgccaacatttggtagctgcagcgatgggcacacaccatgcatatagtatggatagggatggaaacggtcagaagaatgctcaaaccattttcataatcataatttttttcccaaaaactgaatcggaatgattgtgtgaaatgataacgagattaatactactacaacactagaaaatatcataaacaaaattactgaaatagagtctcagagataacgtaccacaagaacaaggaggtcatagtcatatctatactacaaagtaacgtcatgtactaagcaattagtgtagatttaaagaagtaaataattaatttaaattctttataatgatactatagcatcgagaccgacaacacatggaggttatggtagcatttttctaattctaatgggttgccgatactttacacttatttgtttcggatgaaaatggtgcaccgttaaaacagttaaagaaaacaccctcccgttttccatcttgatttccagataagataatacagagtcgaaataaaatggctagtacagaacacaatgatagaaaactccgagccgtttttatccttaactatacatatcaggtcaagtccggccaactcctacagaatccaggacgggttggattgacacacatataaaaggctggtcttagaattgccgtctagagttccggtcttcctgaccgaccggctggcgagttcggtgctttgatctcgtgctcacttcgatccaaattttgtgcgtctcgtcaagtcactgcttcgaccccgtcactgctacccaattctcgcacggctgaacctagcttgtagctgtccatccgacgcctaacttagttaactgtcacgcagcaatgcagcatcggtagtcgccggccggtagcctggtaggctactgtggttgatcaacggatcgagctgagatgatatccatcccctggtacagactacagaggccgcgtgaccaatgtgccagttcaggggacaagaagaaaacgtaggccataagtgaaggaggcgaagcgggtagcgtccatcaagaacagggcaatggattgcgggccactggactggacaccggtccgggaccaaagaaaaaccacgcccacacgatggcacgagccgtgcagccgcgcatgccttgatgcgtcgcgtggtccgtccgtccggccgccgaggcgaggcgaggagaggcttggcggtggcgggcgtcgtcaaaaaggttctcgggaaaagtccgcgggggtgatttgtcgcgcgcgcccacgaaaatcgcatcacgtggcatgcttcggcgtccgtctgatcgtgtagcggcaggcccacccggggtcttttctgcgctttcgtgccatgatgtcatgtgtggtctcgctagcttctctctctagtcttcgatctcttgagctacgccaccatgccatccatggtatgtaggagaacgctacatgcatcgcatctcaggcataggcccaagttctggcactcatcagagttacttaggagagttccttagggttggttttgtttgtggtctaaaataggccttattaaattttatcaatgcaaaattttagtaagttttggtatgactaattttggtaaagcaaagttgtatttggattgaagccaaaatagcctaagttcactattaaaatggcatattttcttaggcatgctaaaatttggcttcaaaccaaatagacactaaacactattaaaattaataaatattggtaagcctaatttagatctcaaaacaaaccagcccttagggcttgtttagttcccaaacaaaatttttcgtgctgtcacatcgaatgtttggatacacgtattgagtattaaatgtagataaaaaaacaattacatagttcgttaggaaattacgagatggatttttcaagtctaattgtgccatgatttgacaatgtggtgctacagtaaacatttgctaataacggattaattgggcttaataaatttatctcgcagtttactaacggaatatgtaatttgttttttgttattggactacgtttaatacttcaaatctgcgtctgtatatccgatatgatataaggccatccccaacccagaaactattaagtagtttccatacttaccatgtcatatagacactgtgtatagaaactatgtatacaatggatggagtcttcaaattaaattctcatccaatcacctctcttctctctcctttatccacgtatgctcttgtttttatttggtacttgtgtagatatggtttcttgtatgagaaatgatttcttcatctttttacctctcttctcattgactctattgccacatatgatttttgcttatgtgacaatgtatttaatactatggaaactagatgacatagagggttggggatggtctaagggggaaaattttttgccaactaagaaagcccttacttggatgtgatacgaccacatcgttgaatcatcgaacaacaacgtggcagctcaccacggcagcggccagcgggtcgtgccctgtagacccccgattttggaaatcggaaatcttctgtgtttatccgtaccaatccctggatcagtagttggtacacacatatatagttggatcacaacatatcagagttaaaagagttaaatacttacattagggccaggtaggccaacaactatcagagaacaaaataatataagggcccggttaacatgccacaggcagtcgactgggaaacgagacctaaaacaagaccgcactccgatcatcttgttggatacgcaagcgtaccgacaagggcttctcttcaacactctcctaaaagatatataaatagcaagggtgagtaccaaccgtactcagcaagccaccataacaacaatgcatatgataaagggtatttcaaggaatggcttcaggttcttttgcataaagctagttttgcaattcttttcacaagtctaagacatagcatagactgatcaagttttaataccagtgttcacattaaacaacgacggttctgtccaccattcattgtgatcccaaggatagcttcccgccattgagtcgtcatggttttctgaggacgtccaccttccctcctcccagtaagtggctccaacagcataaaaatcatcatgcaatatcccatcccacacaagttaagaattttgagtctagccaagtgtaatacacgtcccggtgctcaataaccgcgagcacggctattcgaatagatttggtttattcacactgcagtggatgtacactttacccgcactccgcaactgcccaacacatgagcctcgtcccaacacatgagacgcgtcacggcaaagctttttgataacctcgcattggcagtacccgctccatgaactttacatcctcatgcactctaggcgtacacggtttctagcagtgagaggagttctggcgcacccgggaagggaagactcacacatgcattaagttataaatatgtttagattctcacatggcagtcctaccgatggtgacaccactgtagacacccgcctcgcagtcctaccaatggctgccccaccgtagagtccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggatggcactagccttttccggacatcacccaaatcctccgtctgccccagtcgaaaacagttgtttaattttatttctcttttcacaaatcatgttatcaacatcatggcaatgtgacgctcatgtctccacatgccgtatctcaattaccttcccaaaggtaatttcccaagcatatagcatttgataaatatgagtatgcatgattctagaatagcatttctaagcaattgttataattgactagggactcatacgtaaacatggttacgaaggcataaggggtaaataataatcaaggcatggcataatcacaagtaggatgttcatcattgcatgcaattttatttgtaaacaaaataatttcgcaattgggatcaacatgttcaaggaatagtgatgacttgcctgctcagaatcatccttattcttgatacaatcttgatcaaccttcacctcctggaagctgcatacgttgcctcacgactaactgatacacaaattctataatacgcgagaaaaactaatattcaacaacaagcaaatatgcacaaccaaaatacaaacgtcagggtcgaacctagggttgctcgtactattattgcttgctaggggattccaatcatgctaagggctaaaattccttaatctttctattttcatcgtggtctatttaggagttaatcgatagtgtataaatgagatatacatatggctaatctgtggtttagtcaagctaatgactatggaaggattatggctacacatgtatttatctaaataaagtggtcatatactagaggttctgttgtcggatagatttaggatcaatcaaataattacagtgaatcatttgtattattattttactgatggaggcattactttaattatgaacatattttacttgtcacaataaattatgaaaggataataattatccatgctttgaatgttagagttgtttaggttaaccatattatggttacagattatcccttaatgaacaatcctaacttacagttgaactataattataattataaggtcaagatttataactagtatttatccaccatacatgtttgtcatatactccttggtttaatatatgctaaaggtaggttattgttcttatgtgtgattttaaatggattgtacagtatatgtgatttaagtgggttgacaagtgattttactgtttgagtaattattggatgctaaccgactcaaccttatttgggtggttctatcataacaactctgttcctattcctcataaataaattaaagactcatctatgtgtattcatgtttgattgacctaattataaggctagctttattatttaaataatctataagtcatgggtttaattatacaacaatttaatagtactagtatctccctatacattaatttgagacatcatttaaaattagtttgtgtggttattacaatgacaaagcatgttagagagaaatattcttacatctagtactaattttatttgttagcacatttttaagttgactattatgcattatcttagtattaattatataccattggaaagcttatgaatttagataaatttaggttcaagtttcactcaaatccgagttaaaatgagagagttacgctagtttaaatattcaaatttgaattaatccgagaaattgcaaaaaggtactgttcataaatgatttatttttaatccgaagtctgttcttaacactaacagttgctgacacgtggggtcaaacctttactttattttccaccgaattaattttctaaagggaaataggatgtgctaatgacaagtggggcccacaacctattctcttctcttttctcgttctctctatcgtcttctacctccagaccgagcgggagcagcaggggagacgcggcgcgcgcggcaaggccggccgagggcgacccgacggtgaccaggggagggagtggcaaggctctggcgtccacctgccggcggtcacggcgtaggacggcgcaggggcgagcggcgccgcatggccgccatggccgccatggccgggcacgggtagctaggtgctagggcgatacggagggtttacgaccaaattggtgagggcgtgagcatctacggagtgtgggggttccattttactcactagatggagaggaggagctccgggatggcttgtccacggcgagctcaccggcggcagaacggtggccggaccggcacggcgacggtttctaattggcgaaattaaaggggactatagtttctacggaactaggggaggccagaggagcgaggacttaccgagggatggaggaacgacgaagttcgatgtcgcgggggtggagtagagaagaagatcccgtacgcacgctaggtgttcgacgaaatgtgtgtgagaaagagaaagaggcagagatggggctaggccttgtgatggcagccaaggtgtgtggggaggaagggagatgggaggggggtatttatagggtgtgggaagggtggcttaatggtcgacgcgacggacggcgcacggggctcgaggacgacatgatggtgcgcagggctcgagggcgacatgatggcgcacggggctcgagagcgacgtgatggcgcacggcagcgcgtggctcaaggcggcgatggcgacacgcggcgacgcgatggcgcggcagcggcgcacggggcatgaggcactgatgcgacggcgacggcgacgcgactggtacggggctcggcgcggcgcaagtgacggtgacggtgacacgagcggcgcggggctcggctcggcgcggcgcagccaacggcgacggcgacagcacgcggcgggttggagacggcgcggcgacggcgacgcgacatgacgcggcggcgcggggcgcgagttgacgcgcgacagcggcgcggcagggcgacggcaatggcaacaaaacggcacgcggcggcggtggcagagcgaggcgacggcgacgcggcgcggtgatggcgacacgacagcgacggcgccggtgcgggtggggctcgaggccggctaggacggcgcagtagtggggagaaagagagctgggatggctagaaaccaaatcgaacacctaggggctaaggaacagtgctagccaactatttctgattttagagggtactttgcaattaggaacttggtgcaatatcgatctacatatcgaattaaatactcccataattctattatatatagagagagcctagtttatttgaatgatcatcatttcatgtgtactcatattatggcacccacctacattattcaaatattttaatatttgataaaataggttaataataactttttgtttatttgattttaatatcttgtgcataattatttgtaggattaaatatattctcgtaaattatatctattacttaaatgtatattacatttaaaatgtagttcttttctttacttttttttatcatttatggtttggcaagtaataggaatcataacaaccagcatgatgcaaaagttttaaaaaaatttgaaattttagtgatttttattatcggaaattttcagggtgttacatgcccgaagccccgaagtccaaaccgagagtagctcgcgcgctgccgtgtcgaccgagctggcgcctccaacaagtccacggcacggggcgggagggaactgtattccgtgagacaatggcacgagaggcagctgcagaatatgtccctgcatgcctggggctatgatatgagctgtggctgtctctgagatctcactggcctgatgaaactctacatggtgcaatgcatatgctgatttgcatttggcgaatagcggaatagggaatcgcgtgcgtagtatattaatccgccgatcacttaacctaaactccaaaaggtgatcgtcgtgcgtacgtacgtacagcgctccggtctgttcggtcagccctcgcgaagcttcacggaaacaaagaaggcctcatgatcgggagatcagaagggaggaaaaaggataacgaggaaactgtttcgctttgtcctcacgcacacacgcctcatgcgtccgtgtttatcgatcatgccactgccctgctgatgaacaagttcttcaagcaagttacggtgatatgcgcgcgcccactctgcaaggagcagggaagtattggcggcacatggagcagcggaagaaaggcatttctttgaaccggatcgtttcagctaatctatcgcccatcaccgcatccgacgcatggttggatggaatgaaatggaattacatttacacgtccacggcgtggttgaaaccgaaaaactggatcgcgtgtcacaaaactcataatgattggactaactgaatgtcgatttcctagcgcaatgattcatcaataatgcctggaattggctccgaaagtctgaatatgaaaatgatggctggatgggactctatatacatatgtcgataaaaagatcttctaaaaatttatcagatgtaaatatattatgattgtagtataacttatatagtattacttatatgtaacttttaaaaatccgaagtggtggtcacaggtcaaattccctcacccgtgcctgcgttttttttatcctttctgcttgcacgaatctcgaacaaaaattaattgttaaatatttttgtgaaaattataaacaagttacaccaaaatttaccatatttacgtcagacaaatattttcaagaaaatttatggacatatttatagcaaaaccgggccggattagcaagcgcatggaaagaaaggctctcaacgaagaacctcgcatggaggcccaaaagtgcatcatcgtcggcccgtccggcaaacggcccatatcttgctatgtcggcccaaagaaccctcgaaagctagggctttgcggagggtttagccgcgaccccgttcagtcaaccgtcattccgtctcttgctctcaagcggcgtgcaaccatggcggccacggcctcctccttcctcgcccgccgcctcctcctcacccgccgcgtcctttcccgccccctccgccccttctccaccactgactcctcctcatcctcctcctcctcctcttcctccgacgactcccgtgcgggatctgatgcgggacccgaccccgagcagcagcaaccgccaccagcgggccaggatcagcaggccgccgcccggccgcgcgccggcgacacccgtcccctcgagaacggccttgaccccggaatctacaaggttggaactccttgatcccctctgggttttgattcggtgcgagctgacagcctgattggggattttatttttttgtgtgtgtgggtgagaatcgcgaaggcgataatggtggggaaggtggggcaggagccgatacagaagcggctgaggagcgggagaacggtcgtgctgttctcgctcggcaccggcggcatccgcaacaaccgccgcccgctggaccgcgaggagccgcaccagtacgctgaacgatgctccgtgcagtggcaccgcgtctgcatctacccggaacggctcggcagcctcgcgctcaagcacgtcaagaccgggtgagccctctgttgcctctgcagacgagctgtcacgtaaacgtagtgaagggccaattcctgatgtttgagcgtgacaacctctgatttcgtatgttggattagattcttaactacaatggttcaactgcatagctctgttgcaattgatttgttggtgagtaaagcatctgttatgattatacttgatatgattggtacttggtttccttggggtagaatttggtatattcctttagctctgcatgagtggggattggtagatgcctttttcttttgtgtcgatctattgacttgaacttactctacctctcatttgtgattacatcactgttctactgtattactcaattagtaagaagctaaatatattagtctatctttcgcagttgtcaatttgcatataagtgacatggtaataatattttaaggttttagctttgtacagttcctttttttaattctttggttgattaactccactaacacaagtaaattgtaccatttcaacatttcagttctgttctttatctggaagggaatcttgagacgaaagtgttttctgatcctataactggactggttcggcgcataagagaaatagctgtgcgctcaaatggtatgtttattgcaccattgattttgacttgtggcaaatattttcttgaaaacatgtactagtgcgttgcccatacctcatgttcttttaacaagttctgtctagttctcaaaaagcaatgctcataccactacagtacgttaagtagacttttcgctgtttccttttatttttcacgtacaaactacaaagtaatgtcatgttgcatatgagcattcagcgatactgttcaatatttctatcgatgttgtttagtcggagtatgatactttttttttccatacgaacaggccgtctcttgtttcttgggaatgattgtaatgcgcccaagttaggtgaagccaagggcgttggctacttctgaaactgaggtccactcgacatcaaggtatatcagttgataaaattgatttaaattagaggtatctcaactgtgcttagctttaagcgttcaacgtatggtgaagatctcagtagtggaccagctttatggaacaaatacagttggacatcattgtcgaaaccctctaataattgaacaactgattgtactgtataacttgattttgacaaaacaacatatgtggctgtgctatttattttagttctcccaaaatttcttttgaccttttgggtcagagaagtttgtgaatttgagcttttctacaataaaatggatctgtttactcaatagttgttctatgatgcttccagtctaatctgataacccccttaatacctaatgcggatgataaagcctatcactttttttttggcatctgacagtaaacaaaaatatttgaacaactacgggagttaccacatatctttctgaagtatgcttttttcttgtcttatctcacgtgtccatcgtaagagcatctccaacagtctctctcactctccaaatgtctatttggccaactctccatctaatttgacaagccaaactcgttgtttactccaacagcctctccatctaccatctccattacaagtctatgacaaatgggacccatacgtcagcctctactacccttcttccactctcttttccccacccggccaccccttctaccacctccagtactacttactgcctcctcccctcgcctttaccttggatgcggcgacgacggatgacgacggccacggcaactcgcgtgcgcgcaaggcgcggatgcgcgaggcgacggcggacggcggcggcgactcgcgtgcgcgcaaggcgcaggtgcgcgaggcggtggcggcggcgactcgtgaccgaaccagttcccgacgacggcgacgacgcatggccaccaggcgaactggacgactccgctggcgacctcggcggcgaggaagaaggcgaggctgtgcacgccgaggaagtaggctgcgccgcgccgccggcgtggccccggaggcgaccatggcggcaccgaggaggcggcggaggtcggcgcggtcggcgaggtggcccacggcaaacatggcggtgacgaggaggcggcggaggtcggcgcggtcggcgaggtggccaccgggctcgccgaggcggtgcgggccggaggcggccgcgcgactggaggcggcggcgtgggaagctggcgccgcggcttccatttggaggcgacgacgaagaagacaaggaggagcgtggtgggacccatggatggccagtgaatggcaagtggagtaggctggccaagtttggctagtgagggaagaaatttggccatccggatggcttggagagtgggatggagaggctgttggagtgggatttttgttcaaaatggctaaattttggcttggagagtgggatagagaagctgttggagatgctctaagatctgtagagtttgagggataaacaagttatcaaacctgcatgctaacaccccaaaactttactttctcacctgctgaacacgccttttctgtctcaccatcgcatatccagatatcatctgctttgcacatcagttaaatgtaatataagctcgaagggtatatatagttactttgtgagctaaaagttttagggcaatgcaactgattctgaagatcaaaccggacattctaagatagacaaaaagcccaccagccattctaaaagataaacagaagacgaacacattatgcttgtaacagaacaatattcttatgtctgtctaataaacaaaaggtgaatacactatgctcgaaacagccaattctcactgaagatgagcacattattcttgtaacagagcaatcttctcagacttgcctaatgtgacgtttcctcggtggagaagttggagcgctgggcaagaacatgtagataccaaaggacaggaggaaagctgacatcgaccaatccttctagaatctggacaatctctcccatcgttggtcttgtgttctcatcatcttgtatgcaccagcaagccaccttgcaagccctctccacctcttctaagttagcatctgcacttagttctgaacctagcaagtcttgaatcttcccttcagggagtctcatcgccactagcactgggaagaatgtccctgcaccttgctcaccttgccgatgccaatctgcatttctgtttcctgatatgatctcgaaaagcatcatcccatagctgaaaacatctgcctttgtggtgatagctgtgccgttatccattctggggcaagataccctatagtgcctctcatggttgtcaaaactctgctgaaatcccttccgaggagcttggcaagtccaaaatccgcgatctttggcatgaaa

SEQ ID NO: 18088 - DNA, 3043 bp, Oryza sativa
attcctgcagccctaatcccttggcaattccaagagcaatctgatatcttgtcttccagctcaaagtcaatggagtgcttccaaataggtaacgatccaacgacccatttggcatgaactcatagactagcatcttcatggacctctctgagcaaaatcccagcaaccggattaaattcacatgctgaattgtgccaattgtgctgacttcagctcggaactgcttttctccctgagaaacaccatcaagtttctttacagcaattagtgtcccatcaggtaacgttcccttaaatacaggaccaaaagaacctttgcccaacctctcagagaagttttttgtcacatgctgtaggaacctatacctgaatacgaccaacgaaccctccactttgttcgcttcactcaaattcctcttcctgagaatcagaagtatgccaatgatcacaatgagggtgacaaggatagctccagcagttgaagccccaataacagttgccttcctcgttagctggagaactctgatgcagcgagccggatatggatgctatgccccactgaaccatcagcaggagccactagattgattaaatctccataccacaaagaacaaccaccagcgtaggaataagcggtacaagagcaattgttcagacaagcctgcttacatccatctgtaccagttgccaaaccccaggctttgtcaggcaacttagcaacagctagtgcatagaattcatcagctgttgtcttgctagagctattgccatcatattgtagcttagtgtttctcatgcaacctccactgggattaccatatcgccactcgccgttgtactgcttgctgaaacccctgagacaactgcagaaagtgacggcgttctcagtgcacatggcaaaagaaccacaaaggaagtacacggcgcactgtgcttttggcagtgccaagaagggcacccagtcttttttgctctccatccatactactgtttttacctggcctgaaatttccataataaacatcgctgtggcaatggatgcattagttcggtacacaaagtagctctcttggttgttaacggtaaatttgtagcttaaaacttctttaggatacaatgccatctcaggaattccagtaaacatattaccaatccatttgcccgtttcccagtagatggcagaattgttccatagatggatgaactggtcgccaccattcgggtcaatctcaagcgtataatacccaggtgatggatcaacagagcttttccatgagataaatcttgtgatttggccagtaattttgttccgtccaagcttggccccagggagccacacattggtcggttcatcaaaactctgccataggaaattggaggtattggaggcaggagctaacactaagttgcctgaatcaaggataactccaactgtggagttgacgttattagtgatatttgtggcccagatcaaagacctggcctggtcgaacaatgccaaattgccatcttctgatgctgtcaactgtgataagtttggatcagagattggagtcgcccgatttgctatccagacgggtgtggtctttgagatcttgttgtaccaaatagcaaggtaccatctgttaggcgctctatcatctgaattgttaaccactgagattataatagttttcaagaatgcactagacaaagacttctagagcttagagactagtatgtgtatctagaaagaaataacgaagataggtcttgcttcacatcttcaacaaatgctaactgctgcatgattcatttgttgtacatggaaatatcttcttctacaaattataatattttctctcttatatttccatctttcatataagttaaaatttaaagcttgtgggaaagtaacaaaaagaaggaaaagaattatgccatgaaacgagcatatttcggaagccttccttgtggatttcaagaactcacctatttctttctcacaaaaatatgcctactagggcactagccagatattcacctccaacctgaaagtatcaagtaaaataaaaggaaacatgtggcgtggcttgtagtttctttttttcccctaattatagccccccaaggctatagttttatactattctttttctattatatcaatataaaatatttccttcatcccataatataagggattttgaagggatgtaatacaacatagtactacaaatctagacatagggttttgaagggatgtaacacaatatcgtaatactagatagtgtcacatccctccaaaatcatttatattttgggacggagggagtattgtactatcttggggtgcaataagctttgcacataacatgttcaaaacatcaatttggtttgtaattactattgcaatacaaggatggcacactgtaaaactataaaattgccatgaacagtacttttgaaaaaaaaaacatattaatcgtgttaagtctgtaaaacattatacaagatatatgctaacgacagaatggaatatcatccttacgatatcccatcttgtatcccctataaaacattaccccatgaaatcttgtacggaacttgcataaaacattttttcgatagtagaagtcaatctagcctctacatccaggatatataggcatatagccaaaacatgcatagaaattgattgaactatttaaattaagactcactgaaacatgcatacgcctaacaaaactatatgtacctcgttttattttttgttttggtttttgatcaaaccatattgtccttactgcaattatacatataaaatttaggtatttccggggaaaaaaggtttcttgaaggactggaagaagcatagaactatgacgaaacatgcagaaatgtgggtgaaagctttctgaaaccttttgtacttaatgaaacccgatgagaattggaatataaagcagaggcaagataaactaatagctgaagtttacaatatgtctctaatctctatatcacttgttacttgctacagtagttgctataaaaaatacaaacga

SEQ ID NO: 18089 - DNA, 11298 bp, Oryza sativa
atatatatagattcattaacatcactataaatatggaaaattctaaaatgacttacactgtgaaataggtggagtatgatttaacactattaccattattagtaaaagtgtgctgtaaaaagcgtccggactccggagtttggagttcctctgctctgtacctctggaaaaactcggtaatacaaaaatagaatcattcgacaaaatttcaaatgggaatacgaatattcttattcaacgcagaaaaaatatatatcaaggagataaaaaaagcttaactaaattaattaaaccagaatttattgcagctgttgtttcttcttttggatcattgtgtttcctacgaggtgggtcgccgccgacagagacttctagtgtcgtacatgtacatttgttagtggcggtcagttctcagttttcaccgtagcgggccgggcaccttttgtcaactccggcaactggttgtttggtgactatcacagattcagaggctcgcagccatgattctctcaaccatgacggcatgacgaactctcgcttccggatcatccaaagaaaaactctagggggcatgtactatcccctagcagcagattgatagcttgacaaagaaccaacggtgcaacgattcattaattaacatgttattattattttctacgtatatctttatctctacttattataaaacttaaagatgattctgtactcatccttatttccgtccatagtccgactttagagctgggatgtcgtgcgtgaacgggtcacgcgatggagggagtatatacgactgaaataaatttaaacggtataatttttatattatggaatgaagggagtatatccgactgaagtgcagaagtattctctccttaaggggttgtttagtttaaaaaaaaaacttttcccaaaaagcatcacatcgaatctttagatatatatgcatggaacattaaaatatagattaaaaaaactaattgtacaattagggaggaaatcgcgagacaaatcttttgagactaattagtccatgatttagccataagtgctacagtaacccacatgtgctaatgacggattaattaaactcaaaagattcgtctcgcggttttcatgcgagttatgaaattaattttttcattcgtgtctgaaaaccccttccgacatctggccaaacgtccgatgtgacacccaaaaattttcatttcaccaactaaacaggccctaagccgcctccaagaaaataaagggcttcttgattaccccgagaaaccgaaaaatagaaccaaggccctctttgtttaggcttataagccaacttataagctgaaaagtctaaacctaaacaaacaagcagatttttcgtttggcttttttgaagccataagccattctaacactattaagccaaaagttaggttagagaagcttttttttttacttatatgagatagatgtatgactctaacactagacttaggttattaaatccactggcttataaattattatgccaatatgctgacttaaaagtgtaagccaataagcataagcctaaacaaagaaggcgtaagcccgaagtactgtgcactgtgacttacgtatagcttctgggatatttaagagaaaagaaattctccctccgtcctatttttagtacagtcgtgggtttctgtaccaaacgtttaaccgtctgtcttatttaaagaaattataaaaaaaatcaaaaacttgattcatgcatgagtaatattcatattttatcatctaataacaatataaatagtaattataaaataatttaaataagacggacaaacattaaacactaaaacccacaactgcaattaaattggaacataggtattattcaggcagttctgacgtcaatgtaccgcaccgctcagtttatgtacactgaacatgcggagaattggctagggcctgtgctgctgctgatgccgcgcgaggttaccgtggccgcacggtcgtggtgacgagcaggaggccggagctgacatggtgagcgcgagcagctgcatcctcaccggtggcgggggcaccaaccgctggtctcactggtagtcgtcgtcatcatcgccgtaagatcgagctcaacggagagagaggataaagggtgtgtttagttcacggtaaaattggaagtttggttgaaattggaacgatgtgatagaaaaattgaaagtttatgtgtgtaggaaagttttgatgtgatggaaaagttggaagtttgaagaaaaagtttggaactaaacaaggccaaagaatagccgtgttcgggaggtgaggttggaactcacctcccgcgcacataaaaaggagtgacatattttattatgattaattagatacttattaatatttttagaaaatagattaatattatttttaacgtaactttcatatagaaaccttttgtaaaaaataacaccatttagttgtttgaaaagcgtgcgccggaagacgagatatgtgagttgggaaaggtggggaagagagaagagtgaaggaggaatattatatagtcgtcactataagtgagctcttacatagtactccagttcctttttcctaaaataagtttattcttacctatttcacacgtattactatgaaatcaaaaaaactataatacctctgttttaccaaacctcaatgtagttattttctattttatctacttgcagagtatttattttctaatttcacaaattccgataaagtgattacttaaaaaaatatatttgagtgtaggtccttcctatttttaattgttttctttatttttgaaactaaaatgccttgtaagtgttccatcacctaaaagaccacgtcaaactgccacaagtgatccaaatcgcactgatattattagttgaggatgagatgctctgtatccgtaaaatgatgtgaatgaaactcaattgaagggatgtgtagtgaatcttatccctttactttatattctattaatcctaaaataagtttagctttcatctatcctacacataccgatacaaattcaaaaagactagaatatccctattttatcaactcccgatataatgatttctcattttcatttacacttgatataattattctctattttcataaactctgatgtgatgattacttaaaaataaacttattcggaatatataggagtaggggtgaaaacggtcacggaaattaccgatcgatcgggcgccgtttccgtttaaggggtaccgtttccgaccataccgtttttggctatttttaaattttgttttttctaatttctctctgcatcgtattaatgtcgatactgagtagtttaaatgataaatatagtcaattaccggctgatcgagcatcgtttctgaagagatgctaccgatttctaccatttccgatcgtttccacccctataggaggagctaaaatgaacttattataggacggagagagaggtaacttgatgttgattttttcaagatttttattgtcctaaccaaaataaatcacgagagtagttttattgtcctgtttggaacaggggaatttaatccccccggcgaggccacggtaaacctcgcccgtcctttagctaactgcactcaattaacctagtagcaaacgatcccattgtaccgcaactgcacgaacaatttaatcctgccatacctagtactgtagtattgtggtctgtgggtatcacacgatacgcctcccatctccgatgaatcccccgttgatgtacctatactcgcttcctgtgtccgtgaggatgaggattgaggtcaaggtgagagcgcagattacacaacgggcaaagactcgcttcctcaatggctccggcctccggctcccaggaagcagccatcagctgtcatatcagtgctacacctgctacagtatactactactcctccagtgggcagagtgacagaggagcagtgggctagggagtagggagacctccactagcaatgcagcaatggccctatttagttctaaagtttttttttttctaaacttctacatttccattacatcaaatcttatacacacaacttttctattatatcgtaccaaacatactaaatgtactgtagagggttcctggtacagttgttgagtcatcgcctcctctcccaaaccaggaaacctccggtgcctccatggtcaaagctccaactttagctttgtttaccctcgcgtcctatactgtccaccgtaccaatcccgagggttgaaaatcacaccggcctctgtccctctccttgcctaacttcattctccatccttatcatcgtcgtctacgtggttcttccttcttcattctactccaatctctacccaacagggtgtcccgagcaatccatgtttttcatggcattttacgcctttacctgtgcaaaattgtgctagcaatcgacgtcagctgccttgcaatcacaatttgatcgtcaattcgtcattgtggggacaaaagctctgtcctattgtactttccctgcttatcctattctcaagactatcaaggtattcaaggtctcaaggaggcagcttggaggcatttgggccttgagacacgggtaggtagaactcagcatgcatgcgcatgcctttgaaattccaagggggatcactttagtttaagcctttgctgagaacgatatttggtaggagtatctggtagagtactatagtttcagactttcagtccacttcaagacaccatgcagaattagctaccggtgagaagcaactattctaatcgaagtcagcagtgatccaccaactaattgagtttagtcactcgatgctcacctggaattcacctaaattcttgcccggttcattggttgttgccatgtttcgtgtgtggtgtccacagattaacgagcagtcaacctggcgacacggtactcacaaatcacaatctgtagcattcgctcactactcatcactgacttaatatattactcgtcactgacgacgttactgtaataaaattatactagcatgcttacataatatttaagatataataattattaatggatgataatgtgatatttttacatactaagctttagaatttatactacggagtatgttgtaacttattaaagtaaagtaggataaacatatgaaaaaaaaaaccactttctgcagaaggggacagcaatacagcacgagtgcgcgatacaggaaaaaaaacagcctattcagattcaacactccaactaaaacagtgggtccgattagtcaaatcaattatgcgaggcaaatgaactatctggagctcaaagattttacggttattcccattcgtagcccggggcactaggcattttcacgaattaaatatgaaaacatattgtccattcaattttttttaaaaaaatattcgggatgcaaaatcttttgcacaaatatactatcggtctcacacaaccattgcatgaaaataacgtgaaaatgacgtcgtgacttgtatcacacagtgaaagtcgctcaagcaaacagcgataccgcaagcaatcaacgctatcgctcaagcaaatagcgataccgtgccttgccgatttaattagcggttaattatcctagttagcgattaatcactaatcagaataattaatcactaattattattagttaattgttaattaagtaattaattactaatcaaatggatctcattggtcagtgtcgctgattgcttctgcgagaccgaccgaatggtctcgctcttccattccgcgagatcgtgcgcgagaccgtgcggtctcgcgctttcgccacgcgataccgcccgcaacgtcatcgtcatatcattttcgcgtaacagaagtgcgacaccgatggtatatttctgcacaagtttttgcatcccgaatatttttgagaaaaaattgagtgaacagtataattttaaatttaattcctagtcactgcatgttcatgagttcatcccatgacattaggcaacatatatatatatatgctcacgacaaaatcgatccgttaataccttccatgggatgtccgtttatatacatcgtcgaaatgcctggaaagtcctataagatatcactaaacttagcacttcgactcataatatattattccctccagtcataaatattttatgttattgcaatatctatacaacttcaaaagactggtgacagtaaatctaacatcccatcctccattgtgcggctttacagttttttcaaattggtcatactattctctaatatttagagaatgtctcactatttgattcaaacaagttaaatgaatatcatataattaaataaacaaacacgtgattaaacattttacaaaaactaaatattttttgggcatttagctattcaatctgtctcaaatataacatgtagattttaaatttggtcctaaatataccaagctagtactcataaaaggtgagttttaccactataaactacccatattcatccactactccttccgcctataatataagggattttgacattttgcttgcactgtttgaccactcatcttatttaaaaaaatttgaaattattatttattttatttgtgacctactttattatccaaagtattttaagcacaacttttggattttatatttgcacaatttttttaaataagataagtggtcaaacagtgcaaacaaaatatcaaacttccttgtattatgggccagagggagtatcatttagctttattatagccccagctagtccaagcatgcacctcatacactccgagggaataaccaagttttttttacctctctccttaataattgtgtcaaaggctaaaacttactatattttagaatggagggagtagtatttagtaaaaaaaattattatcggtctcatctcccaagtggatacccccaagcttctacggtccgcttattgaggaatagatataggatggatgttcaataaggacaggtcatcgcaaagaaaaactaatactgcctccctcccaaaataattgtaattctaggttatttagcctccctcataaggtttgaaaagaaagactatgatgtccctcattaaatggtgtataagtaagagtggaagagtggttgagggtagaatagaaagaaatttgaatgagaagtaattgatgggacaactagtactctattgtgataactattttgggataaatttgaattgtagaaatacaattattatggtagaaagagataagtgagcctacgagtctacgactaccaattccatcggacttatcaaatactcggtttaaaaagaattatgtgcatatatttgcctcaaaaagtagcataatagcaaaatttactagatttcataaacttattattgaaaaatataatagtatgttttatataatgtcacaactatattaaaaaaatatgtgaaattaaatgggaaatggttatgattggttgagacgagagaataagtgaagaaattgaacatgcgatgattgcgattgcttgaaaggatgaagtagatgtaaaaattgatatataaaaattggcgaccctaaattcaaaagtttactgaaggagtaataattacgaatttaaatatacaagttattgacttttggtcatgatgttactattcatctttttttaaaaaaatgagtacaagttatttattttgttgtggtttgttttatagttaaaggtacttcatgcctgaactattttttcccatattaatgaaaaacattatatccaaaatttaagtcacttggcaaccatcaggccatggcgccaagcacgccatcctatatcctaccacctccattttggtttcaagaaaaccaccttcattttgaaacataaatatttcttgactattactttttgatcttaaaatgaacaaatatattactgtttacgacagactaaacctattcggttgtatagcaaaagaattttcataggtgtattttgggatgaaggtatagctagctgtgagcaactgactgaacatttatcaaatggaattgtacataagttgaaaaaaaaaaagaatggtagagccacatttctcctgcacgactgcctggcccatgccctctctgctataatctgcaccctgtcttccatttcctcatcaaaaaaacacaacaaaacagaacagaagcagaccaggtagcagacaaagccaagagtttctcacactcctcccatcgcttctcttctcttctcttctctcctctcctgtctgctcagtttggtgggttctgctcaccagtctccccccgcagtacaaaacctccattcctcgccgcctcctcttccactcggaaacgggtagtagaaaagaacacaccgcggtcacacacactctcttcagcaacaaacgatgaggaccatcatggcgaggagccctcacgagtcatccttctccttctccaggaggcacttcaagtggccagttcttggcaagagcagcagccatggcgccagcaatgcaggggaggacgacttcatcaaggcagaggacgacgaggaggccaccatggccttctcctccacctgcccgtcgttccactccgaggacttcgtgtcccctccgccctgcaagccgctcaagcagcagcagcagcagcagccgcagcagcagcgcaggaagggacgcacggccgtgtcccgcctgcgcacggcgctggccgcggccctcgccggccggcaccgccaggtcgggctcggcgcccggctcaccggcacgctctacgggcaccgccgcggccacgtccacctcgcgttccaggtggacccgcgcgcgtgccccgcgctgctcctggagctggccgcgcccacggcgtcgctggtgcgcgagatggcctcgggcctcgtgcgcatcgcgctcgagtgcgagcgcgccaagggcggcggcgcctgcgcgttccccaccgccgccgcggccccctcctcctcctcctcctcctcctcctcctccagcgccggcggcaggaagctggtggaggagacggtgtggcgcgcgtactgcaacggcaggagctgcgggtacgcggtgcggcgcgagtgcggcgccgcggactggcgcgtgctgcgcgcgctggagcccgtgtccatgggcgcgggtgtcataccggcggcgtgcggcggcggggagggcgacgtcatgtacatgcgcgcgcggttcgagcgcgtcgttggctcccgcgactccgaggcgttctacatgatgaacccggactgcggcggcagcggcagcaacaacaatggcggcccggagctcagcgtctacctccttagagtttgatcactcgagcgtctcccattctcacgttttcttgtatcgtgtcagttcttgcatgctttgttgtttcctgttgtaggctagtagtactttagtaggtagtgtgacggtatgagtggttctggaataatatgcatatggaaactgggattgaaatggaatattttttctttcttttatgtttttttgggcactttgtttggtgcctaggagttattggactgaggtgttcgatcatgtgagtttagtgtcactgacgtatgggtctatagcaaagaggattcacatatcagtaactgaaagtcgtataatttaagtcgaacgagcttaatctaaagatatcactcctatatacagagaaagtatggtaagttctttagtaaacagtactcaagaaggtctaggacgtcattttctaatccagtgatgggtgatctcaattggtattgtactagcgaaagatgattaagatcttttaacttaagttatgtgattttgagttactaacatataagttatgtgattttgagttactaacatataggttctttttgctacaaacctagagtcagtgaacctagagtcaggtgacttagaggcagatggtccttctcctccaggctccagtgaaagaagggagatccagatatcaggaaggagcagggatgaccggtgaacagtgttgtattatccagaaagattatgtgatagtaatgattattatcgaactgcatcaattgtctttgttctcatgcatttgtctctgccataatgtgggaccgacagaatgccggactgccggagtacatctgttttccgaagttgtttttctaatcactttatttatttattatgtaaatcactttatttattcgtaagcttaattttcctgtattttactgtcaaaattgggggtataaatatgaaacccgtggagtgttaaaacaagatagagcaaggaaagactagattcataaagaaacacttagctatatgttccattttaaatgagtgcaccaaacagctcaattacacccagtcaatgaaaaattatgtttatgaatctgaatatgggtctgtctatataggtatatacctagtaaatattgagagctactatacatacgatatgtcacatacgaagctagtacgatgttgtccagctgtttcctagcgatgcaacaagtaaggttcaccatccgttagtaatcgtacgagaatcgtacataacaatcgtaatcgtacgagaatcgtgcataacaatcgtatgcacagctagcattttcacaacttaagtttgtttaatttgtgttttgttgagttgtgatcagtgaccgcttgagattgcggcgcaggtagctagccaatggccgcgaatgcccaatgctaatgtacaagttaatgaatagaacttttataataaaatcatagtacatattattttttttctattttgttgatttttaacatgacatttaataattcatgttattacaaatttagtgcaaatatgaaggaatataggtcatgttcaaaatatctttaataattaataaaaacacatcacaataaaacaaatggttattagtatttattgtatttttaaataatatgagtggttaagtgtcatgtgtaaaagttaacaatgttatatatttaaaaatatattgtaatcatctaagtttggtatcttctttattttgtgatagtagctagtcaaattggtccacattgtttagtggtatgttttgatcataatactcagggttaagaggaagcaccggtaacgatggactcatgcagtcatgcttacactggtggagaaatgctttttagtcccggttcgtaacccccctgtagtcccggtttttcaaccgggactacgaatccgggactaaagatcgctatctttagtcccggttcaaataaccgggactaaaaatcaatctttagtccc

SEQ ID NO: 18090 - DNA, 7598 bp, Oryza sativa
ttagtcccggttggtagggactaaagatcttcctcttattaaccgggactaaaaatcatttttagtcccggtttttaatggaaccgggactattgtggatatggatcgaccgaccaaagatggtttctctaccagtgttacatgactccatatacttaggatatatatttgaaatatattataccgaaaatttgacacccaaaaaaaaaactagtataatacacccccaactatcgatgttggacacttaaccatctttgagttgttttgctatggttttttacacgtgggatgccacgttagcccttcgcaacattgaatgaaatataataatacattaatagtttaatacagcgtgtaggcctgccttctctctcacaccgtcacatgcattctctctctctctctccctgtttatggttctgtaaagtggacaaggagatgacacacggcaatgacggtagggttctcgccgccggcataggtggtgcctgagaccggcgcagctgaaaggaggcctccctgttctaccaacttacctaagctcttacgcatgttaggtatttccatgttgattattcacactatgaaatccatcttgccacctttctaccacactcgcatataacagctagagaataatcaaatgtcccctctctgtatcgaattggaggtggcttgcttctaccttgtctggagaactacgatgcagatcgtaaagtccttcccgtgctgccatttccaaagctggtcatgtccctcgatctacttgttccgtcgttcacggattccacctacttgcccttgtttcctccctgtgtggagattcttgttatgtgctcagccctctctattagcgaccgcatacagctgcttcggttggcgaccgtgcgcaacgtcttggatctgctccttccccatgacacctcctccgccgactaccgccacaacctgttggagatgctccttccccgccgccgtgcaccgtttccagtaggcctcctgctatcccctacgttcatagcgctgatgccttcgaagctccacgccgccgttatcgctgcttgtgaaaaagctaggtcaaaacgaaccaaccaagcaatatgggcttggcctatattttcctatgcgctaacgtgatgaagggtgacgcagcatcccacgtgtacaaaaaccacggtaaaacaactcgagtagaaataagtattcaacattgaaagttgagaggtgtattatgcctgggtttgtagttggggagtgtatttttgacaaatataagaatttaggggtgcaaaatgtactttgctcacattctataactacaaaatctatgggttgttcagatcgatgtcatctcaaaccataccatcctttggtaaagttaccaaaattgtgcatccatttagttcctttttttgacaatttagtccttttagaaaacttattttgaaactaaccctcgccaaaaactttaacaaaaaataggccgtgggctcagcgctagtgcctttggcgttgaacccttgcccacatggatccacagatggcgtggggtcagcgccaatgcatttggcgttgactcccgtatacctgttaagtacgtgaagtatattttgatatcatgtagtgcagtggtgaagcccatcccttgacttggtgacctgggttcgaaccttgagcttgcacctttttttttcacttttctatgggtaacagagaaaaaccaaaaaaagcggttaaaccgctgcactatgaagaaatcatgacaaagaatagcacaatgtctaattattacgtacatggggttagcgccaaacacttaagcgctgacccatgccacgtccacaaccaactatgctagcgtggcaaattttagtgctgtactatttggtgctgagacgttggaccttagcaccaacaggattggtgttgagtccacggtctatttttagttgaagtttttggcgagggttagttttgaaataagttttttaaaaggaccaaattattaaaaaaaggcatttagtttcttaccaaactcttgtaaacacataagaaatccagccaaaacttagcaatattgttaaatttggtcaggtttatttggctacaatccgaacaaggctgaatatctggtgagaaatctggaagctgcgtggctagaaccagggtttacgattccgacgaaatccgatcggatttcgcgaaattttgacatttcgacgagactcgaaagtagaaaccatctgagatttcgaggaatttcatccaaatttaaatttgaattgataaaaaaatcttataaatactatgatattcatagaacctattgagatataaattttcgaaaaaaaaatgatgtattgtgtgtatttactaaaagctacatcaggaaagaaaagaataaagaattaaaaaaaagaaacaaattaccgatcggaatttcgatgatttcgatcggaatttcgccaaaaccgaccggttttcgagaacttgtcagcaaactcaaggatttgtattcaaattttattcaaattttggtttataaaatttgttcgaaatttaccggttttccaccggatttcgtgaaattccgaatttcgccggtgcccgaaacggaaggtcatgtcagaatcctaaaccctggctagaactagaggccccttaaaccattgatgcaatacctgtagtgcatattggagcatggaacagtcggaaggggtgtgacttgtgagaggtgaccggggtcgtcgtctccgaaggatcctgcttctctgctctggtaagacccgatgggtcgaatcatggcgcatggaaggacagctctctttaaaacctgattggtactccgtactctggtgtgacctgcttgtgcttggagagatatctttttcctcggcctcctcccctttctgcctctcgcaaggtgattgatgtcttcatgaatgtcagatggtggattcggcacaagcgactccacagatatggattcccttctcgtttaccgggccggtacttcgtgctgtatatcatcagatcctcactgtttacctcttctctccacgtacgttggcttatccttctcttttcactgtaatcacgttttgttccgacgggtcatgcaaagcagttttacacaacaaagcaagacgcttgatttcagaatgcatctcaattctcaagctcccatctactgctcccagaatcgttgcagttgcagagctgccgctaaactcaacttctgaactcattggttcaaaacagcaacactcactaacagtttggaacttctgacagtatatacagtggttttctattcttctctgtcagtctaacagggcgcagtgcctacttcttcctcgcgtggattcgtgctaaagctagtaagctcttggtcttttcggctaggtaagacaaggcgacattccctgcagcttatacccactaaaagcgattaagcctctattaactaagcacgcaagtgatgatggcctcatgctatcattcgatgggggctcgcccaggacagcatgcggcgcctacccatgaactcctgcccggctcggctcgacagactgcatctcaatccattcaatcagcacaaagctgagaggaatattatcagataggacagagctaattagcgccttttcaacggaaaagctcgggggggcttgttcgcacgaaacagcagcagtaatcatgtaaagagcaccacgccaactctagtattagcactgcgtggctcacacgtgctgaatgtacgagagtctgaattgaattgtgcgccgatgaacctggtgctctgattacaggccgggcaacgaattggaaagggagaaacgatgtaggcaaagctcattgcaagctttatacggtgttcacgagttgatccccacctcaatgcactcgaatcattggcacattgggcctgaacctactcgtcaatggcatgagaagaaaaaaagggtattgcataatagtatctgatctgaaagatgctacaactttgaatcatgaaatggtccagtaccaatgctttacgatcaaaatttgacatttttttagcagaaagtgattaattcatatttgacacgagcattatatcaattaaatgcaatcactcaccatcttttctagataattcaagttggcgaattcagacaaaaatcaacacatacatgaaagacaaataaattgatgcatcgtgcttacaacatcaagtgaagtgccgactaggcaagtaggacccagcacctaccgatcgaccaccaccaatatcaagatgttacttgcccttgctttctcttgataaatcagcagctgcatgagcagccgcgctagcactagtattgctagatgcacatgcactagcctgagcttccagatccaaaatccatgatagcacttgactacttgtagtaagaaaataagaaaagaaaataagaaaaaaaattacagatcaagcatgggaacttggaaagccaagccagaagaggagatttggctcacaggggaacgaagagaagtatactcgtgcttccgtggtgccaccggcggcggcagcagcggaggcggcggccaaacggcctccgcctggcgttggcgcatgcaatcttccgctgcgcatagctgcgatgctgttgctttcgcgtgtggcgatgacgacggcaccgggaccgtgcttttactcctgatgactgtagtaaaaatttctacggcagccatggagtggagctgtgctgtctgtcacttgcttttttgggggacggagatgcagaaattgatggacccgtcatgattatagtattattattgcagtcacttgtgtcctgtgagtcgagccgtcgagcggcacgattgatgtgatggccaatgtacacatgactactcctgctcgcctctctttcggtcttttgttcgtcgggccggagaggagaggagaaaagatacgagatctactcttctgtgtactctagtattcaatccgcgtcaaaataaactaattttaagaatatagagtactatattttagtattaaaaatctagatatatgtatatctaacatatccccaaatttataatagaagtttattttattttgggatggatgaagtactccttaatgacgcgaggcacaagcatcgtgtgaggttttatcgccgtaagagcaagttcaatagtatagccaactactagctccaattcatctatagccaatctaatagcttatttatacaatagttacatactacactattaatacctggtcccatctgacatacacacactgcgtcttggagtccgtgctatagctggctacaaatctgtagcccgctgctcttctctctcctcatttaattccttaaaatgtatttgcagctggcttatagcctggtattgaacctgctctaacaaggaaaagatatgggggcactaatccatttcctcgctggattttcgggaataacccagatccgacaaatggcactctgctcagcagatggatgggtggtgtaagtttttgtgtaatggtatagttatatcgtacgcactgctgcagtgctactgttcatacgatgaaaaaacagctcggtagcacagccacaaatgatgctcttagttgtaggctaacctatacccgtggccggacgaaaccgagcagcaatgcggagtaacgtcgggcaacggcccacaaactactatcgtcgcagaggcatacgagccgaaatattggggaggcgctgtattcacgtaaggaaaaagtacaccaaaggtccccagcttgtcatcgagttccaaaatcgtaaaacctgatacaacacatctccaaacttagaaaaaccagtacaaactatgtccctcgacggttttgactttgattttgtccgacgcggcagccaactcagcgtgggccccacacgtcagcctcttcttcccctccccctctccacctctcttactctctcctctcctcttctctccacaggcagccggcgggggagtggctctgcgtgggcgcggccggccagcggcaaagcagctccttcccccgcccccgcgcccaactgctccttgcccctcgcgcgccgctccttcctcgccgcccagcccagctgctccccgccgcccgccgctcgcatgcatctaaggcgttctacacgccaagaacacccacgtcgcccgctaccgccatgcagctcctctcccggccgcccacgcctagttgctctctgccgagtgccacccatggagaggggaggagagaggaagagaggtggagaggggaggggaagaagaggcgcggcaggggaacacgggggctgggaagggccttttggtggcgacaacgatgcaggagcaggtgtcgttagcgaccacacgagccgctgcatgtgcagactcgccaacggcactccccgtcataactctgcctcggcctccaccttcctcgccgtcgcctgcaccgcttccccaacaaggtcaccatcgacgtcgccctatccctgccgccaccgtcgccgctggacgaggcaagagggtgaggtcggaggagcagcgcatcggccatcggacgatggcggctgcccacggcgaggtccccgtggaggcggtggtggccgattgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcg

SEQ ID NO: 18091 - DNA, 12821 bp, Oryza sativa
  unsure (1)..(12821): unsure at all n locations
ccccacgtagcccctctgtcagaatagaaattcaaggagtaccatttctggccaatcttatcttgttagaatcgaaggaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgcttcagaaaggatacatcagaccgagttcatcaccatggggagctccggttatttttgtggaaaagaaagatcatacccagaggatgtgtgtggactatcgtgcactaaacgatgtgacaatcaagaataagtatccgctgcccagaattgatgatttgtttgatcagcttaaaggagccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagtttcctaggccttgcaggatattatcggaggtttatagagaatttttccaagattgctaagcccatgacacgactgcttcagaaagatgtgaagtacaagtggtcggaagaatgtgaacagagttttcaagagttgaaaagtcgcttaatatcagctcctattttgattttgcctgatccaaagaagggtttccaggtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgttacagaaggacgacagttgccattggaattatgcaaggaatttgaaagattaaatttgggaattgtcggtagaggtttcgttgcagccttagaagcgaagcccactctaattgatcaggttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccgggttgttgcagcctttgaagattcctgaatggaaatgggaagaaattggtatggattttattactggtttacccagaacgtcatcaggccatgactctatttgggtgatagtcgatagacttaccaaagtggctcattttattccggtaaagacaacttattccggaagtcgcttagcggaattgtatatggcaaggattgtgtgtttgcatggcgtccctaagaaaatagtgtctgatcgaggcagtcagtttacttcaaatttttggaagaaacttcaagaagagatgggttctaagctgaactttagtactgcttatcatccgcagacagacggacaaactgaaagggtgaatcaaattttggaagacatgttgagagcttgtgctctagatttcggtggaagttgggataagaatctaccttatgcagaattttcatacaacaacagttatcaagctagtctacagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctcttcgaggagttcatcgttttcataccaaaggaaaattggcaccgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatattgagcagatagaagtccaagaggatttgacttatgttgagaaaccaatccgtatcctggaaacaagtgagagaagaaccaggaatcgagttatccgcttttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtctgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcttctcgtcgccggagtcgtcctagcgccgtgcgccctagcttcgctgtcgccgccgccgctccagccgtgcgccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtctgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaantataatattcacaaacaaatgtagaaccaacttcaaatccttcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtgctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacacagtaatatttgttctaacagtttaactctgaactattttgtactagtgttgaatatgggaagacaaataatggtctcaataaa

SEQ ID NO: 18092 - DNA, 32157 bp, Oryza sativa
cattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattgcacacatggaagcaccagcaaatgaagagaatggaacaaagaataacttgggggagaattcatagggtttctatttacatgttagtaacaaatacaactaacccagatgatgtgaaatgatgaagactattaatttatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaattaggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggcaaagcaaaaattacagaaagtgtccgtgcacgtaataaactctctgcttttttgccagttgccactagtttaccatcaccgtttcgcgagttgccggaattcccctatcgccgtcctcgtcctcggccgcggactccacgccgtccctgtccgtgcgagatctccatcccaatttcatcgccgaacactccccgcctcgtcgtcgtcgcaaccacggcgcctcctcctcctcctcgacgagacgcccgcgggtgcctacgccccgtgcccgcgtgaagcttctggctgacgtacccgccgccatcctcctcggtcccggccttcctgtccctcaaaagtttcgcgaccatctcgatggctgcgccggcgtcgtcggtcatcagcagcctctccgcgacctcggccggcgccacctccacctcccgcagcagcgcctcgatctccgggaagagcgggtggtcgtcgccggcgacgccgtggtaggtggcggcgagctccctgaacgcgccgaagccgaggtagcccatgtgcacgtgcatgtccatccggcctgggcggagcagcgcctggtcgagccggtccacgtgcgtcgtcgtgaagatgaggatccgctcgtggccgctgctggaccagaggccgtccaccatgttgagcagcccagacaaagtcacctgcgacgtcgcgcggtacatggcaacacaaaaaaaaaaaacgcacagctttgtaagcgacacggtagcatctgatcagttttgctaacctaagtttgagattgaattgatggttgggatttctctttttggatgtctcttaatctgatcttcctttgcaatggtgctgagactgtgaaaacgattgagcttatcaccaaatttgtttgttttcaagacgtgactgatgcgtgtgtgttcatttttagtgcggggtcatggccgatggtgtacgtatgattgtattcttgttgtacctcacaaaatggcaaagttgacaacgcacgcgagacaaaccaaacaaaaattatgcgctctcttaaagttgtgaaacagtaaaacaactagtagtagtaagatattatgagaacgagtataaaatttgtgtgctttttagaaaggaagatttgtaatctacaagtgcatgtgcatgtgtacgcactagattttagaaaagctttagttattacatctttaatataagttttaaccatgattgttttcccgaacaaagattttaccctgctagcctgtcctgatttagaatcaggaatttacgcttcgaatctcacaagaacaagtaatttagcctgtcgtttggctagttcaaagtttaagccttttgtttcgcttaccatgcacaatttacagttacagagctaatgaggtgtattaattagtactactaagcactactaatactgaccttacgattcacggaaggcgggttgcttccgtcaggacctccatgcggttccctccgcggcgccgcgacgacggcgcagtcgacatcctcgatcaacaatatggacctgttcttcatccggatcagcagcttccgcagctcggtgttggagcggacgccgccgagctcgaggtcgtagacgtcgaagcggaggtggttggagatcgcggcgaccaggctggacttgccggtgccgggggggccgtggatgaggtaccccctcttccacgccctccccgtccgctcgtagtactccttcctgcccaggaacctgtccaggtcgtccaccaccgcctcccgcagcgcggcgtccatggccagcgtcgcgaacgtcgaggcgttgcggagcctcacgggccgccacttgccccactcgttgctgtacagcttcgcctgcctctgcccctgggacatggccgcgacgcgggccatgacggccgggaggtacgcgccgagcaccatgtccttgtgccgcccgtcgaagctcagcttgaacacctcccgcgcgtcgtccccgccccgccgcctgccgccgccgccgccgccgtggctgctcaggcgccacgtcagctccgccccgtcgaacacgtccacgaccgccgtgccggggcgcatggcgagcgtgatctgctccgcgccggcgccgcgcggcaggctcgccttcatcagcggcacgggcgccgcggcgaggagggtggagacgtacgccttggccgcgaggaagacgcggttgtagaaggcgccgtcgaactcctcgatgaccacgcagtggcggcgggacgagggtggcggcaggaggagcagcgcgcccagggccgtgtccgggaggacgtcggcgacgatccggcgcagcagcatggcagcgcccacgacggaggaggccgccgtgatggcgttcttgtaccgttccagagcttcgctgttcggagacgccatggctgtcctcgctgcagctgcagtgggaggctctgattaaggttttcgatctaatcaagtgtttgagtggtttcagtaacagagattagcattcagcaggtgaggagagcttttggagtggttgccgaaagggaataccttattataaacattgtaaaggtcggtttaattggttggtgtttgatcactctgtcatgtaattaaccaccgtatactaatgtttgttgtgtaggttgtgattaatgtttgcttaggaaggagattagtgggtgctgactagctaacagttcggtctaccgtgtaaagcacttcagtcagtcaacaggtgccctctgagtttgccaaggaaaacactcggaaatttcgaacgtacatttcaaaaactgcgatttaattggttgtgcggcttggggtctttctttaacgtttggtaatcactctgagatagccttttgtccacatagtacattgatttatatgtgaaatttcaaataaatgtatcttataccccctctaaattacttgtgttggcagttttcatactgtaactaacactccatgttacactttacacccataaaaactatccatatcggtcaaattatggcttgtttagttttcaaaaaaatttttctaaaaacatcgaattaaatctttggacacatgtatagagcattaaatatagataaatagaaaaactaattgcacagtttgtatggaaatagtgagacaaatcttttgagcctaattaatccatgattagccataagtgctacagtaactcacatgtgctaatgatggattaattaggcttaataaattcatctcgctgtttccagacaagttatgaaattagtttttttattcatatccgaaaacccttttcgatatccggaattaggtttaataaattcatctcgctgtttccagacaagttatgaaattagtttttttattcatgtccaaaaaccctttttgatatccggtcaaacgtcgaatgtgacacctaaaattttctttccgcgaactaaacatggcttatattaccccctcctagactagcaaaagttgatccagctagtggcttgaccaccacatcacttttcattgcacataggtattgccagtcagtccaatcaacaacaaagacgcaccacaaatccacgatcgttctcgcctcgtttctctgtttttgtctctacctccagtgtcggcaatgttgagccgtcctgaccggtggcacaataatcttctgaccagtagagcccacccactagaaccctaacacatggaggcaaatggagcagagctgtatcgtagaaccctaacacatggaggcctagtttcaaactttttcttcaaacttttaacttttctattatattaaaacttttctacacacaaactttcaacattttcatcacattattctaattttaatcaaaattttaattttaatgtgaactaaaccacccctgagctcaaggaggggagtggcctagcatagcgggttacagactgacaggcatggtggcagtagaatgagaagatctctatagtgcacgttgaaaatgacacaaaagctgacagcagccagcaggcaaagttgatgtccatcacaacgcacatttttaagtgagccacgtttttccgtgctcaattttaataaatttaaaaatataagtcacgcataaagtaatattcatattttattgtctcataacaacaaaaatactaattactccattcgtctcattttaagtgcagtgatgattttttatgccaaaatttaatcgtctgtcttatttaaaaattttaatcgtcccgttttaaggagcattttgtgaatgtatagtccaagaatgatttgacgcggttagtaaaaccacattggcgtttttatgacttctgtatgaaattgatggcattaaagtaattgaatgaaaataagtggcaggtgtacgaacaattgaatcaaaataagtggcaggtgtacaaatataggtgaacattgtctgcaaactgcaagaagaatcactagagacatggtggtggaacaagtgaagacttggacacatcatcgcacttttcaaggcttaaatcccactatctacctccgtgctaatacaagtacagtctaggttttatctaacttttaaccttccgtcatatttaaaaaaattataaaaaaattaaaataaaataatcacacataaaatactattcatgttttatcatctaataacataaaaatagtaatcatatttttttaaataacatagatagtcaaacggaaaaactcacaactacacttatattgggacggaggtagtaatacttaccattatactcataaaaaaaatacatttacacttttaatggaattttggtggaaccagcacaccaaaatttaaatttagacttaacacggtacttgaatttacggttatttactctttcgatggtagatggtgtacatgtttacagcgaggcgtctgtggtgaataggggtcttcttaataggggtaagatgtgagtgtgtgcgtgttgtgaactcttgtgtttgtactgtattcttaaaaaaaggggcttgtttggttgtcactttgaactcaacacaaagctttatgtggaggtgagagaacttatataaacaaagagtgttgatttctatacaagagctagctccttatatacttcaagataaatacattaaatgtaccggtgaaaaaaatatgagaaaaaaatagagacaattttatagctcatctattatacatatcagctctaatacaaaattataactaatagctggctctactattatatttggttattgatcatagcctgaggatagattacattaaatgtcaccagtggctcccggctagtataggcagcttcacaggtttgccagtgaaaactccatttaattttaatattgatttgtgaattgttatgaaatttgtacagtaaatattagttacattgaagtttatctgggctcaaaaaaaatttttggttccgccacttagggctaatttgttggagcttctagttgctgcagcttctctcagaatcaaatgctcttctaagcataccagcttttggttaaattatttatagaatccagaaaataaactagaagttagaagttagaagctgaaaaacttaatttttctagattcccagctatttctcaaaacataaactttccaaacaggctcttaggccatgtttctttcagtttgggattattataatctagattattgagtcagattactataagctagattgttataatctgtagtagaataagcggttagtttgtttctttcctagattattgggtttgcaagtctaaagagggagtgggtggcatggtgggtaatttttcatccaataatctggaaaaagctcacctaaatgagcttatcaaattataaaaagctggcttcggattataaaaaactacttcaataaattgtctgtttctttcaatttactcttaataatctggattatataatcccaaactgaaagaaatagggtcttagagcaggtacaataagttaattaggttggctccaaaatttctcacaccaccttaatcctatattaagggggaagaattgaagcgagagaaacgagcgagcgcttaatctagcgtcgggcggtagcgcagcctcccacgccgtatagcctgcatgcagcccgtgaaggcgattaaaaacgcgttatatgggccccacaaggaacccgcctgatcccatcctccagctctcatcgcatctcatccaactgcccaaatcggcgtcgacgctcacgttcctcttcctcttccgcacctacgcgcgaaatcacctccagccttgggcgtgaaatcgccggcgatacttggtgttcctctccctcttccacccctacgtgcaaaatcccctccgtctgtgcatgcgaaatcgccggcgacgcctcctgttcttcctccacttccgctcatctgctcctggctcatccgctgatctgactggtggtcgcattggtgctcatatgtgaggttgctgctgctattatgtaatgtggattctcaagttgattagtatcgatcaactttcgtatacatacaacatacatagacatatttgctgaatattcttgcttggattgacttgcctgttggactaatccggcaagataagtgaatacaacaactaattacaaaggaacaaactgaatgatgtatctgttttgtttcaggaacatatgtgctcttttgtccactgaataatgatgcacttctttcacaaataaagtttttagtttcacaaataccttactgaaatcatgttgtgtgtatttgtggtgtaccaccaagacatcttatagctaacttatagctagcttgttgtatgagttggcttttaagttagctctacttaatatgacaaaattttggagctagctgccagctgcactattgaccttgctcttagtgcattgatggtaggtcatcagtcatcacgtattcacgtgggtaaacgtacttcgaagtaccgggaaccgggttatacaggagaacaaatatatctcttcaagtactccagttacttgctaagggcattcccaacccaagacactagccatagtttccataaactccacatcattaagaaactagtactagacactactcttccaatgcaaacactactattacatacttcaatttaatgatacttatctctcatgacgttttggatgttgtgtataaaccatgtctcatgcaagatatggtttccctctctttcctcatttattcacttgccacatcattttttatcctaagtggcagcttatttaatgctatggacaccatcatagtcattggattagaaatgccctaatagctcgtttcttgttttgctcgggggattaacacattaatcatgtttggattagatgcgattgctttcgtcgcctggagctcaggcgaccgtgggtccgctccatggcaccagcccaggcgagcagaagagcgcgtatcatgcaggtttggtggttgcttcaggtggtgtttggatcagggaattaactttagttcctatattttgatactaatttagtgtattaaatatagactacttacaaaactaattacataaataaaagctaattcgcgagacaagtttttcaagcttaattaatccataattagataatgtttaatgtagcatcacataggctaatcattaattaattaggctcaatagattcatctcgcgaattagtctaagattatgcatgggttttttattaatagtctacatttaatatttataattagtgtccaaacatccgatatgatagaaacttaaaagttttagtcccatctaaacagggtctcagattggtctccggccaggtgaatccatctttggaagccaacaaattactccatatgtccctaaatatctctaaatatatgataccgttgatttttttaatatatttgatcgttcgttttattaaaaaattttaaataattattaattttttcctatcatttgattcattgttaaatatacttatagttttacatatttcataaaagttttttaataagacgaatgattaaaaaaattaacagttatatagatttacatatttcacaaagtttttaacaagatgaacgatagaaaaatatcagcggtttagggacagagggactaccaaacagccccaaaaaatgctttgttgcacttgcaggctgcagcaggataggcgcggaggcgccatcgtcgtcaccagccgcggcgcacgaccacgaccgcgaccgcggtgggcggcgtaaccgcgctagctccgccgtgccgcctcacctcgccctccctcccaccccgccgtacgtcccgagcgcccacctccaacgcagctcctcctacctccgcttcgccgtacgcatttttaatgtcatcaccagcattaatttttcaccgcttaaataaattttcgagctcagacggcgccaccggccggctgcgtcgtcgccatagcccatgctctcgcatacctcgagatccgccgcggttgctttcgctctccctgatctgatcatcccccactcgaattctccccctccttttttttctcagccgcggaaaagaaaaaacagataaaaagaaagaaaaggggaatcttggagcccgcggcccgttttgcagcctcacccctcaactgtgcgtcgttaatcgcggggccctcccctccccgtcgctgctgtggttgctgtcgtgccgtgtgggcgtcacaacgaataatcaatggcctctcctgcatcaccaagaagagaagaggaaggaaaaaaaaaatcagagagagggagaggagtaaaaaaaaagaagaagaagaaaaggagaagggagacaggggagtcagtcttctccctctgcctccgtgcctgcgcctttgcttcggagtccgccaagtttagattcgaggaggagaagggaagagaagagaagagaagagctctcccctccctctgcggcgtgtcggagcaggcgattggctccgttccaacagtccaagacgaggattattttacaaaggttaggtcttgccgccgccccgctgccgcttgtctgtctctctcccttctcaagtgtgcctcatttgttgactttgctaatccccaaatctgatttggctcccccgcattgcgcgcggcggcaacctcttcctggtgcgcttgccacatcagcctggccatgaacaaagttttcgctttttttttatgcgggagagatggggatgattatgcttgaggggggatcttgagcgtgtgtataggatcgagggttttgaacctgatttctgaaagcgcctggtttgtgaggctcaagagtctctgctttttgccggtttgagcttttaacgaaagaggcgatgggctctgttctgctgaattagccacctcgaggatggggaggttgaaggattgaagctctcttttcctttcgcagaagtaatcgcctgtgttctggcctctctgtggatatgtttcagagcttacctgtagcgtcgagtttgtctgcaacgaaaattgctggtgaatgtttcagatgttatgtattccatccatttgagattctcaaaattggttttggctctgtttaggatgtttaatgcctcaagttcctagttggtccacctatttgattaactccacacatagaagagcagaagttggtacatccttgctgtgcattgttgaaactatttgcccgttctgtagtgatctgaaagatgtcacattctgcgtgcgatcccttctgtaatgaggtcagtggtcgttttgggaaagcaagcatttcagcaacagagtgggatatttgatatctacaggccttagtaatgctcattttacagacttttcagcacaataggttgtgtctgtttccttgcattgttaaagttagaaggttccctatatatatgaaaaaaatgcaatgcggaagaaaggaacagagtaacatatttgaatcgtaaacagtgagctgggtcaaataatttatagctatcaagaaattgtcttgtttgtctttcgggctttaaaacaatgtgtgaactcctcgttttggaagaaaaactctgacatgaaattactatactgttttctatgtacaccgttttccattgaaccgttgagtttgtttgttgtttacagaagctgccttttataatgcgattgttaaatgacttgatgtatagctttatattttctgtgtatctatttgtatttggatatgtgaacatggttggatatgaacttaggctctttcttgattgacttagggtgtaggatcctgattttgttcttgaggtatgtcctcaaccagttcttcacagccaccagcatcgtcagatagagaatctacaccagccagtgataatgcaacatctcctgattcagatggtaagcagcatatcattttcttatatgatctctcattctctctacatgactgcactacatacattattattccctttcttatcttccaatttatccttcatggattttgcaggcacgaattctgctggacccgcaagaagcagaattgcactgcagttggatcagcggtcattgcatttttctgttactgcttgggtaaatggattaagcacaacaactagaactttcagcaattattgcattgcacataattttctattctctgaaatcaattcaatgctgaagatcacgctcttgtctcaaaatcccattggtgtctatataagaatacttttttctagggcaccctcattggcctaaaaaaggtcagttttagaattcttcacaagtgagttaatgttcagaattcattagatatattatcacataatagactgatgagcatatattatatcagaataccagatgagattggtgtagccatttatttatttccctccttaatgattatttgctctttagttccataggaacaatatttagtatactttttaagtgctcgccagtacaaaatttcaactttagtttggggattaatttgtatgccttgttttagcttccatgtattaatcatgagcacaaatttacacagcttttagttaacatgtttaaattactttagctgattgtcagattatctttatcacacacacaacacatttgtttcctctgttttttataggttcttattgttgcattgattggaatccttccactgacaccacgacaactgcaatataagggatatcgtttgtcacttctcggcacaacctgcaccacaggctatgctttgtttgctttttatcgggttagtaacatgtcatctgttttattcttcccttcttagataccttgcacaacttttaccatttttccttttgttcagctaccaagagcaggaaacatgcatgctgctcagatctttcaccatgtagcttcgtcaaaggattttataccattcatgtactgtcttatgtttgtcatgtctaaactgcacttgaagcgtaagcatggcttgtttactgacataatgtattcttcatatttccacctaaacacctttcctagtacttgacacgataatattttttgacagttgttttggtaccagtgatttgctgggcacttgaacatgtggccagatttctacggcgccattttactaattcctctctatacaggtaaatgaactcaacagattataagcacaaaatcgatgaagagtatgtttgtcttgccttctatgcatatgctgttgtgctatcattcacatatttaggataaggcagttgaggcattatcttcccattcttggtttatgctgctatattgactaaacattttgattacatggcttttactacttcatctctctgggtgtgcaatacctgtaaaaccatcacaatgcaatgaagaaaacaatatggctgtacatgccctagtccatcagttgtaaatcaatatgtgcaggaaactgtcataaatgttgaatagtataggaagaagggaagatatactacgaatattggacattctatattgagcctcggagggctaggtatatataggagtacatagtgaggagataaggaatgattacagataaggaaggaaccatacaaaccaatcctatcctaatatgactctaactaccatataaacaaaaaaacataaatactttatgtgcaggaaatctgcatggcaataagttgataaaaaacaaaacaaccctgcaatactttgcctgccgaacatactggtaaatgtgttataacatttgaacgcattgtgaatttgtaggacatatctggagaaaccttgcacatgggttgagacaaacacaactgcagtcaaattcctgagttcaaatgcggagattttgttgggatttcttttgatttagactctgttctcgtcagtagagtcctacccttcagttttaattcccccattcccattaaccattcatcttaatctcatattacttttaacctctgttgtgtaggcgacaacgcaatcctatgcaaacgttcatgtactggcaggttagttttttacataaacaccgattaatttctccaaataacatatttctctttttttttgttgactacaatgctgcaacaagacttatctttcaggtttttctatgatatcatttgtcatcacaattaggaatttggagtgttctttttatatctagtataatatacttttatttttcttgcgtggatatcatcttatccactataaacaagtgcttgtttagttgtacatcaaacagaataagtaccaaatgacgcttaattttgcactgcacatgctggctaaaatgctggtgacgagctcgtccaaatgcggatagctatatttcaataatctcaggatgccagccaagggaaaaggtgctcccatggctgaacaaaattaccaattaagtgtatgcaatatttgcatttaaaagataatttgggcaattttagttacttctgctctcagttgtaaaccgcaaaccgcgcccctgcatttaaatgaatgcttgtcgggttgtagagaaaatttattatttattaatgttatagtcacagaaaatttctagcaaatcactatctcactctgtttacccgctattgcagttactgaagctcatgtatcactctcctttcactgccggttatcacagagctatctggcttaaaattggccgtacagttaatccctatatccatcgctacactccttttcttcatgacccgataaatgctggcatgagatggtggttcaggtagcatggatatggctcaattaatcatgtaaaggtgtttttggttacagttcacagttaacacatggaggatcttttcagtaagttgtagtttgcgagcgacatgtttagtaccttttctttttgcgatgttgcgctgatattacttttagttactgacaagtaattcttgtaactttaccttgactgtagaactagtgtagaccttagtaatatggccaataccatgaagtgaaaaatggaaaagcaatttattactatgatgcaactggattctgctcctgatttgtatcagaccacttcatgtaccatcccaaaatataagttttgggtaggatatgggcattaagaaggttacacacgaaattaaatggaaaaatgtatgtggataaattgtttatatcttaagataacttttaaatgctataagttattaaattctgggacgaagagatcagttggtttcaggccctgggccatgtagatgcatttggttgcaaggatggaatgggatgggatgggacgaacccacttttgaggttgtttggttgaggggtgagtgggatgagatggtccctggagaggaatattcctctcagatccgggaccaaccgatccggcaaattctggcggacgaactcgtcctagttgggacgagcgaacggcatgacccgctcaagcttgaggccagcccgcgcgctcgccctactcgccctcaggagcagcggtaaacaccggcgggctcggcgacggcgacggcgaccgcggctgcgggggctcggctcggcgaccgcgggggctcgacgacggcgaccgcggggggctcggctcggcgacggcgaccgcggggggctggacgacggcgaccggcgggggcttagcgatggcggccgacgggctcggcgacgacgaccgcggccacgggggctcggctcggcgaccgcggggggctcgacgacggcgaccgtggaggctcggcgacggcgaccgcgaggggcttgactcggcgacggcgaccgtggccgtggggtggctcggctcggtgaccgcgggggactggacgatggcgaccggcgggggcttagcgacggcgaccgcggggggctcagcgacggcgacggcggatctagtggtggggagggcggtggaggtggatccgcgtcctttgcctgctcgccgccggcctgctcctccaaccgcacccctgctcgcccgtccgtgctcctcctctgttcgtccgcctgctcgcaatattgcgccgctcctcctcgccgccagccatcgtcgcacctccgctcgctctcctctttctcgctgacggtgatagcaaacggcgcccatcccatctctagctcatcccttcaaccaaacaaaaaattaggattgtcccatcctacaaaccaaacacgtaaatggaatcatcccaaccccaaaatcagaaatggtttcatcccatcccacctagtcccgaaaccaaacacacgctaagatgactagtgcatattccaggggcaatttttgcaacagtacatgaaaatgcagtgccgcaatatttcaagaattgttgccaacactctattcgaagcaggactattaaaaaaaatcagtaaatcagtactattacaaagaaaattgaaatgcgataatatttatttcatgaaactcccaggctccaatgagagttcatgcgaaccatccctaggccctgagattaagtgtgaggtggagcacggatccggcctcgatattgtactcgtgggccgccttgtcgtcggtgaccagcacccctttgtagatgagctgccctatttgcctgtcctcctcctcgatgcgcgccctgatcatggccccggtgtccgtcggctcgatgcccaggccaaacacctttgccgctgagaggcttcaccttgatgttcatgctgcctggaaggaggcggagatagaggctcagcgtcgagccgtcctggatgttgtagccagccaccgtgcagccgttctccagcaacttgtggtcgaagaagagcagctgctggtccggcgggatcgggatgccctccttctcctggaccttctccttgacagatcgtgtcgctgctctccacctcgagcgtgatgagcttccccatctgggtctccacgacgatctgcatcttcgtgtctcgacggacgtcgatcgacgacggattcggctgctggtttgtggaagatttacgacgtacgacaaaaccgcggggctttgcttcgatgctgtgggcgtattggctttgcgtcgagacttgaatcgatcgatgtaggactggtgttgtgttatgcggctccggtcctgtggtttttattggtggtagaggcaagctttcgccgttcgggttggtttccagttccgatacggccgcgacgcccagcgttcgcgttgggctccatctccggttcggcggattatccaactcgggcctgtatctggactctgaagatacaaaagacgtactgttgccggttgggatttttccttgagatcatgtagtagttctcggaatgggactcgtcatcgtgtacgtttctacgactacgatgccggagtacacggctttgtcgggtacgattatacgatgtgccgaaaagatgcagcccgatctaactcaggactagtgtgattcttgtattgtaagcgacgaagtgcatcccagtcgggtacggtacgattttgatgtcgaaagggcgtaaaagttctgtcattgcggatacgagaaaaacactgagtccactctcacacggtaggagtacatgcattatttgaagctggccggcgtgccaggatgagacgaaaaaaaatttggtggagaccgggtataattctgtaaatcggctcccgtgcagccccgaccccgatgattgccgcatggacaatctcagaatcggacgtctagttcgttgcggcttcaggcccagcgcaaatatggcataggagcctcgctcgactcggctcccgggcccgtcgggtcgtgggctcatatccctctcgtatcggcctcattcgtccgcagcagccgccgccgccaccgtcggccagcggcgtctctctcatctactgtctctcgtccaccatcgctccctctctcggacatcgtccactcggcggtgatgacgagggcaaccggctcacaatcgccgacacccactgcggcaactccatgcatggttggtctttcggcaagaaatttaattaccggtaaggagattgaggttgagggtgatgacgcggaggttgtacacatcggtcttgtcactcattttcttgaactgcacattacgccatcagaaaatgttagtggcactatcagtattaggtatatagatgccgaaattttgataatttaactcttttagaaaatttatttgaaaagtaaaccgtgtcaaaaacttatttcaaaaataaaccgtgacctcagcgtcattgacgctgaggttaacgattaaacgccaacgatcatgacgctaagcacaccttggcggggcactatggagggttggatgggatcagccatgggttttggcgctgaccccttatgtagtgataaagtgggtttgtgttaattcttgtcactttctatgatgtgccttggtggtttaacttcctatgatcccaggttcgacccctcattgctcatttttttgcttgctttaatcacacgaaaagaaacaaaaaaaaagcaggacgtagggatcgaaccctagtcttctgcctgacagtggacacattcaccgttgtgctatacttcggttcataacagtattagccatgttttgcatgtaacatatatatggggtcagcgccaaaatgcatggcgctgacccctatcgcacctgccaatggctccgcgtttttgatctcagtgccaatcccaatgatgacgaggtcacggttcatttttaaaataagtttttggcatggtttactcttcaaataagttttctaaaagggttagattgtcaaaatttcggatatagatgcagattctcaattcatatagatgaagcccaagaaatgtagcgtgaatttggagcaaatttgttcagagacagaaaggtagtagataatgttagtaaagcactgttgttaaacaaaagtcgatctccccagaaaaaaaacaaaagtcgatctgccatttactatggccggaaaaccgtatgatatacatgttaatttgttcaactgaacttgacactcttttactgaaatatatgcactgaccaagtgaccatgaagaaatgaaatgcttaaatctccaaaatcttcagtatgtatcaaatctaaatggtaaaggaccaaaatgaatattagtactttatcaaatctaattagaatctgcaaacgttcagactacatacattgaaatgtagcaattaacaactatattaaagtttgaatgcagaagcccagatcaaactaactaatcaaatcaatcctgcaccatggtaagaaagaagcccgtgagctcgatcaagagatagcagctactgcccacgggaagatggagtacatctctgcgctagccgccggcaaacagggcgaactcgtcgttaacgttgcggtcgacgagagggatgggttgtgggggcgcggccactcgctatcgccgccccgccatgcagacgacggatgagataggctgcgtcggcggcagtggctgctgctgagaagagatgtcgatgatgcgatgtgagccggtgaggcggtgagccgatgggcccggagccatcgagcgagtcggctcctccgtcctgtttgcgctgcgcctggagccatacatagtgagacgttcgattctacggttgtccacgcggcaatcatcggggtcggggctgcacgggaaccggtttacacccggtctccaccaattttttttctggatgagactatcctgcttctctttgtccaatagggctcatcattctgtacgttcatacgactacggtgccggagaacacggctggtcaggtatgactactatgcaatggttcgaactgatttagatattattataaaaaatgatctttcatttatagaaacgcatagatcaatagtagctacagaccagcaaaatgtatgaatggtgcatacggttgatgatgaacgtaggcaaattaaatgtgacaaaggttatgattggttgagaatagaaagtaggtagagaaattaaatagtgtaagtttgtaattactcttattggttttattattcttaatgttttggataaggttgaaatcaaattttttataactttgcctttcagtaacttttaaaatattagtttaaaggcactagaacaacatatatagatttatcttataaagtaataaaaataaaaatatatttatttattgtacatattataatagaaaaatatagtcaaagatatattttgaagactgtcattgtataaaacatcaagaattatgaaagtagaggcagtagttgagaagagaatatgggtgataaaattgatatattttacaataacttttaaataacagaagttatattttaggatggagagaataactgactttaggttatgggtcaagtaccaacaatttccggttctataagtcaatatcaagcccaatcagatgctatatatactagtgcatattcaaagccaagtttcacaacattatagaaaaatgcattgctgcagtatatcaacaattgttgtcaatactccctcctaagcagggctattaaaaaccggcaaaataatatacttaaatgagcaatgttaaaaaaaaatcgaattgcaacaatatcatatcatgaaacccgcgggctctaacgagtcatctctagcccctgagagcaaggacgatcgtggaggagcacggatccggcctcgatatcgtactcgtgcactgtcttatcgtcggcaagttgcttcccgccgtagacgagcctgccctccctctcatcgatgcgctccttgatcctgcccatagtgtccgtcggctcgatgtccacgtcaatctccttgccagtgagcatcttaaccttgatgtcgttcatgccgcggcggaggcggagcacgaggtgcagcgtcgactccttctggatgttgtagtcggccagcgtgcggccgtcctccagctgcttgccggcgaagatgagccgctgctggtgcggcgggacgccctccctgtcgtggatcctcgccttgacgttctcgaccgagtcgcagctgtcgaccacgagcgtgatggtcctcccgttcagggtcttcacgaatatctgcatctttcttcgttgacggtcgtctcagctggtgatcgatgcctgcggcgatttgctgtgcgacggccggaaaactgggacaagagaagaccgcgcggcgacggcgaggtagtttgcttcgtttgcttctctcgtggacgttggtttgcgtggtgaagccttggggatcgataagcattgcagttgcagctctcatcgtgccgttttatcgtgcgatcggcgggcttgggtcgcgttcgaatcggcttcattttccgataccagcaggggcagaacatcgttgtccgatacgtattgcccggagtaaaccgtaccggaaggtccggaaccagcccgcacaaacaacacaggctggctcggacgcaccaagggccaaggcaggcagctaccatggccaacgaagtttggtgctgacgccactgctctctctccggccggagtcccggttgaggttggctagcatgattggggccgaccgccggatcgaattttttttacaaaaaacatgttaacactcacaatgcgtgtacattcatttctattaatacatacacatatactctacctctataagcaccttcgaaagattagaccaatatattttaagatagacaaagtcaccatggacacctcactgtcgacgaacatgtcgcctaccactaaaagaataaatagttgtaaatatgagcacacatatcaaatctaaaatttaaactcgggtaggtatcaattgagctacatcagaatgaaaatgaattttgtcaatgtaataaaacaaggaaaaaagttattagatttgaccgtctgacccagttttttaagaaaatgtaatttattttggcctttgcttatagaaacaaactacaaacaatttactacagaatttgcaattaagtcgacaatggttaatcacagcttaattgaaaataaaaaaaaaatccgaacatcagcctaaaaggagtgacatatctattactaaactttcatcgacgaaaatctatgtaaccattattttttactaggtttagaatttttacgttggttttatgggcaaaatagatccgatccttataatagtactctcaccttccataaaaattagacctattactccctccgtctcactcattactctcaccttccataaaaattagacctattactccctccgtcccactcattaagacgtggtcaaacttggcataatctttaagaataatctttgactttaaatttctcatagactataatatttgtagcaaaaaaaaaatcataatatatgaaactaaatttaagtgataatacaatgataatattttcatcaaataaaatttaatttataataaactattaattgatcaaatatttaaagagtttaatcttaaaatgtgtgtgtgcattaatgagtggaacggagggaatactttttatcaccaaaactaggagaaattaattcattttgcatataacaaagatcaacaagtatacgtacgcatgcaactaataaatattaagatgattaattaggttctcattaaacatttaatttacctatccaccatttaagtcttggatgtatagacactgtaaataacaataacttatttgaaaaaacagtaaaatatgaaataggtctttcttgtggttggagagagtacgttctacatatgttgatttatttgtctggtcactcggtagtagttattttcaccctcgatgacacgcaacttgacgttcgtatatgctttgcaaatttgtatgcatctttcacaagcacaaggatgaactcatcagttaaccgacattgtcactcatatgcttcttgaaaagaggaatcgatcgaaagggtagtcctcgctgcttgcgctgtggctggacctagacgagctccgcattgaggcgcggctttccactgttccagccaagatgacgcgggtagcctcatggtggtccacgtaggatttttttttaagctaaaggagagagaggagaagccggtgactaattagggcaagtgctatgatagatgtgactaccacatttaaatttatctatattattcactcactaactatgagacaaaccatacaatatatcacctctaatacacaaataccaatatttctaatactctcacattcttcttgaagtttgtgtggaggttgcctcttggtttaagggtgtctcatcatctctctcatcacttctctcctctacctcatcactcaatccaatgtggcacttttagggggcaacacatggagcattagagcaaggctaataatatagccagctgcttactgaatagatctttacaggctacctctcagccaactcatatagtggttagctcttaactattaatatatggtccacctgtatcgactctcacatattttcttagttcatgtgcctaagtcggctataagcctaccacccgctttccctctctctctctcctctcctctcttatccatctcagcatgtattcaaccttcttatagccttctattatacttgctcttatagtacttgcccttagccgtccggctgcacgctcggcccgaggtcgcggggaccaccaggagcgatgggttcgccatctgcgtccggtacgctgttgactgtgtccaccaccgttgccatcgctctccattgccgtcgtcgtctcgcgcttcaccgggtcgccgccctcgtccgtcgtcattgccagcgccgccaccatcagcagccttgtccgtcaccgcagccgttgcactccactgagtcgccgtccttgttcgtcgttgcggctgccagcggcctcgtccgtcaccaccatggccgccgttacactccactgagtcgccgtcctcgtccatcgtcgtcgccgcagctggcctagtccaccatgcccgccatcgcactccactgggtcgccaccctcgtctgtcaccaccgccgccaccgtccttgtccaccatgatcgtcatcttcgtcgtgcttcactgggtcaccgccctcgtccgccatagccgccgccacctacatccgccatggccgccgcccttttagacccttgccgagttgccgtcgccctcttctgccgccgttgcggccctcgtccaccccggccgcctatgtccacctcggccctcatccacggcggccgcccaccacaggcgccacgccgcgttctttcgccgcagctcgttcaccgtaggcgctgccgccgtcattgtccactgcatccaatccccatcggaagagaagaggtgagaggaaggagagaggaagagacatggaaagatggtgggtcctataaagataaaatatttgtattacagtatttcctattgtcatacattagctacaacatttattatagatgacatgattattttttaagccaacaatgggttgtattattgaccttgctctaaaggagtaagtggctccgtttactgtgactcataaatagattcgtgaattagccattatattttcagtggcagatccttctcaatcgacgctgaagtgctatgcccatgaacagtgatgcatgatgacaagggacgaagcgattggaaacagacaaccatgatctgtacatatgttgtggaggtcgggaggtaagagcaccatggaccatggtatgcctatagaaggtaagagtatatcggtgtagggatgacgaaaagagggtcaactttattttttttaaataggtaatttataaataatataattgagatttgagactgatcagtatttattaattttgaatcggcaaaaaaaaaaacgtctcaactaaaattattactccacaaaagaaacttcataaaatctctgtagatcgataatgcaaagaaacttcttaccaaaaaaaatactattagcttatattgttccaaaaataacctaaagccctagctagagtctagagtaactcgatgcctccatctactagttggagcgcgctcagaagttcccgcctcggagagcgaggacgaggtggaggacggagccagcctcgatcttgtagtcgtgcgccgtcttgtcgtcggcaagctgcttcccgccgtagatgagcctctgctgcacgggcgggatgccctccctctcctcgacgcgctccttgatcctgtccaccgtgtccgtcatctcgatgtcgatgtcgatctccttgccggtgagcgtcctcaccttgacgttcaggccgccgcggaggcggagcaccaggtgcagcgtcgactccttctggatgttgtagtcggccagcgtgcgcccgtcctccagctgcttgccggcgaagatgagccgctgctggtccggcgggatcccctccttgtcctgcaccttcgccttgacgttctggatcgtgtcgctgctctccacctccagcgtgatggtcttccccgtcagggtcttcacgaagatctgcatctcgacggattcggcttgcttgtggaaggtttacgacggctgccggaagctggagaagcacgtaaaccgcggggctttgcttcgatgtcgtgggcgttgggcttgtgtcgagacttggatcgatcgatgtgtgtggctatgcggctctccgggcgtgtggttttattggtggtagaggtagcggcctactagtgttcggggtcggcttcccgctccgatccggccgcgatgccaaaatacagttcgtctcggcttccagctccaggccggccccgacgcccagtatgtctagtatacggacgtaaaaaaactcaatcctaggtttgaatctggacatagtgtatgtccagattcaaacccaggattgggtttttttgggacggagggtgactaccgtacagtgtgatctacagactactgctgtgcatacgtattcaaaataggacttgcatcgtataggccggatacgtggcttatcgggtacgactacgatgcccagtagacgtaaccgattgcaatggtccagatgaacagatacagcacggagctagttctgatgagaccatcagctcatagcgattcccatcattgatttctatagcaatatttttagctaacgatgaaaaccaatggcaaaaaggaatgacaacgtaatacaagtggctcgtgcagcctttttatgcaatagagaaaacaatgaatggttgaacatgctccagtccatcaaatgtaaaacgtaaaacagaaaatgttactattattttattattacctgagttcatgaaaacgcatgtctccttagatccctaactattaggagtatatagcaattgctcagtacgtactgcgagcctgagcgcagcccaagaactctggacgggctcagatcctgagttttggacaacactatttcctaccaagtctccaacaagtcaagtttatattgaagttgactctggaccttgcaactcgtcagatcaccccgtcatgacagcacatttcagcaaggctaaagcaatcaaacgtagagctagccacttctacttctgttttccgcatctctgttctctcctcgcattcacttcagcagcccagctcttgccaatctctgtctggaacttgcctgcagtaacaagatttacagatatgtttaacaacagaggacatgtttacaaatttttaaatagcctgcaacaatgacattaccagcggtagagaggaagaactcatctaacactttgccatgctctgtagaataagatgggaagagttagtgttacaaacggattataatccacaatgtacatcagatatgtactacttgagtaggatgacaacataggcaggcagctggaattatattgtacagtgccctgaacaaacaaaagaagaagatggtggcatgaagaaagcggtttggtatgattgtcaacacagcagcagactattcaaagttcttgctttgtaaaaccaagcatcaatgcacgcatcagaatggtgcgataaaaaacatgatgtatcctgcatattactgtaacagcaaattgtttcagaggaaggacccaatctaccgcctggtagacttcacagtttgttaaaatgagtaagcagctagttgaatgtacacaaatttaaaattacagaaaagtaatacctttctcatattctagtgcttgaagtatcatttccacctgcaaaacaagtaaatacaagaaatggtaaaatcccttgaaccatagtgaataaatagagaatgaaaacaaagaaaaggacaaatgagatgtgccccagagtgaaactgcaaatgaccaatatgtgccacaacacaccaaaatacaatataaatattacaccttaaagagttaagaatacaaaatgaacaatatgttgcatgcagggtttaaaattccggaacaaatttcaggtctataggtgggtcccaatagacagtgagctccggtgaaaaatttcggcaaaacactgttcatggtccaaatccccaatttccaatccccttctcactcacctttctccccccgtcctcccccaacatctcctcccatcctcccagcactagcgagcaacaccggcagcggttgctggaactggaggcagaggggtggctggagtggccagcggtggttccgcggctctccggagtgacgacgatgacacaagcggcaaggcggcgcgggcctcgcatcctcgtgctggagtgccagcaacggctccgcggctccggctcgacggcgacacaagccgtggacctcgcatccttgtgtttggctggagtggccagcagcggctccacggctgtcgggcgcgaccgcgaccgcgacaacgacacaaggcacacaagccagagaggacacgacgacacaatccttgcgtttcattctcctatcctgtccccctgctttggattggatggacttgatgcatgtctatattctgatatatgtcaaatttctgtaatttttgttgttcaaattcaaattttgtttgaaaatttcgttcgaaatttccgaaagatttccgaaatttcgttattttgctgacctccgaaaattttccctttcccgatagattgaaccctggtttgcatgacacccctcttatgtaataaagaatattcttacaagcaaacatgcatgcgttaaagtattggaaattaaaaatattt

SEQ ID NO: 18093 - DNA, 9167 bp, Oryza sativa
  unsure (1)..(9167): unsure at all n locations
attcctgcagccctattttgtctatgttaatgaagaaaagcaagaattttccagttcatatgaactaaatataaaatatttatctatgagtgagttgtttcaggaacttggacatggtttcataaagcgttactctagcaagcttgaaaattgtagaattgtgctgaatttgtaccaattccaaacaaaaagaaagctagtatattaacgaaaatgataattctggtgtacatttcaaattagactccaggttgagaaaattaaaatcaacattataaaaggcaccaagttaagaactaagaaaaagaaaaggaacaagtagacagttcagaaaataaaaggcacgcttactttatcaaaatcctttacaaggttggcttcaatggatgaattattttcatattcttcccagagctccttgatctcatcagctacaaaaaacagaacactaaaagtagtgaagattgatgtcaaacatcatccttcatgaactcggacgtcacatcccaaatggacacaaacctattggtcctccaccgagaacttcacacatttcatttagagccttttgttcacggcggcttttttccgctttaggtataccgtcggatggagtaatgtcaccaacaatagctgtcaaacaaaaaggataaaaacctgaatataaaaggatgctaagaaaagtgggaacatacagattatacagtcctagaataaggatgataaatattggcagatgaagtgcaataacatattatcaacaagtgcatacaatagaaaattaagctaaaaacagctgatagggtgttctttggcataccttcagcaatgtcatgcacgatagcaattttgatgcatctgttttaggtaaaataaatatgtcatcacaaacaagtaaataactaatgactaatttagaaaggaagcctgaaacatctggtattttgttgtaatcaattaactagatgaacaaagaacagacgaaagggcattttttaatgctatggaaatttgaataagaaaaacacggacctttctcgatctacagcaggtaggtcaccggcaatcaaagccataagggccatacggtacatgtgatcagcaatagactcaggaccctttatgctatggtttatccagcctttccttttagtggtctgtataacagaacagaaacatgcacaactcaatatatcgcagaataataacgagtataatagacctaggcaacacatgcatggagagatgaacaattgaacaggatccagacgcttgttcatatgcttgttgctggtcacacatcccacctacttatgacatcgtaagcaaggtacccatgatgcgagacttcatggaatcatggtaatcaattcacaatacaaaatggcgattatgaaacccctcatagctgttccacattccccaagctgttactctagaaattaagggggtatcaccagcccggttgtacacacgcggtcagcgaaggacaggcatatgccttcggagcgacgtatccagaggcgatcggatcacgaggaacatcccgttggcgtaccttaaggcgatggcagagggtgaggaaatcgatggccgaggaggcagacgacgccgcggcggagggcggcgccgcggcggccgcgtcggccggcgcaggcgtcgtccgcctagggacgggcgatccgccgggtccagggatcccggaggcggcgcggacgccgggcgcgaggcggcgccgcgccgggcgctccacggggagcgaggccgggaggatgccccgcggcgcgcggcgctggaggccgccccctggaggggccggcagccgcgtggtcacgcccatcggaggtagggctcgaggtgcgctgtggatcggagcttgtggtggtggcggaggcggaaggctacggatcaatgggatgggatcgccggaggaataggcagcggcggcgggtctcctctcctctcctttgcctctgctcggggtaggtaggatcacgaccgcacgagacgaaggcgtccgatcggacggccaggggtgcatccgctcgaacatgccgtaacgcctcgtgatcatccggccgtccattccgtccattttaatcgttcgccgttcattacgcaggagcagcacatggtgctagtgctatagggacaagccaattttgcttgcgcgtcatcttgattcgtgctctaaacagcatctggaatcgagtactcggaattatacatcctgattttgttcttttattaacattctgcaaagatgtcgattacactgcaatagtacagtgggtctacttcatgaccatatatgatgagattgtaaacttcgtcggcagctctgtcacaataatctcttctaagctcgatcttatcataggccaagcattaggattcgcagcgatcatacgacgatgaagctgaggtgctggaccgttaaggcatttacatcaatcacacagctcctcaaattagccatagcgaatgcgattagattacactgagatatagcgataacaaattatcagtgacgccatcagatcaagttcgtcaggggcctcggtgccgaccgaagcacgagaagcatccctgtggctggtcggtcgggatcatgccaccgcccttggacgtgtcgatcgcctccagcatggacaccacctccgccatcgccggccgcttgtccgggttcgcgtcccagcagcgcttcatcacgttggccaaggagctagggcagcagcgcggtatctcaggcctcaagttctgtagtacatcatcaatcaaggatggtgattttcttttcagtgcttcagagttcaggaatcagagaggtgaagtggggaaaacgggataggacggcgtttttttttatttacctgacgaacaacagctgaagtgacctctgagaaactcagatcaggatacggcatatcgcagcagtatatctcccataggcagattccaaagctatatacatcacacttcctgttgtaaggatggccgttgagaacctgcacaatgatgccaacgtatgacagtaaggacaataacagtagactagaattacggaagaatggtacgtgcaattttggaagatcgcagaaacacaacatgacaatgaataagatgattgaggggatgcagggttaagattttccattcgccaagcaataagttttttgaacgataccagcaaggaaattttcagtgacatatagtcacttttcccttcttaattcgatagtttggtataagtaaagacctatcagcataaatgatacatgatcagcataagatttccgtatggttgaaggaaaatacctcgggtgccatgtaaccaagtgtgcctgtttcacccgtcatatcactaggatttgaagcctcaattcgtgcaacaccaaaatcagcgattttcactgttcttgatttgtcaaggagcatattttcagtcttcacatcacgatgaactatcttctttgagtgaagatagcttaatctgtcagtgcaaatcccacaacaaaatcttctgagattaaaacggaataatagatgtaaatccagaaaaaggaccaagagaaacatatattattacttaccccctagcaaggtcaagagccaattggaccacaactttataggctagcttccttctcctgttctttatcagaaaatttttcagtgcacctccggcaaggtactcgacaacaacgcagcaaatattacttggcatgccaaaatgtccatgttctgtctgtatatttaaatctcttgcacccattatagccccaataaactgtcagttaaatttcaagatattgtcaggacccagttgagaagcagaagacaactacgttcaccaagtgaatgaaaaaaataatgataattgttgatagctcaaaatgaactgtgtagatggcagatactaatatttattgcttggtaaattcggcaccatgttctaaaatcaattccattgtaattatgccataccaaataggagtacgcaccttcaaataggagtacgcaccttcgctactattatcagaaaaaaaatattgtccaattatacaagattctaatgctctttagcagtgcatggctaaacaccttaataactattttatacagaagaggaaaacatggaatccaattttagacacgatactgggtgtattatatagctagcaccagagtttgaacatgactgccagtcctcctactgtcatatctgatatctctagccatgaaaatattattgcaccacaaccaatggtttccttaatagattataatgccagagatacatcatgataaaacaagtttgcccatgtggttgtgccggacaatattgaatacaaattggttttgtaaaccagggctaataaatgtaaatttcccaaatgttctgtaaaccagagataatgtaaattggtctatatatttatcagtgaaacgatttaacctatgaaatttgaagggatgaaaaaaaaaagtcttctccagtcaaagattaccttggtaacatttggatgatcaagcttatgccagacagcgacctcttgtgcaaatgctgctcttagtgaagaaatttctcgttctgatctatggccatcctccccccagtcaagcattttgactggatgatagagaagatatatcagttacttcgacaatgaaactacaagtagaaataaaaagtcttttttgcatttagcaattgattcgaagacaaagttatattgaagtagtaatgctgcatattactacatcaatacacattctttttttaatgtaaatcaatagcacattcttgatgagggtaacaaaatcttggtgaactgtgcatgtctctgttttcctaaaagtgtatttagcaattagctgttaattgccaagtttgaatctatctgggggaatataatgtgacaagtgatgaattattcatgcaaaagcagtgaggaagctggttttgtcatacaaactaaagtggtagagaaaggcaagccaataaaaaactccagtgagttagcaaatactttgaaaaataaaaaaaagaacatgctggaggaacactgccatttaaaggaagctgatggggacttgaaccctgactaaaaccaccgctaccttgtgctaccaggttacatgagcatcaccaagtgatttaggattctaatgacctcttatgaatctaactgatactttccatttcaagacattgtactcaatttcctggtgaaccaatatattgaaaggacggcatgcaataggtgataaagttctggacagaaaaaaccactgcatctgcttttgccttctgtcatgtgattatagctggtgatacagtgcaaaattgctaatccggaccttttatcaacccgaatttggttcagatgcttttgaattttcctggtccctgaaaagtactgtgcctagttgcaacttgcaactttttgatctgaaatatccgctgctttaatatgtaatcttcaacttccaggtgctcatcataagacaaaacacatgaatcatgcctattaaaacttttaactgttggttggttcaatcacatgagaagggttgcacgccaaaagcacgcttatctacccagaagtcacggaatacaccatggaatcaagaaaagcagaggtatcacctttagcaatttgctgacaaggaaaagcactaatgacacgacgagcgaaaacaacttccaaaagcacccgaaacaaccgcacctatggtaaatgacgtttgccatctatcaatcgatcggctctactccataatccatatcctaatccaggaagaagaacataccgatgaaaataattaaatcacgcatcaaactttcctaaaaacttggagaggaatcgatcggaaccagaagctaacgcaggcagaagaagccactaacgagtactagtaagcaacaggccatttcatcgaatagctcatggtcatggacagcaaaaaaaacttggtcagcgccgagtggacgaatatatctgcaaagcaatcagctgtttatagcagaggggcgaaagaaaaaaaaataccagcgacgtcctggccgtcgtagacgccgcggtggacggtgccgaacgtgccgcgggcgatgacgcctctgatgacgagcttggcggggtcgatctcccagtcctcccggcgccgctgatggtgcggcgcctgcggcggctcctccccgagcccgagcctggcggactcgccgcggcggctcccgctgcccccgtgctgcgacgcggcccgctccgcggggcggccgaggtggcgctccagctgctcgtcgaggctcttgaggtcgatctggtccgcccggacgaacccggcgtccccgctcccgccgcccgcgccgggatgcctcatcgcgctcaaacctgtcgtcggagctagcgatcgatcgagcgagctgggggggttgggttcggtggcccggggtgggtggaacgtctctgtactctggtggcgttgtggatgccgcggcgtggtggtggtggtggtcgcggtggctacaggggaaggggacgggttggcgaggcggggacggaggcggttcgaggtcgtcgtgtttggggagacgacgacgactccatgtgagagcgcattggggtgtggggggaaggcgaagtactaggcgcactaggagtaggccagtgatgatgacaacttgacaagtggtgaccgaaggagactcgtgtcgcgggggtggggcccgactggagggggggtcgtcagggagtcggaaagtcagagctcaggaggtttcgtttgtgtcattgggcccatttggcatctttttcggccgggccattggcccattagcatctgatttcgcataccgtgtgaactgtgaagtagtatcacgtgtgagttgtgatggcgtgagtctcgcgcctgcgcgcaaaacggtgcggccgttttttccgaatgttttgctcccttcaaatcttttccagtctacatagaatatataggagtattttgttgaactagtagcgggtgcactactacgtagtactatacctgtacaagtgtaatgtttgcaaattgcaatattattatcgttacgtagctgttttagtactgttaaaacctgtagaaaaattgcctcccacgaaaatctacagagaactgaaatgacagtagaaaaattggaaaaaaaagaggaattgtttttattaaaacaatcgcttgaaagtggtcctagaaccgtagttttattctaaaacgttccaaagagagaaacgtcaggctttctagtcggaataagttcacttcattacccatttgatcgaaatctaaaccataactctaaactacaaaaccagatatctcgatcttcaaactcctaaaaccggtgtaattggactccctgagcggttttgggggacggttttgctgacgtggcgccatgtggcgcctacgtggcaatattgaccgagtctttgttacacgtggtgttgatgtggcacctacgtggcggtagaaataaaaagtatgcgtgggacccattagtcattcacacaaaaagaaatgtgggcccaccttcttcctcctccctctctcccttctctctctttctttccccttcttccccttcggctggtggcgcgcggggacagcgagagcgagcggcgtcggcatcgggcggcggcggcggcggtgcgggagaggagctggacgaggaggcagtaggcgcggagggagtggggggtcgacgacgacggcgacgaggaggcggcccagtagaagaaggtgagcgcgttcctggcgacgagctccggggaggagaagtggcagtgcttggcgaggagaggaggacggcgtcgacatgatcggcagcggggaaggcggcggagagcgcctccactgtcgctctcggatggtgcgcgaggtagtgggagatgcgccgaggcgtcgtggcggcggtgacgacgatagcgcacggcggaggaactcgccggccgtcggcacgcaggggaggaactcgccggccgtccgcgcgtggggaggggctcgccggccgtccgcgagcgggggaggggctggagctcgccggtggtagggagcagcggcgaaggggaagaaggggagagaaagagagaaaagggagagagggaggaggaagaaggtctgacatgtgggccccacatgtcagtgggcccatatttctttttgtgtgaatgactaatgggtcccacgcatactttttatttctactgccacgtaggtgccaagtcaatgccacgtgttacaaagactcgatcaatattgcacgtaggcgccacgtagcgccacgtcaggaaaaccgcctctcaaaaccgctcagggagtcaaattgcaccggttttaggagtttgggggtcgagatatctggttttgtagtttagggtcatggtttagatttcgatcacatttgagggtcatgaagtgaacttattccctttctagtcctgtaacaactttctacgtaaaattagagcccacgaaggcgacaattctggcccgttacagcgcctgaagaacagaaggcctagacagcagtcttgggccgcatcgagccatacaagcccaggaaataaagcagcccagttcaattctatcctgttactactaatttaatcgcgagaaaaatccccagcgggagagctcacgaactgttcccttcccatggcggcgctgcctctcctccggtggggcgcttcctccctccgaggaggccactcctccgctccgccttcgagccgcctcttctccgcgctccgccgacctcccgccgccgcccgctgcgagcccggctcgagggtcatgctcaaggggatggactaccctgagctcgaggtaagagtactcctctcggcgtacgagttccgtggatccgtttgcgagttgttggtcggaggtttccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18094 - DNA, 474 bp, Oryza sativa
attcttgccgggttgtataatcaagccttctcctcagcatggcgtgtactacatgcccctcttgtaacaagctcgaataatatttgatggataaaacaactttccctgaactagacacgaatagtatttgatgggtaaacacaactttcccatgaacatacttgttaggcgttcgaggccatgtcttggttaaataggaggccaaccctttgttccgggtgcctgctacaacataaataaaatatgccaatggaaattgtcatggttatgaataaggcatacctcctttcctatgaattacgaaatatacggatatggtataccttcgtatatacgatatattcccatatatgataaggaaaactagaagatattatggaaaatatcctcatggactggtgattaaccgagtcctactcagagatgattgggtttattctatatcatgcaggtttattgtctccgagttctact

SEQ ID NO: 18095 - DNA, 3399 bp, Oryza sativa
tcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattctattcgcttatcaattagagtaatatttgtactctattatcaatttgttattgtgtgcctcggctgattcctggacgagggttcacacacatgtaagcgtttggaattttggatagaaattccgggcgtgacaagttggtatcagagcctctttgaccttaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtgttattagtactgtacatctattactgactaatggctcatttaccagcaaaagttttacaatactgttttatttaatcttgctgcaataaaataaatttagtatgttgattttataactttcttttgaaacctgttgttaaaaagtacaaaatttgtgaccttgtttccaactatttcaaattatctcgcaaagcttggtttactttatttacttcccttctactttgatttctaaaccttattcaaattaatccaaaaacttgtgctattaattggatagatgtcttaactccctcctttcacttgtctttagatgccgtgttacaagcctgagtacctgtttggtgttgagggttttgtccaggagttgcgtacgatgtcctttgtcattggatttgggactgcccctttttatgcccagattcgtcatgatcgtcatgaagagaagtgccgagtcaaagtcaccatgaacagtaatagtgaagatatcccctcagcgatgttcgaagctggaggaagaaactacatccatgcatgtcaggaagtggcaaggatcgccataggagagctccgtgatagctacagtgatcaattggccgacactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcattataagtagtgatgaagaagaagaacccaagcgcaacaattccaagtttgagtgggtagctatcaaagatgaggaagatgagccgaacgagcctttaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcaacgggaatggtcctaacctcaacaaccccaataacaacaacaatggagagaatccaacccttgctcaagttcttgctcaacagactcagttaatgcacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgcttactcagggatctcgctctgttacggagtatctgcacgaattcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctactgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagccc

SEQ ID NO: 18096 - DNA, 681 bp, Oryza sativa
attcctgcagccccgcgcatatcaccgtaacttgcttgaagaacttgttcatcagcaggcagtggcatgatattaatcacaacctacacaacaaacattagtatacggtggttaattacatgacagagtgatcaaacaccaaccaattaaaccgacctttacaatgtttataataaggtattccctttcggcaaccactccaaaagctctcctcacctgctgaatgctaatctctgttactgaaaccactcaaacacttgattagatcgaaaaccttaatcagagcctcccactgcagctgcagcgaggacagccatggcgtctccgaacagcgaagctctggaacggtacaagaacgccatcacggcggcctcctccgtcgtgggcgctgccatgctgctgcgccggatcgtcgccgacgtcctcccggacacggccctgggcgcgctgctcctcctgccgccaccctcgtcccgccgccactgcgtggtcatcgaggagttcgacggcgccttctacaaccgcgtcttcctcgcggccaaggcgtacgtctccaccctcctcgccgcggcgcccgtgccgctgatgaaagcgagcctgccgcgcggcgccggcgcggagcaaatcacgctcgccatgcgccccggcacggcggtcgtggacgtgttcgacggggcggag

SEQ ID NO: 18097 - DNA, 11804 bp, Oryza sativa
tttgcggagggatttgatttgggaaggatttggattcgggattgaacttgacgatcgatcggggatttgagatccggaattggcacggacactagacaataagcaaggaaacagatttcgaaattagggtttttaggaattacattttcccgctaggcgccacgacggaacgggcgctacagctagatgtgttgccaccacccccccccccccctaaacatgccgcataagattggatgatgaggtggaagaaataagtgaggaaatagaaaatgaggcacccgtcatgtaacctccacacaaacctaaaaaaaagatgaaagaaagagtggatatggcatacaaataaaataaaatcatttgggttagtatgctagaggtagtgtaggtgtgatgtattgtatatatcacctctgatcttacatggataaaattagatgtggcaaccactcctattacaaaacttgctctaactattatatgaattggctattaaattgactatagatgatttggagccaatagctggctataccattaaacttgctctgagcagactgatgtctctgctatcgctggcaatggcaatgtctctgcatacaccttgaatgattgtagggatagcacagcaatcccctgtttagaacataataaaatcgtaggatcttatagccgtttcacaaattcaatttcggttggaatagggagaattttctactacgtttaaaatggggccctaactaggagttcatgttagcagacatatggatttgagaatctgtcattacgttttacagaaggcgccaacaattgagtcgactgcattcctgtatgttgctcggctgattgcgtcgtcctcccagaattcctgcgacctgcacgttactctcctgcaccccaaccaacgtgctgaccgctgcggttactccaacacaaatcttggtcatttaaactagtataaaatcttctgtccccaaaaaatcttcgaactgatttctcctgggttctccacttctccgtgccttccttgggcaaaccaaattcgtcaagtggctgtagttaacatgacgcctttcgtccaaaaaactcatgtgaatagttgtattctaagcaagcttatctcgtatcgttctgcaatcaacatatctcagttgcatgctattacctgtttgaaatagctccaagtccaagatttcttcgaatgagctattcttagctccataaatctaaatccacaattatattaataacatttagataaactattttgttcctaatttgacttataaacttcagatttaacatggtggatattaaatccagggatgtgctttatatatttgaaccacccagattgatccgggcgggtaagagatcaggatagctgaccagacggccaagtgcatggacacgcaagttttggcatgccaatttttggtaaggccaacatgtgtttggattgaagccaaattaaactaatttagctattgaaatggcctatgttatataggcatgccaaaatttggcttcaatccaaacatacacaattattgttgaggttgccaaaaaattggcaagcctaatttaggcctcaaaccaaactggcccgtaccgctcgaattgtgacaaaaatgtaatacacagataacacacagaatatgtgtatgcacataacaaaaacttgttcaaaccattctaatgttaacgaagcatgagatatttcttttctctgctttcaattccaccaccgatgatctgatgatcaacataattcacagttgctcaccgtgaccaactcttcacacagtgacttctttcttggatgttatgccataaactttctacaaaactaacatcaaccttactgttaaccaacgccctcttcatcaaattttcagttcagctcagcatccttttggatttcctgatgctgggctagtatttacttgtaacaatggctttgaagattttattacgacattttcttttggaaaactcatccagggacattgaagtgaaagagccaagatataacaaaagcaaacaccatgcaagcaagaaggaagttgagaaaccggtggccttgccaaaacctccgaggttcactggcaggcatttgcgaagccgcggtgttacttgattcattccactgctcgatgaactcggcatcaccgatacctaccacattgcatgcagttgagccacagatttcgcagatcctaagacaagtaaaggaacatggagcattttaattttctagattccaattgcaaaagcagaaaatggagttatgcttatgtagttatattacagatcataaggagaataatgctaacacattcttttatgcctctacaatacaaagagagtaacaacattatgaatgctttaacaattaatatttcacttgaaccactatcaaagcacaacatgaagtggaagggcacaagtgcagttacatctcaacactgatcaatagcacagatgcttgtaatttggtcagaaatatcaagcatgtatttatcttatcctgactctaatcctcacctcaattgaggtgataaaacccaagtaactatgttggtacgatatactagcacaaaaacaggttcccactttcaatattatattcccttccatttaagcaacagtaatacacaaaaggctgtgaaatacaccttaattcagagctctggtcctagcatttaccaacagtcatcccatagtaactagaggctagggatgtaaaacattttcactatctaaaaaaagtaactataactataaaatgcataataaaggaaatactggtgttagtaaaacagtgaacatatgtatagggagaaaatagcccatccatctggatgcttgcctcaagggactatctgttatatttctcttgtgaatgttgtactgaaaaacaccaatcatttaattgcttaaagatgatagcttgatgcaaatttattttccattcatattggttctacatggtacatgctcatcaaatgatttgaagagcaaggataggataagaaacaatcttcagcttactatatcttactcatatattcttgtatgaggaccctccatcttcttctttttttctcacttcatttttttaatagttaagattaattagtatgtataccagtgagaattctaatagtctagttccttggaattcgatgtcagataaacatagctcgtgatctcttaatgaaatgaccgtcaggtaacttaactactattggccataatgttcgtgtagaagtatctaagtacattcttttaggaatgtgacaccatagcactccctatagagtctagatcaccacaacgaaggcatgccaagaaaagggtcagcgcttccactttcggagatcatgagagttacacaagaatctgcaagaaaaagcagaccgaaaggaatctaactttatcctccatctgaaatgttctacaccatgttggggttcctaagcttttcctagatcctactggttaatcatactccactttgcccttacctctcacatcacactctatccttcatatccctacctaaataaagcaaaaacaaggaacatttcgtactaaaagatccatccagttacagtagccaaatattttcattcgagtttgtgcatagtattagcagattaaatcatcagaagtgaagtgtggaattagcagcagctgagagatattacctgtttcccctgatcttgaaccaggtctcggcgcactgcttatgggcgcaggagaggtcgtccttgcaggagcagccgaggaacatgccggagccggactcggcggcggcgctctcgaggccgaggtggcagatgcggcaattcctctcggccgtgtccgggctggccttgctgatctcggccagcccggcctcgaggtccacgtcgcccagcgagcactccgacacgcacgacttcctcctgccgccgccgtccgcgtccgcgtccccggcgccggagcggacggacgcgcacgtcgagatgaagtcctcgagggcaacggagccctggcgcgagtgcgaccgccatgagtggtcctccgcgtcggagaagcgctggctccccttatcctcatccgagctctcctccgcaagcccgcctcctcctcctccgccgccgccgacgtggcgggccggctccgcgctagaatccgcggcggcggcgggagcgatcgtcaacgcctgctcgccgtcgttcaccattgctcacgccaaacaaacctaccaaaaaaaaaaagcaattcgagaaaaaaaggaaaagaatcactcgaaattgcttctataccaaatccggacaagagcagagaagggagcaagcaaacaagaatcgccgaaagcgagcactaaatactcactcttgcagttacaggttactccaaagctgacggtgtgccaccacgcaagcaatgcggccgatcactgggagcaaccacccaagaaaaatccaagctgccagtagattctaagctctaaaaaaataacgaattgaaaatatactgctaccgacgaggcatcaggtgcctaaaaaagattggattttaaagctgtttcttgatccacagtggcgcagagagagaagcgagaaagcgaggaagagtcgcgtagctgggaagaatcgattgaacaaggagtaggcgaaagagagaaggggaaaaaagaaaagagaaaacttgcggagttgtggtgctttgtcggggacgaaggggaagagaagaggagaagaaatgaagcatatgagacggtctcttgggtcagcaatgaagtagagaagaccgtgtcatgtgatgggagagaagaaattgaccatccacgagtttttgcttcacgaaaaatctcgtgttggtgtacacagcccccgcgccaactgtgaatttgatcccgttcgacacctgttttgcctagaatttttatggttgacaacgctatcaccttttaatcttactctaatcattaagcagagttaacgtaaagctctacgtggataccaccgaaggccatattttagggaaacgaataccatcttttcatttatacttatacttaggaccaaaatttaaattttcactcaaatttaaagttgatttttgaaattttttcactaaaatttatttttctgcctttatttttagatcgctaagagtacgtatataaaacttttatttataaattatttttcggttgtaaatataccgtttcatttatttctcgaataagccaaataaggaggccggcctttcactcactcaactttacctgaatctagtcgcaaatcttttttattttttgagaatctagtcacaaatcattggtcgatggcgcccgtcacctggattcgaaacggagctttcagtgaagcagcagctaattaaccggtggcacttgggcaccgccaccttccgtcttcagaagttgagatatacacaacgagatatttctgtcgcggcgccgcccgaatcctcctcttttcgccgcccgcactatgcttttcagctctcctcagtcctcacagtgattcacagcgctcgccatcacactctcgtgcatctcgccgccgatcagatgcactggatatgggcaccgccgatatcctcggctatccctcctgtatatttatccatctttcgcgtgattccaacagcaaaaaaagattctgaatgctgggagtagctaggagaaagaaaaattgtcctctgtttattttctagcggcggacggtgtgtacgaaccatctataaatcgacctagcacaaaataagataacctctatttaaatatattgtagtaggttatatggcatcacaatctaagttaattttatttaggacatatatatttattatagtagattatatcacatcataatctaagttgatttattttaggacagagagtaagatagatacactgcttgatgtttgaccgatgatcaactgtacctacctaaaagacgcgaatactaaggaatgacctaatatcaaataattagaaaaggtgaggcttcgaactcaaatcgtctagcccaccaccatatgaagctagccagaagagtcctggaagtttcatgatggtcaactgtacctatcaaaatagggaaggaactgtgcgtgcaaacaggcttacatccgggcatgtttagatcacgaaatgaaaatttttgggtgtcacatcggacgtttgaccggatgtcgaaaagggttttcggacacgaatgaaaaaactaatttcataactcgcatggaaaccgcgagacgaatcttttaagcttaattaatccgccattagcacatgtgggttactgtagcacttatggctaatcatagacttatggctaatcatagactaattaaaagtatctatagggttttagctgtccaaagattcgatatgatattttttgaaaaaaaaaattagaactaaacagggcctcaggagtctatctacagccgacagctgactactagctgggtaggagtagtgccgatggtgagacaaaaatagtttcggcgatctttgttggtttctggtggagaacaaagtcgtctccggtttggatccatctatctatctattatattattaaaggaatagaaaaaagagcctccacgttcgctctcatggtctagaaattctcacattaatcggagaaaaagaaaaaacagagtccatatagaaatacaatttagaaatagctaaaattcggaattaaaaaataagaaatattagaagaggagactagagtccatatagaaatacaatttagaaatagtgaaaattcgaaattaaaaaataagaaatattagaagaggagactagagtccatatagaaatacaattaggaaataactgaaattcggaattaaaaacaaggaatattagaagtagagtatagagtccatatagaaatacaattatgaaataatagaaattaggaattaaaaataagaaatattagaagtagattatagagtccatatagaaatacaattaagaaaaaaaatagaaattcggaattaaaaaataaggaatattagaagtagagtgtagagtccatatagaaatttaaaactaaaattaaaagtagagttttgagtccgtataaaaatacaatttacaaataactaaaattcaaaattaagaaaaacatgggaagaagagtttaaagtcaatataggaatacaatttagaagtaactgaaattcgaaattaaaaatttaagaatattgagagatgagtttagagtccacatataaatacaattagaaataataaaaattcagaaatcaaaataaataatattggaagaagagtatagagtctatatagaaatacaatttacagaaaattcggaattaaaaatattaaaatttggaattaaaaaaaatattaaaaaacgagtctagagtacatacaggaatatatataatttacaaataactaaaatttgatattaaaaataattaataactaacacgtatataaaatacagtgtgaatattacacatttgtagtttcgtaaagttattgcaaaatttaaaattatgatgtcattttaatatatttgaataatataataagaaaacatatatgctattatacgagagaaaatataatgatgctagccgcgtaatctgcgcgggccaccatacaccatactagtttattattaagcttacaaaaccatccttatatgggacagaacaaagaacaaaggagaggaactgaactgacacactgcaagattcgtgttatcaaaaggctggaactggaagtgccttcggccatgcgcagcaccacaagtccacaattcaacccaactatacatatcgcaacttaacagcagaagattctacgagcaagatcagccaaaaccctatagacacttctgttggagaaaaatcagtacacgattagcaaatcatcactcgtagcaaaaaccagaacaatccaactggattgaagatgatgggcactgacaccgagtgaagaatgaagccccacgatcgcccaaaaatccaataaattatacttgctgatgctacctctgaactaacacatgcaaggagtgcaggaatccagggagatctaaaccatctcggctgggaaggtaaaatactaatccaactacccagcaaaaccatgaaaccagtctaagcagcaccctgtatccatttcctgatgaattgtgcagaaattttcgatgcacccagttatttccaaatcacatccatagccggtcccatgaaatacagaatctttatatcagcatgacaggatgcatatcctataatttgagacaggtcccccgggcctaccagtcgatgacaaagcaacaggctgcttcagctttcatcttccaaaagattgtatagcctgtacacacatcgatatttctcaccggttaaagcgaagatgggcatgataagggattaggtgcaaattctcccacagtcccactctggcatcaacaaagcaacagacaagtagaccataatccatgcagtatactacataaattaggctttgcaattttgcatggtctatctctctgaaactaccctttagtgtctaaatattgcctatggaacctcaagaaaacaaaagagttatttcgtccagcaaattcgtagtaaatccacagaaattacaggcaagaacacctgaggagcctgtacaatctgatctttatctgcctttgtaaactagatgtgtctagatcacctgaggagcctgtacaatctgatctttatctgcctttgtaaactagatgtgtctagatcaagagtgtggcatataaagttacagcaacatcataaatacaaataacagtggggcaggtccacaaaacgaaaggatttacaacccaggtcatatcatggatgtatttgcaaatatatcataatcatactaatgaaaatttcttgaacaacaagagatataattaacaataaaaaatgaaactatttgtcatccctcaaaaggaaagcgagcagtggtaactggtaagtagatggactaatggactactagaaggaagacgggagatgatcgcagaagatagatcaaaccttggcaattctggcagtgttcaatattttaactcctcatgaatgtgccagcattcatcttcccagagatatgaattggtcactgataaaaaaaaaagtaacagcacaagacctcagcaattatggaagacattgaacagactagggcaatacctggtcccaaatgaaaatttgaaaggaaaaaaagcgggatagtaaatgctggtctctatcctaataagtgcaaagcagaatgtacaaacccatgaaagcaagcctgaccagctttgtgtctattgtgatattgtgattgtactatcttctagtcaattatcacagttcacaaatcgataaccaaaaacatactcatctataacttcgtataactgataactgcatagaggaaaaagcatataacctgatagtcctccgcaattcaaacgcagtaacacttgacgaaacctgatctttaagaaacatggataactggtgaaccactagaggcatgaaactacaatttcagctacaccattattttggttttgtatacttccaagaaaaggaaagaccactcattttaagcaaagcgaaagatagaacactacatcatttctaaagcactactgcaaataaataaataaataaatatatgatagcaggtagtagataataaacgaattttaagtgaagatacttattccatttcaattatataatagtctggtgatgcatggttaaaagctctcgggaaaagggaggaaatcctacttgttctcacagacaggaaaggaattaaccctcaattttgcgcagcatatttacgacttaccattatagtattagatgctattatcagcattgaactcaaatatatgaatcacccctaaatcatgaaaaccaccatcattaagaaaccctgattcgaaattagcttgagaaaagttgagtcttcatagtacactaaaccgaatcgcataattacactaaacggtttattctgcctaaggaatagtcatgcatatgcaacaaaatgtaacaaaattaaatctcaactttcaaggatcatagttggaaataaacatttgcgcaaatccaagagagtaacctaatgtttcttttttcaaattttaattctctgcacttaatcggttgtcatcacaattttgtatgatagcactgttctattgctaatgtattttaatttatcagttgactttatttatgccagacatagcacatagacagatcccacatgttccctagtaaacaaaaattctcatatattagattattccattatcagaagatcttgattcctgatgttattaaaaaaaactgtggcacaagtcaataactataacatcaaataatactaatttcatgagtcattaaaaggggggagagagagagtcattatttgacaattaatatttaacaacaaatgacaattataatattcacttctcatagctgagggcttgttctatttataaaatttagtattcagacatggaactaaaaatatcattaaattacgatcaggattgcctagtaagtttttctaaaattccatttttgaggtaggcttgtcccaatgcctaagcagaacctccatgcttcacctagttgggtactgagcacctgaaataaaatatggtaagaactgcaagtactacatgcatgtccatctaccaaaaatacaacaataaccatgatttgacttgattacaccttaatatataaaaattgactccaaaagtttcatctcactaatttacattatcctaatctgttaagctggtggaacagaccgcgctaaggtgtcactgctttgcaaaccacttttcatccaggcaatgctgctaatttctgacaccaacgaagcaaaactactatctgaaattggtggatgatcttcaaactcattaaactcgggacccagcaatgagttcttacgaagttgcccatgagaactgcagcagccatgcccacatttatttggcacctcagcagcaaaacttgtaggatcaacaaacttgcagaccccattttcaggcttgaaaggatgaaggtttgagtcaaacttggtggcaaagctcagcatttccttttgtgatgattgagcaggtcctacattgtatggtttgaatgcaccaacctttgcaactggtcgggcaagataaggtggatcaacaacttcagttttgcaactctgatccccgatttgccatgccccaacataactttcagatactgtttgtgcgggagcttccattgcttccctaacatttaaggaactaagattgcccaatggccaaggttcttctgaaaccgacctaggcctctccggaatagctctcttcataacaccaccttgtgtgcatcggccaccagtgcagtgccgacgcctcagggtagagttccagtgattcttgattgcattatcggttctcccaaccaaaagctttgcaatagccgcccacttgtttccatggattgcatgagcagccattataatgcggtcttcctcctctgcagaaacagcaataataatttaacaagcaagttttacagagatgcaacgaaactacacaacagactgaacgcgcaatgttcatgcccataatgctacaaccaaactagcattgcctcatagacaagacaaatactctttggattaaggttaacatcacgtatcctataggatacagatactactggatgaaagg

SEQ ID NO: 18098 - DNA, 5122 bp, Oryza sativa
gatgggtggctaggttggggcagggaccggactgggagtgggacgcgcgtctcgccgtcgacggccacgggaggggaggaggacgacgatgaggagcgatgcggttgggactcgtcgggatgggctcctgcgccgtgcgtctcgtcggtcatggaggcggggctggaatgggtggagtcggcggccggtggattcggcggcggcggcggcggcgaagcggcggtttcggacgacatggtggtggctggtgctgtggggttggtgctagttcgttcgttgtggcgagtgttccggagacgtgccctttcattttctatcctccgttgactgacttccgggtcccatattgtcagtcatcttcgcgtgggcctctcggcccttcgattattaaatgggctttttggagcccatcgaggtccctttagatggaccaggatttcagcccatccaaacgaggtctcaggcaatccattgcagatttgcagcgttgtggaaaacggcgtaccacggtaccagccatttaatttgatgaatatgaaaaattaagtacaattattttaaatttgaaatagatttatatgatattttaaagcagcttatatatagaaaatttttgcatgaaatgtaccatttagcggtttgaaaagcatactactccctctgtttcgggttgtaagacgttttgactttggtcaaagataaattattttaagtttgactaaatttataaacaaatataataatatttagaatactgaattagtggcatcaaatcaataattgaatatattttcataataaatttgtcttggattaaaaatgttattacttttttctacaaacctggtcaaacttaaagcagtttgactttgaccaaagttaaaacgtcttataacctgaaatgaagggagtgacaaaaaccaaggtaaaatttgcatcttaattagaaaaaaatgaggaatatttttgtttctttaacaattaatcatatgcttttttaatcatcggaataatcttttgtatattgcattttttttttaagataatgggagaaccggcctctacatcctgagacggatgcacacagccaattcgtatattgcacttgatgatcatttaaagtattgcatcttccatgatcttgtttagtgttgtttatatttatttatatattttttatgttttatctatccgatataaaccaaacctcatgactatttggtgtactacagcgtgtgaagctatattttgggttaatgttaaactatggctgttcagttaaaaaatagtatgaacatatttgattctagtgttgactacttctcccattcatgtagcgtgggcgtttttcatttttcaactctcagaaaaataagaaaccgtttcctccctcaaaattaaaagaaatcgttttcaagccgttgttggatcaacttgtcccccaaaaaagaaaaaattggcatatggcctatacatatggctgggttgataaagatgttcgtagcaaatagtagtgttgttctttgccacacactgacacaccggccgggacagcaaataggtgaatctactcggtatgtaaagacttgggcaggtatacgtgcgtgaggtgatggctgcatggcgccgttgctttcctgtaccaaatcttgacaatagtaacctgactaaactagctaggcgaataaaactgcatgtttcaccgtcactctgcccatcccacgctcttgtttgttccccagatcaatttgtccatgtacaaccagacattcacaatcaaaactattgttttcactgtcaagtggagtaaaattagacgcagtagacaacatgcaagtggtgtattttctttgtgtgccttgttggtctcatctgtgactaatacaaaaacaataacgaaggagtgagcaacgatttggttcctacaatcttttgcgctatatgtatattcctgtctggacaaaaaatgatactacagagttatgcaaatatgcattcatgctggaaatggatttcctgatcacaagtacttgatgaaatggatttcctgataacaacttgttggcttcgaatttttttgaggattaatattatttttatggaaaatcgcaaaagtagtggccaaccggggaaaatcgcgaaagtaggtccctgtcgaacgggtgcaattcgatagggcacctatcgaacgacggacagtcgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtctccccagcccgcgatgcttgttcgatttatttgaggaccacatcgccagccgccgtcgagagtcgccacatcgtcgccgtgagcgccggagggagcgaggggaggggatagcaggccggagaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttatcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaaaatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgtttgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaacttacatacccgataattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccatctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagacaaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcagaatcaacaaagaaagtttgatgccatatgggagcaactggatcgtttgaccactatacacatggaagaggttaggaaaaaacccatagttgccagacaggaggagccggagggacttgaacccattcctaatgaagcaccaagtattactcggcgcaggaaacgtggacgggccacgaagtgcttcacggagtgggtagaatttgagccaagggagaaatggtcgttgttgtacgatacagatggatcgaggtatggtgtgatgacaacaaatcttgctgaagtgtataattgggttatgaagaatacacgacctctaccacttgttgctatcctggagggcatcacgaggggtacacagaagtatctctgtaaaaggtattccatggctagtctgaacctcagcaaacccgacggtacaagagtgggagcacgcagctgataacttggcacttcagacacctccagacgatgggagttattatggagcttacctt

SEQ ID NO: 18099 - DNA, 33822 bp, Oryza sativa
tcaggtctgacgacctggcgagtgtccttcgcaacttccgtgcacgtgctgccgcactactacgtcgtgtctcctgtcggagcgcggcagatgtggtgcaaacgtcgggccgacggccatcaccaccactaccccgacgttccagcgtggatcggagtggtccatcctcttcacgtcgcgggtacgaagcagcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtatggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcacttatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgttgaacggcagccttccgatctcgtcgccagtcgcgctctggccgttcgataggcgccctatcgaactgcacccgttcgacagggacctattttcgcgattttccccggttgaccactacttttgcgattttccataaaaataatattaattctcaaaaaaattcgttggcttcgatattgagttatgctaaaaaggtgtgacaatgacaagaagtttatgcaacaagcatgtcaaagcttagagaaacgatcatagagatatttgccaaccatatatagagatttagcctagtggttacagtgacctgagtagtaccccaaggtcctgagttcaaatctcttatggagcgaatttcagattgggttgtttggttcaaatctcttatggagcgaatttcagattgggttgtttgcggggctaagttccctacttcaatggccgtatatatccgattggatgtagaggccgggtaaaaaataccattctctaaaaaaaatatatatggagattgtaatatctctgtttatatggtggtgtgtccttttgctatcctgtcggttgtctgctatatataacttggagttgtctagactaaaacattgtaataggtgactaaagcttctctaaagtaaagaccgaattgttatcttaaaagaataaaaataagattacgataaagaataaatcatgtgaagtactctctccatttcaagttataaaacattttgactttggtcaaaattaaattgtttcaagtttgactaagtttatagacaaatatagtaatatttataatattaaattagttttatcaaatcaataattgaatatattttcataataaatttgtcttgggttgaaaatgttactacttttttctacaaacttgatcaaacttaaagcagtttgactttgactaaagtcaaaacgtcttataacctgaacggagggagtagtaatcaacaatacatacagagttaaaagaaaaaaaataaaaacaatacattgtttgtaaatgtctcatgcaaaaattgcttatataaattcctgaagaaacttctgaagagaattcaagtcgagactctagtctagctcaaactagctctgcaacttgcaagtgacagcgaacacaaatgagctcctggtgcttgtttaaactgaacgcgtgcaaatattatttgataaatatttacagcatataggaaaaatccactaggtggctgaatggttgcttcacctagtcttgaccagtcggcaaggggttagaaatcagactctgtagttggtattctgtagaaatgtcttgtattctctcaacatcacgtactagctgtaaagtttcaagggtagtagcaatcactgcataaatatataaattttcaataaactttgtcttgttttgttttgtctatttcgcatgtcaattagtagtcctcttttgaacttcgaagtgggttcctccttgaaagcaaaactgtaacttccactgtaaggttagtaaatactgttcaattaaaataaaatataagtcgtgatgagtacagaagaaatgtagtatggataaaaattaaaaagtcgctctaaaaagaagttcttctagatagaacttgaatcagatgcccaagcatacaagctattcctagtttctagtaaaggtacgctggagaccttgatatatggccagccatcaatcattgaaaattccttttgttttgagttattctactctcagcaaacaaggtatcagtcgttacaataagcccaggtccatgtctaggaagttgttagcagagtagttgatagaaattgtaaaaatataatgctatggtcatcatttggatatgtatgatcctagttagttgttaaagccataactaaaacacataagttatacttttaaaccttttctttttaaattttgatcagtgaaaagtaaacaatatgagtcagtctatatctgagccttgacttgggaaaccgttctaactgataataaataggaagtactctgcaataagcatccataaacttcatgttccatgagaaggattcaacaagttgcagttgaactaacaaaatgacacgcaagtcagcattattcaccccaatacttgattgatcaagtcaaccaggggcatcgggcagctatatatatagcggcattccggctgcattttgtcatccccttaacttcgacaatcactgctggtaagtgttatttctggtccccccccccccaaaaaaaaaaaaaagtccttttttcagattttgagtaaggtccagatcaatttttctgttcaccatatcattgagagttgctagctagctttggccttggaatcaaacatacggcatgtcgtgttcttggatgatcccagtgttcgctattctggcttttgttgcatccgcggcccaagctgacgtcgtggagcataccttcaatgtaatcattctctctctctctctacaaacaaaatccgcattgaattgttcatttgtcctttgcacaacaaaaaaatagtgccatgaaaactattacacacacgagtatatttttaataggaatttaatacgtataagggtttgtagttggcatccatccctcagagcttgtgttagcaggtgcactcacaagtgtgtgcatgtcatgtactcatgtacatacttagtgtagtgacgtgtgtatcttctatgtagtcgggaaaaaaaggagaaagtttgcacaaccaaggaacgtcacgaacgtgtaattgttttatagtcggtttaataacaaatatatggaaaaaatatttaatcaagtaatgtatcaaggagaagcaacaaagacaagtgataagtttaagtgatcatattttccttttttatatattttggaattatttttctagcatcttttttaatattaagatacatttttcaataacatctgatattttgtactccctcagtcccagaatgtaagaagaagttttagggttggaaacagttattaagaaagtaagtagaagtgagtggtggagggttgtgattgaatgagtagtgaaggtaggtggggaaaatgaatgatggagggttgtgattagttaggaaaagaatgttagtggagaagttgttatattttgggacaaatcctgagagctaaaagttattatattttgagacggagggagtaacagctagtagatgacatcacaccacaagttgccaaaacaaaatttctacaactaatatttattactaccagggtttttaaaaccgtgcggttaccatgcacggtaaccttttcagtttttgaaaccacggtatgtctcgcgattatcacgcggttttcacgcggtaaccgccttaccgcgggagtgcagtaactgcgccaaaaacggtaaggggaaccatgattactacctctgatcaataatattttatgtttaaaattagatttaattaaactttcaaaacttttacaatcaatatcttctaaaatgcttagttgtaaaaaatgtggagtttaccttgaaaagtactacaaagatagcacaaacttactataattccgtcccaaaatataacgactttacgtggtttaaactttctaattcaaagttgatgatcacaatttcaaaagtttgctcgaatatgtcctaaatgagagagaagatttaaactttctcgacaagcgggtagcgcggttgtatgcgagcgtccaagaaaattgtcagcttggcagcttgccacctcatatctaatattctcgtaccacacactagaaacccattatttctctgtcaattctcaagtcttgcctatggtactaaaccccagtcttaacagtcatgctcatgatattgtttctatatgatttttgtcaggtcgctacactatctcttccccgtatatgtcagccagggaatacgagcgtcaccgccgtaaacggacgagtgcccggtccccaagtcgaagcccgcgaaggcgacaccgtggtgattcacgtcatcaacgactcgccatacaacgtgacagtccactggtacatgtatctcacctactcctcgccgcccgatgtgtgacaaactaacaaacggcgcggcgaacggtgcgtacgtgcaggcatggcgtgttccagcgcggcacgccgtgggcggacgggccggcgatggtgacgcagtgccccatccggccgggccaccggtacacgtacaggttcgccgtggccgggcaggagggcaccctgtggtggcacgcgcacagctcgtacatgcgagccacggtgtacggcgccctcgtcatccggccgaggcgcgccggtggctacccgttcccgacgccatacgaggagaagaccgtcttgctgggggagtggtggaacggcgaccccgtcgccctggagagccagtccttctcgaccggcataccggcgccgaacgccgacgcgtacaccatcaacggaatgccgggagattcgtacctctgtccagagacgactaaccgtacgttcgagttagtatcacgcgcgcatatgtgtgacgattatgttctgcaacaatcaagtacgttcttgtgcaggaattgccaagttcgaggtgcgccgcgacaagacctacttgctccggatcatcaacgctgcgctcaacacggcgttcttcttcaaggtggcggggcacacgttcaccgtcgtcgcggcggacgcgagctacacggagccgtacgcgaccgacgtgatcgtgatcgcgccggggcagaccgtcgacgcgctcatggcggccgacgcctcccccggctgctaccacatggcgatctcctcctaccagagcgcgatccccttcccgccgcgtcccgcggggttcaatggcaacaccagcacagccatcgtggagtacgtcgacgcgacggcaacgaccgatgctggctcccctgtgctacccgtcatgccaaaaccgaacgacacgtacacggctaaccagttctacaccagcttgacggcgctcatccgccccggcaggcggaccgtgccgctcaccgtggacacccgcatgctcgtcaccgtcgggctcggcttctcctcctgccagcccgaacagacgcagtgcaacaggagcgccccggtggtcttggcgaacatgaacaacgtgtcattcgctctcccgaacaccgtctccatgcttgaggcgctgtaccggaacacggcggacggcgtgtacaccagggacttccccgaccagccgcccgtcgcgttcgactacactagccgcgggttgctcggtaactcgcctctggcatccacggggagcccgtcgacgaaggtgaagacgctcaggtacaacgcgacggtggagatggtgctccagaacaccgcgctggtgggactcgagagccacccgatgcacctgcacgggttcaacttcttcgtggtggcgcaggggttcggcaacaacgacggcgaagcggctggagcaggtgagttcaacctcgtcaacccgcaggagcggaacaccgtcgccgtgccgaccggtgggtgggcagtcatccgcttcgtcgccgataacccaggtacagtagtcatctgtaatcaacttcgtatatgaacgtttacggctgcagtaaacaggtaaagtttaattgggatttgggcccctccaaattgggcctaaaagagaccaacaccggtttgagttcgcacaaagttgaagctttgggctgttttgcatccgtgcatattatgttgggcctatatgggccgttttcagcccagtcttgtcaggccgaaatatagataatgtcaagtaatctggcccgttcagaacttcggggcttttttttttgcggggaacttcggggcgtgcttaacgatttgccactagatctacatgtcatagatagtgagtgacaaattgttaattgctatatcccaaaagtggcaaatagttaaatttccccagaagttccgatgctgaagcgctcggcgctgacgtactgatggtgtgtaggatacgcaatcacggactcacggtttatcttctccttttataagaagccaactaagtcactaaccattatgcttctgtcatctcaagaatcttatcagcttgatatagtttgcactgtcaagaagcttatcttgttgcggtttgcaaggggataaacagagtaaagaacgcatgttctgattagttggaaactttttctgcttgcaggaatgtgggccatgcactgccatatcgattctcacttcgccattggcttggcaatggtgttcgaggtggagagcgggccgacgccggggacgacgctgccgccgccgccccccgacttgccgcaatgctagctggcagctactagctgctaaggttgctctctgaaagttcagttctggccttcttcgatccggtgaaagatgggctgccatcatgatgtaaaatgcttcggacgacagggagatgacaattaagttccatacacatcttggtaatctttgaagagatacattgtttcgacaattcgattccgattgattgcaagtgtattttatccgtagagttttaccttcttttctgtgttgatatttgatcgttcctggattctgcagttctgcacgttaacatgtaaataagaggggtcagaatcaaagagtaaataacaacaaatcacaagaaaagcagaaattcatgtacgtgatttttcctaggaacacaatcagtgaagaaatttttttagataatgaatcactgaagagcttgtgccttgtgatcttgtatctatgtaaagctttttgcagatcatttcccacttccatggaattcggaagtgctcctgatttctttcacaaaagcaaaattcactgaattacccatgcataccccttgctaaaacaatcgctccctgcatatctgatgaactgcgtgcatgtttcagacgagcaaattcaatttgctttccgcatggttctgggcttctggcaaccatgctgaccctgcgcacatcctgcagttaggtgagaggtctccatcgtgtccatgccttcagaacttaatcgtttattcggagatggtacttctggatgttccctggcattcatgcaaagggaaaacaaggtctccacaagatagactccgagtgttgttttgttttttttttcctgagctctacaccgtatagccgtatgtataaacatcataacgttatctcgtcaagatagacctccatgatcaactaccacatgatcccaggtcattttccgttttcgtgtcatctttatcaacatatgcacgctgtattggttatctagagaatgctgtttgtccggttatgcatccatcctgtgcattacttcactatatcagaagaattcgttgcttaattcattgggcagaatttgtatagaatattattgcttgggcccaaatccgtgacatgatagactaatgagtagattgttgtcctaattagcttctcctgatccgatattcaaaccactgacaaggaatgcttggttcagggtacttttggtacacctcagctattatgagagctgcttttattgatccagatgggggagtaatataaggacactttgagacatgggattagttctaatgttttctcagccagttttttcctgttacacgtttagcttatacgttggcctcataattcgtcagaaaactatatacctagtgtgtccaatagtaaaactcctgattgattatgatgaaaacggcattttttgtggacgtggcggtaatgctagccaagaaagaggaattgacaatgttcaggttgatagaccgtgaatttgatactgcaatcaaagatagcagtgaacaagctagcaattgacgagtggcattgctttctctatcattttatcaggccacataaataattaggggtcagcaacacctagattatgagcgtgtgatatcgctagaagctttatgtcgcaatcggagaaaaaaatagacaaatgtgccattgccctacgcaagtgattctcggggaagtgccaaaagcattccatagtatatatacttatcgtgtttctctgaagactttgctatatacaagttggccaagatcaccaataaggatttgcctatccttctctggcgctcctgaatcctcttagatggttataccttggtgttcgtccatgatgcggcttttgtggttcttgttcgcgcttcttcttgccagatcggtggcagatgctgcaactgcgaactacactttcactgtaccctctctctctctctctctctctctcatcatcatcatcatcatcatcatcatcatcatcatcatctcatctctctgcatacatgtagttgtattcgttcatgtcattgatttcaagaagctttgtacagcaacaagaacttagatacttgctatacctgcaagctagagttattgatcaacttgtgtgtggaaagcatgagaattcataaacctgaaactgtatacaatttgttggtttttccttaatttcttcagtagtagtatgagaagagttcggttgtctgtatataagactgatgccacatttgtttgcaatcacataggtggaaagcatgcgagtcagtcggctatgcaacagcactgacattattgcggtgaacggcctactgccaggcccaatgatagaagtgaatgaaggtgacgcagttgctgtcgaggtcatcaacggatcaccatataacttaaccatacactggtacgtcactaatccttgtgcctcagaaacttccggtaatcaagttgctgtaaccttttcttcattttaagcagtaacgtcaagtcgtctttgtagtagcatgtgggatggcgtgagagtcctgcaatcgggctagttatttagattcgggggctagctggtcctttgataagtacgagtgattagtagttcctacccgaactcttgagcatatctatatatgaatatatgattagagccgaaagtgaaagtcctgaaaaggacaccctacctgacgatgccaattaagccgttaaatgtacgaaagctcatcttactatttgccaagtgttgtacagctgataactgttacaagtttaaaataaagcataggaaaaaaagtcatgtttcaattatactggagatacaagtgttcatacaccacacatataagaaaacgttcactttacatattagagacaaagtattatcctcaaaaatttcttacttaaagatgctaggatatatttcctgctctatcaatagaacttcgcaccgttttgtgcgagtcgttaaaaaaaatgctagaatttaaaccatcgtaagtagagatacggagcaatataccctcaactgcaccaatgcaaactacaaatgttttctgaaaagaaaggtgattttttttataatggattatattaaccaggcctctacaccttagaaagttatacacagcctaaaccgcaattaaaagtacataagactccacccactacatggggataccaaataatagtttaacaaaatagttaaaagaataacatcagtctaagcctcaattcttctactaaaattccaaccaaaggtagaaaagaactctattactctcttatccagaaaacttcatttgacttgaacttccattttatcgtcttctttaagaaacaaaaaccaaaaccttgtccaatgagttgccttgaaaatcacttgcaagaaagatatgtgaatatgtgactgtgactgttaaagaccataagggtatgtttcttcctagatatcaatcttatagcaacaaaaaattctaaaaatattttacaacattgtcatgatactaatctattgtctcataaaatcccccttttgcgctgaatggttgaattactgaatagctgattgtttcttttaataattatcagaggatacaaatgaacaaattaaatatcataaagttggtaagtggatttaaaataatatcttaataaattaatatatttgaagttcttttgcagacacataacatttaggagtttaggaagcgtgcgtattatttatagaatggggaaggagaaaaataataaatttggctgacaacatgacctttgatgttaaatcttttttataaattttcccgaattggatgtcatgaaagatacttcctacgtacttgtaaagaaagtcgtttaggataatgtttaagtcaaaccttagaaaaaaaatcatgaataactctcaagttgttgaatttgaaaatgtaaaaatcatatgaatagatttgtcttgaaaaatactttcataaaagtatacatatatcacttttaaataaatatttttatagaaacaagaagtcaaagttatatattggagaccgtgtcgctgtccaaatcgacttcgtttacgagtacggagggagtatgccgctgataaagtaataagtgcaaagactttctgcatttcgcatgctactaggagttgattgtcaggctgcttgtgttgctcttgaaaataaaagtagtattccctccatcccaaaatataaatatttttggacttcaacacagtcttcgagatgctattttgaccaacaatatatagtatgttttaaataaaaaaagttgcatattgtgatagtttgtttaataataaatctaataacatcaattttaatcttttttatattttttctattaatagttaagattgcaaatatttgatttggcactatgctaaaaatgcttatattttgagatagagggagtagtgcagcaattcagtgcacttttttttttagctcaatttagttcggtacacttaacctaaccatttggcataagcagagttgggtctaacccctgcacgtgtgactgctgctggtggaaaattttacaggcatggcatactccagctactgacgccatgggcggacggcccgagcatggtcacgcagtgccctatccagccgaacagctcgtacacgtacaggttcaacgtcaccggacaagaaggcacgctgtggtggcacgcccactcctccttcctgcgcgccaccgtgtacggcgctctcatcatccggccaagaaacggctccgcctatcccttccccgcgccggaccaagaggtccccatcgtgcttggtagccgccgaatctcctagctgtcgtactatgcattgatacggaaattgggcatatcttgattctggatgaggccttggtggacacaggggaatggtggagccggaatgtcgtcgacatcgagagcgacgccgtctcatctggccagcttcccagagaatccgacgcgttcaccgttaatggtgttaccggcgagctctaccaatgcgcaagtacgtacgtcatttggtaaatcctgatggaatgacacagtttaatttactgcaggcgaaaaatgtaaatcctctgctcaaatcgaagaaataactctgtaaaaaattggttcgtagatgacacgttcacggtggacgtgcagcccaacacgacggtgctactccgggtcatcaacgctggactcaacacgcacctcttcttcaaggtggccggccacgcgttcaccgtcgtggccgtcgacgcgtgctacaccgccaactacaccacggacacgctcgtgctcgcgccggggcacaccgtggacgcgctcatggtcaccaacgcgtcggccggcagctactacatggcggtgcaggcgtacgacagcctgtctccgaccaccatggccgtaaccgacgacaccaccgccacggccatcgtgcactacaacaccacgtcgaccaagaaaaacgcgacgcccgtcatgcccaccatgccccagagctccgactccgcgacggccaacgccttctacttcgggctgaggggcccgccgtctcccagcgcgccggccgtgccgaccaaggtggacgtgaacatgaccatcgagctgggcctcggccagctgccgtgcgactccacacagagcagctgctcggggaaatccgtcgcggcggcgatgaacggcgtgtcgttccgcctcccgtcgcagatgtccctcctggaggcgcagttcaaccgcacgccgggggtgtacaccgccgacttcccggacgccccgcagccgagcggcacgccgatggtcgaggggaccaaggtgcggaggctcaagtacaactcgacggtggagatcgtgctgcagaacccgaccgccttcccgtcggagaaccacccgatccacctccacggcttcaacttcttcgtgctggcccagggcctcggcaacttcacgccgggcaacgtgagcggctacaacctcgtcgacccggtttcgcgcaacaccctcgccgtgccgaccggcggctgggccgtcatccgtttcgttgccaacaatccaggtaggaatcctactgtcgctaaatctgtcgtatttctccggcccaaactagagatgggctgtttgggcctaacgtatgggctgaaaatgacgggtgctggttttggactttggacgcaggcatgtggttcttccattgccaccttgacgcgcacgttccgatggggctcggcatggtgttcgcggtggataacgggacgacgcctgactccttcctccctccgccgcctgccgatctgccgaagtgctagaacctgcaagattctggcgttggtgtcaaattgtaatgcactttcgtagccaaattttacttcatatttgttcttgtgtttgtgtaaatggagtacaggaggcacgaaacgaggtagtgccgttcgtttatttgttctgtgtatgtgtatcatgtgtaaactgtaaagaggtctgttttttttttcctctccgggggaacgtgtaaactgtaaagcaacaaatgtcaaacttcagattcctttgactgtgttaaacatgaatttattccaggataccaattaagcaacgatttgggagaatgacgttggtttgcttgcaattcttagttttcagctaaagattcctgtgtttagataagctgccaggggtgcatttggccatttagcctagcaggagccaggagggcaagctctgattggttttcaccaaaggacgacgtcgtcttacgagtcacaagctcacgacaccctcggcccatttgcaattatatttttgttcaagtgccaatcttatcgccaattgtcaatgggacattaccttacaaaacgaaatgtcaatgcgtcacttatatatatgtgctatttcatcgccgcggtttttccctgacttgatcaaagtatgcgtgtgacgttggcagaattcaggtccattcatggatgactattatttgagcctttcatgttcctctgtatgtagaacactaatatagaacacagatggttgtgaaactgtgaaacaaaaatgcaatcagaacagtagaacccttgtcacgccccgaactagccctgaacggaactagcccgtgactctccaaattaacctgttaatcgataccagtcccaggaaacagtgccggtatcacaggaagacagattatcacagcaacagaggtctccttattacagagtaggggtacaatcatgttgggctacggacagatcccgaactcacaactgcattacaaaaggaaaagcggaagccaagacttggaccattcatcacaggcgcgacttgagaactaggcagaaaccctaaaactcatcgtagccgacttgctcctggaagaactcctcatcagcgagacctacttcatcttcttcagcaactgggggggattatttatgtagagcaagggtgagtacaggagtactcagcaagacatgggaattaagtatttaatgcaggcttcaaaggaaaggctgttgtttgtgcaattgattttatttaaacccccttttgaaacaactaagtgagtgcttctcaaacgacacggatgagacagtgcgtcttgtccggtcggagtatgtgcaatgtatcagtctttgattggatcgaggttggcacccggccaacagctttcaaacggccacccaggcctggctgatcccatcagccgcagatttttccaaacatcgaaccctttccacatcagcaatttcacaagcagtagtcaaacaaaactacgctaggaatcacctcacatccgcccatgaccgtgggcacggctgttcgaacagtttaataacctctacagagggggtacactttacccacacgacattactaacccggatcacccagcccgtgcagaacggccacgtctggagaccttgaggctttcatgacaaggcatttcgaaagccgacacaggttcaccatatgccaacaagaggggtccagaccaacaccaggttaggtcccagaccatactgtgtcaggaaacctaggggttctccccggcaccaccccattgaatccacatgtctcttggcatcatggctcccccgattagctaattactcagccaggggcgtcccattacacccatgtggtcgcacttgtcttatgttcggatgaaattccaaggaaacggtccttagtgcaagagtgggaaaccgtactctcggtacgtcccccggtctgcgattttggaaattcatttagttcgcaagcaccgacccaggtatcagggtttttttccaagtcttttgtaaaccccaagttttacccatcgttggatgttttaaatttgaggggaggtgttccgatgcccatgcccgaaggcccgtgcatcgaagcacaacagtcgacaaaggagttttaggtattcaataattcacggagggtaattgcagcaatttaggatttggggcaggcaggctatctcgcaagccgcggccgaattacgtgtgttaaacctattcatgcaatatttgcggaaaagaaatacttatatttaaattataggtgcaaaatgttcaaaggtgacttgccttgctcgagatcttgagcttgatcctcgaaatcctcgcgctgtgggtcttcgggctccgaaactacacgcgaaacgggacaactcaacaaacggtgaaaataaagccgtattattgacctctaagcgtgccattagatagatctcgagacttgaggatttttggaagttgaacagagtcaaacggatgtacagttgagaagttattgaatttctaagattattggatttttggtctaaaggaaaaaggatttaattaaacccttttgaaaaagaaaagaaggaggaagggagtttagacttccctcgggatagccgcggcccgagaggagagagcggctcagctgagctaaatgggccggccggcccgagaaggcggcccaagggcacgcgcagggagagagggagggggaaccggtgggccgggtccacctcgcgtggtcccgagtgggacccgcttgtcggcggctcggctcaccaagagtgaggagcacgcgacgcggcgctagggtttggagggggcgcggtgcacgcgcgcggctcgcggtgggatgcggatgcggcgggcccacacgcagcctcacggctcgcagtggaccgcgcgcacgagcggggcggaggggagcggcggaccggggtcatcttgacccggtcgcggccgaggtggcgccgaggtggcgcctacgtggccgccacgcggaccggcgagaggaagacgacgacgcgcccgcgaacggacgggggacggcggcggcgagcggcggggcgatatacggcgatgcgggcgagggcgaacacaccgggaggtagcgcgagactagaggagacgagctaactgctcggattcgccggagggagtgcgacggcggcggattgcggcggtggcaaccggcggcaagagaagggggaaatggcgacggcgcgacgggagttcgattccttcgcactagagcatctacgcgactccgggaatccattccttgtgccggattaggaggaaacgcaccgagggaggccggcgacgagaggcgctaccgagctcgggcggcgacggcggtgagcacacagcgggcggtggcaaggcttggggcggcgccagctgactacgggggtctactcgtgctactaccgaaagctaggggcaggaggaggaacgaggagggagaacggggagtgcactaccgcgacgaggtgaagggcgcagtgacgatggctgacggcgcggggcgtgatcgctccggcctcgggccggggaagaggaggaagacgtgcgcccggagtccccttccgttcctagcgcgcactggctcctccggcacacgcgacggcggaaggcgacagcaagcagggcacgggcgaggcggcaatggctcggcggcttggagcgaaacaggggaatcgagcgagagggggaggggcggcttttatggggtggttatgtcggtttgggaggagaggaaaccgacctcgagcggtactggggcgagggagcttcgaggggaaggaacgggctcacgggcgcggggtcaaacggcatgggcgatggctcggcgtcaggcgctcctccctgcccatggcgctggaaccagcgggagaaacagaggccgggccgagtgaggaaaggggaaaacagagggggagaaagggagctcgagccatgccgatttgggaagggagagagatgggagcgggaggcgctgtctccggtttttggacggatgcaggtggagcggctcgggcacgcgcgctggctcgcggggcaaggcgcgacgcaagcggcgcagcgcggtagggcgcggggccggacggcgtaggcatgggtagcaggtggctgacgacggcggcgaccgcgcgggcgcacgcgtgaagcaacggcacgcggattcgaaattgcgggtggggagctcgctggggatggagcggggagagagagcgagagaggggagagcgctcggctcggcgcacgcgcacacgcgcgtgcggcacacgggcagagcgagggagagagagacggagctgagggggggagagagagcgggctgagagagagagaatcggcccaccaaacgacggggaggcattttagacttttgcggaggaatttgatttgggaaagatttggattcgggatttgaatttgacgatagatcggggattttgagatccggaatggcacggatgcttgacaacactcaaagaacaaattttgcaattagggtttttaagaatttaattttcccgctaggcgccacgacggaacgggcgctataggatgtttaactttttttccttatcaaatttccaaatttatacaaaaatatagtaatattttcaacacaaaacaaacatattatcaaaatatattcaatgctagatttaatgaaactaatttgacaaaaattaaatattgaaattttttctataaatttggtcaaacgtaacaaagtttgactagaaaaaaagtcaaacgacttataatataaaacaaatggagtattatatagatatagtatagtattcatgccatgtaggcatgcatggtgagtattctagtccaaacatttaaatatagagtttgttctttttctaatgctacaaaaatgtttttgttaagaattaagacccacaaaaaccagatgatatttttatgagtaaacacacactaggctttccctgacaaaaagaacagcatgttgtacattgcaatgggattttgtgcaagcacgggccgacgaatctacttagggagcggttcattttatttatatctatttttttattggttgatggtgggggtttagtttttggtttttgctatccaattttgtatccattttttttatcgatcacccattaagttgtctatcattttttatcggtcacatgagtttttatctgatcattttctttatttggccatgggaagaggaacggtaactcccgaaatcacgtggaatcgcgttcaaggggtagcggataaatgaaattaccatttccattttacagtagtagtgatagtagtatgttcgtgcattgcaatagctagactaacattttaagggcccctttattttaagggcccctttgatttagagaaaaaacaaagaaaagaaattttagagtgtttcaatcctatatgaaatttttttatgaagtctttaaaagaaaggattgaatcatactccatcttttataattcctatggattgaacaatcctatagagattttgtacgaaatttaccgagaacttcaacctcttaaaaatttccctttgagtatatctctcttatctgattcatacgtttttcttgtgatctaatcaaacggtcattcatgtgtttttctatgttttgcaatcctcttctttatacttgtattcttgtcaaaattctgtgtttttctaattctgcgatttaaagggccctaagtgtatagagaagttgagcaactttggtagcttgcatgaacgtcccatattcaccgttgtgtctatgttctctatgatacgcattagctttcttattgttttgatacttaacttagtaacgagaacttgatggaagtttttgaagaaaggcaaaagctttgccttgtgtatattaatagagcaggagaaaaataaacaagggtatatatagggttagccgaggaaaaagactaccccgcaaaaaaggaaaagagctaagtgatatctcccaggattccaaactcctgtagggttgttgcctctgctttgacccatgctcttccttcctccttgatctttgctaggattgaggacggtgatgacgcagagtttcggaaaattcttgcattgtgttcgcaccagatttcccacgagactaggataatcatagtctttagaggcttgcgggggtgtttggggactccgctacgagagtccaccactgcccaacagagtgacaagtttcccaactacccatctgaaggtcggtgcatgtccatctctggatttctgtccatattctctttgttagcctacatttggccaggaggtgtagggtcgtggagtccaccatttagtcagaacttgatggaagttttgtacgcgtgtgcgagagtgtgtgttgttttttaaaacacatggtacatgcgcagacactacgagtttttcttgttgaatgtgtcatccacgttgttattaaactcaattatttgaattttttaactgaagagacggtacgtactatacgtgctagatggagctttagtaaaacaatatgtataagtgtagaaattttctactggatgctcttgacctcagatacacacttagaataattgatagatgctacatctagccaaacttcttcctttaccaacttcatgacgtgccatatactgtaatggtgatttaatccaactgcgttttcgaggaaaacagcatccctccatggctcatgccgtcgcaatctgatttcgttgttactaaagctctcacgccatgacggccaagtggaatcggttcattagacttacgtacgcattcacgaatacgctgtttcatacgtcgttctgcaagaagaagtaataagatagactagttccaatgtcagttcaataggatgtactattgtgctaatacttaaggacgcgcgcgccatggcggtgtgtctcctcaactttgctactccagttgctactgaagactccggccatggcatcggcagccatgctcgtgccgctcgtgctggttctctgcacggcagcagcaagcgcggccgtcgtggagcacaccttcaaggtaaaaattcctgcccagaaacttgtttgtgtgcatgtttgctctcttcgtatatatccagcgttatgtactgtactctggctttcgcgcgcgtcgctccacctgtggctgtggtgcttgttcgttttggagtggagtgttgcaagggtccacggctatgtctttctaagttctgcgtatacctgaattcaggtgggcggtacgaagatcacccagctatgcatgaacagtgtgatctacacggccaaccagcagctgccgggaccgaccatagaggttaccgaaggcgatacactggtcgtccacgccgtgaacgactcaccgtaccctctgtcactccattggtaagcgctttgacattctctgaactttcctttgccaaacagggggcgtgatctgaatacaacagactgccaatgtttgtgggcctcacatatccagcccacacagcccatagtccctcaatcattctgggcttccggcctaccacacctggacaaaccggcccaaaactcatgtgtttcctctccggtggtgattgatgcaggcacggtgtataccagctccggagtggttggaatgacggggccaacaagatcacgcaatgccccatccagccttctggcaatttcacgtaccggttcaacatcaccggccaggaggggacgctgtggtggcacgcgcactcctcgctcctccgagcaaccatctacggcgcgctcatcataaaacccaggaatgggccgagtgggtacccgttccctgaaccatatgaagagatcccgatcctactaggtacgcaagaactagtaccgtatacacgatggagagatggtggcaatgtggcatggttcatttttgctgtgtggctcgtcacgatattacgtaattgttgttttctctggcaggtgagtggtggaacagaaatgtggacgatgtggagaatgatgggtacctgaccggcttagggcctcagatttcagatgcgctcaccatcaacggcatgccaggtgaccagaatcgctgcaaaggtacagctccaccagcacgtattagatagtttacctgtgaccaacattttcccgacctgcattttttttgtgtgtgtgcaacacattaggttccgccatgtatgaagtggaggtggagtacggcaagacttgcctcctgcgcatcatcaacgctgcagtcaatgtggagctcttcttcaaggtggccggccacaccttcaccgtggtcgccgccgacgccagctacaccaaaccatacgccacggacgtcatcgtcatcgcgccgggccagacggtggacgccctcatgaacaccacagcatcgcccggtcggtactacatggcggcacacgtcttcgacagcaagaccgtcgccgtgccgttcgaccagtccaccgccacgggcatcgtgaagtacaagggcgtgccgaattacgccccggcggccatgccgtccctgccgccccacgacgacgtcgtcaccgccggcagattctactggtcactcaccggcctcgcgcgcccgagcgacccgggcgtgccaacaaccgtcgaccacaacatggtggtgacgttcgggctggaccaggcgccgtgcgcgcccaaccagacgaagtgcagcgggttcgcgctcgtggcggccatgaacaggaactcgttccagttcccggatcagaaggtgtcgctactcgaggcgctctacaagggcgtaccgggcgtgtactccgaggacttcccggacttcccgccgccgatgcaggggttcaggaaggcgacggcggtgaagaaagtgaagtacaacgacgtggtggaggtggtgctgcagagcgagcagtacagtagcacgctcggcaccgagaaccacccgatccacctgcacgggttcgacttctacctgctggcgcaggggctcggccggttcaacccgtcgatgaagagcaagtacaacctcgtggacccgcaggtgcgcaacaccgtcgccgtgccggccggcggctgggcggtgatccggttcatggcgaacaacccaggtgagcccgcggcgcttaatttatttttaccttacatgatttggtgcaaccgtgcaagtgactgtcgagttgttgagttgcaactgatttctgattggttccatgcatcggggatgaaactgtaggtatgtggttcatgcactgtcacttggacgcgcacctgccgttggggctggccatggttttcgaggtgctgaacggaccagccccgaatctgctccctccacctcctgttgaccatccaaaatgccatggatgaacgccttacagattatgtgcgtatatacagagtatactcgacaagttcatgataccaggaatgagattgggtataggagttttcacctgaaaaagaaagatttgagtgtgcgaggcgtgcccgtattcaaattccatgtacttactgctcgtgtggtcattcttttctcatcctgcttgtgtttaggacaatcatgttcgaagttcgccactttttaagatttcagtactgaataaaggatgggcttctggagccttccaattcgtcactgtcttgttactacttcctccttttagcctctcattgtaagctggattactacaatagctcctcatgaaatttttcattgctgcaagaattggaatatttgcacataggctcacggaacgaactacttcaccaaaagaatgaataagctatgtttacttgttggcatatcaattgcaaccacaaattgaattttactatttagagttgattttgagggattctacatgtaaattatttttcttgcttcattctttttggaatcaaacaatcagaaccgaacttttctttttgtttttttttaaattagctgggtggcccgcgcaattgagcggctagcatccaaacaaaatcatatagtttttaagtatgattttatttaaaatttattaaatagctatctagctatttcattgtcttaagactttgaaagaccaaaccttatcatcctcgtgtttctaattatatagtttttaaaagtcacaccagttgctatcccttatgtcatctccttctttatttgcttgctcgatctaccactattttcattcattcttcttggaacctttaaaaattagattttatagtttttagagtttattgtcatgttgggtttcatttttataatttctagatgtcccatcaaacgttgccattatactactctacggcccgtccacggtctcttctcattgttgtcattgagattttaaaaatcgaacataatttttgtttgggttcattttttactttctagaagttccgccaaaccgtcagcggctttgctattgtactcctctacggctcacccgctgcctcccttcttattggcattgagattttagaatcgaacatgattatcgttgggtttttttactttttagaagttcaaaacctttaaaaattggacttgtagttttattttttataatttttagaagtcccatcaaacgatgctacaatgcccctctacagcctgtccgccgccaactctttattgacattgtgattctaaaaatcgaacataactgtcgttggaattcattttttattttctagaagtcctgtcaaccgtcggcggctctacaactatgctcttatacaccccgcccgctgcttctcctttttattatcattgagattttaaaaattgaatatgattatcaatgggtttttttttactttctagaagtcccggcaatcgccttactcgtttgcttcatggcctgcctgacgtctctccttttaatcgtcattaggattctatttggtgttttattaacaatttttatatctcatatcaaccgccaccactctacttctttataggcatgttacttaatttatctcgtcatgtgttttagatggtcttttctttcaatgatctttatttttatcacaaattttagttatttataaattgtattcctaattgatatcttatttttatttttctaatttcagaattttttaaaaaattttagttaatatcgtattgtgttattttaatgtttttattttttattttcaatttcagttgtttcaaaattgtattcctatttgaactctcttttaatttttctagttttagatattattttattttttattctaatttttaattaatctcgtattggattcttctttcaatatttcttatttttaattttgaatttcagttatttttaaattatacttctacttggactctcctttttcttttttttctttttctccaattaatgtgggaattatttttattctgaattttaattaatcttgtattgggttattatatagactcttattttaatattccttatttttaattccgaattcagatatttttatattgtattcctacttggactcttattttcttttctaattttagattttattttattattattttgatttttgattaatctcgtattgggttcttatatggaaacttattttaatattccttatttttaatttcgaatttcagctatttttaaattgtatttctacttggactctcctttccttttttgattttggatttttttatttttatttcgaattttgattaatctcatattgggttcttatatagaaacttctttcaatattgcttatttttaatttcgaatttcagctatttttaaattgtacttctacttggactctcctttttctttttttttatttttctccgattaatgtgaaaatttctagcccccacagtgaacatggtgtctcctttcaaagctgttttaataatataatagatatatgatcagagccgaactttgtcacatgctcatataacttggtcgaaagcgtcgagcccattatttactggccgtctggccctcatttggtcctgttattttggtaaagcccaaagtccagcccatgaactccagaaagcagcaaaataccgtgcgccagcggctctagacctctagtcaaagcgaaagccaacggaggacgtatcgaggttgttgcagagtgctggacttgcccgccaagccgaagacaaaacgcaccgcggacgtggagcaacacgcgccgcgattcaggctccccacttcgtccacacatcccgcctcctcgccgcttctttaaactccaagcggccaagcccaccgccaatcactcatccaagtatccaacaaagaacaaacccacccccgccgctgagatcgaatccgaccttaattttcacctgctcgctgatctcgccggccgtcgaccgccatggggatggtgctgggcaagatcacggtggagacgcccaagcacgaggtgctccacaccggcgccggctacgaggtccgcaagtacccgccgtgcgtcgtcgccgaggtcacctacgaccccgcggagatgaaaggcgaccgcgacggcgggttcaccgtcctcggcaactacatcggcgccctcggcaacccgcagaacaccaagccagagaagatcgacatgaccgcgccggtcatcacctccggcgagcccgagagtatcgccatgacggccccggtcatcacctccggtgagcctgagccggtggcgatgaccgcgccggtgatcacggccgaagagcgcagccaggggaagggtcagatgacaatgcagtttctgctgccgtccaagtacagcaaggtggaggaggcgccgcggccgacggacgagcgggtggtgctgcggcaggtgggggagaggaagtacggggtggtgaggttcagcggcctgaccggagacaaggtggtgaaggagaaggcggagtggctcaaggccgcgctggagaaggacgggttcaccgtcaagggccccttcgtgctggcgcggtacaacccgccgtttactctgcctccgctgcgcaccaacgaggtcatggtccccgtcgagtgatacggcgagactccattgttggtgtctagtgatgtactgatgcgcatgtacttttatcagggtgtccttgttactcctaggccctagctatttctctatttctttatccttttgactttgttctgtactgatgtatgtttggatcaacgaataatggacatatcttgggaaaaatttcagtagtccggaaaaatgaatcaagcatgcacacaagaatactctgcagttcagtcacgggcagagtacacagcttatgcagttatgctccttgacggtaaatttgttccggcctgaacttattggagacgctcactgcaacctcatacttgagccaacgcaactgtcaaatctaaacttcaggctggccgtcgagatcgaatttggcccatattagttagcggtgcagcaccgttccgtttcaatgttgggcctacaaagcgctcagatccatacccgcaaggctgcaacccagtttatggattcgggcgcaacccgacatccttaacggtcgctaaacccttcaacgcgaactggatagagtcgaacaccttcgtcttctaccaggcttcccaccgaaggagagagccggctatggccatggcggcctccccattcctcatcttgccatccttattccccaagcccaccatcctcgccgcgcgcatccaccccagcatcttccgaggccgccatattcgctgctccccgaacggcgccgccgtaccggaatcccctgaacccgccccacgccgcgggcgcaggaagtccccatccccgtcgccgccgaaggcgaagaccacgaggcgcaggaccaagaagaatacgcaggagtctgattcagagggcgaggaggagccgccgaagcggcggggccgtcggacaaggaaatccaagcaagaggccgagcaggaggcggcggagaaggaggatgaggtccgggcggcgagccccggaacggaggattcgaagagagcggtccaagatgaggatggggaggcggaggcgacggggagcgactccgaagacggggaggattcgccgtacgactggccgccgctggtgtgctgcttcggggcgccgcggtgggagttcgtcccgacggtgcgggtgtcggaccggcagatgcacccggacatatactccacgtggctgcatctgcagtgggagcctccggagttcgcgcgcgcgccggggagcgcggcgagcaacgtggccatcgcgctcaccaggctcggcggccgcgccgcggtgctcggcaaggtcggtgacgacgacttcggccgcgagcttgtgtaccgcatgaactgcgagcgagtgcagacgcgcgccatcaggttcgacgacggcgcggccacggccactgcgcgcatgaaggtcgggttccgggaccgtgaggacggcagcggcggaacgaggcttgtggctgagacggtgaagagcgctgccgaggactccctcagcaaggctgagatcaatgtggatgttttgaaagaggtgagtcggtgattttgtggtaaatgattgaaattggtgacttctgcatactccattgctgcatttttatttctcggcaaggatatccaccgctcagctgcggtacattgttgcattgaaaaacaccgactctatgtgagtagtgtactacagagcacaattgcttatgtctattcattagttcagttgaacatacaatggtgccaagccaaccagttttgcagattaaaaagacaaacaaattttaccctgttatatgatgtttatccttagaagatgaattttttatgtgcccgtgaaagtagattgtagaccgtcttttctttatttatgatttgatggaaagcaaaaaaaaatgaattttagacctaacgtgctgtaattgcaggctagagtgttccatttcaattcagaggtcctattgactccctcaatggaaagcacactcttcagagcaattgaactgtccaagaaatttggaagtaaaatattctttgatcttaacttgccattgcctttgtggaggtcaagggatgaaacaaaggagttgataaacaaggcatggaatgaggctgatattatagaggtgtcaagggatgagttggaattcctccttgatcacgagtactatcaatataagcgtgccaatccacctcagtattatctggatggttttcatctaacaaggaactggccacagtactaccattacacccccgaagaaattgctcccatttggcatgatgggataaaactcttgcttgtgacatacggaacacttaggatccactactacacacccaagtttcatggctgcgtgattgggacggaggatgcactcataactccatacacaactgaccggacaggttctggagatgctgttgttgctgctgctattagaaaattgacgtcttgtcctgagatgtatgaggaccaggatacattggagaggaatctgagattcgctgttgctgccggaatcatttcgcaatggactattggtgctgtgcgaggattccctactgagagtgctgcccagaacttgaaggagcaagtatatgtgccttctatgtggtgactggcggactggtaatcatttgtgattaaaagaacaatgctcatgatatacaagtgtatttcatgagtgctgcaacagaggtggtcaagggaaaagttttaccaaaacagcttacaggcttttcaggtatcatcctatcgtccgttccatattgtttcagtgttcagttttagttggaaaaatgtgtctgccacttggaggcttccattgctttacagttttgaagagctatgtttacctattgacttccatggtagggatgcaagtgtctaacccactgacccatgtcactaaattggtgcttctttttctgcacacatttatgttagtgataaagctaaataatcagaatgaagtcacaatttctgaaattgacttagtttcacacattcaaggaaacttaacagggaatgtgtttaagaattaagaacaacagtactctgtttgagaggaactggcaacatggatgatatttagttatgatatcgaggatgattgatatgaaatggagcaaagcatagaaatccaaaacaatcaactgaacttagtgataaaatgtttgttggcatcatggcagcacaaattcctaaagcaaacttgaaatgcaaagactcaatggaatgaaataaactaaaaaagaatttaccattcatcacttgtttcttcttgggtacatcctgctctctctatatacatcatacatgcctatctgaataaagctgcaattttgggatgaatacaaaatataaaaagaggacagactgtacatatggagtgtgtgaagtgtgaactacatacatgcactaaaaaaggtattctttcaagctatcccatcacttctggcacatctatgctttgctggtatttaaaatcttttttactcttccgtttcctgtatacttgaataaataatcaactggagatgcagatctcagacgataataaatggacctgcccctcctgcttccttttctatgaatgatggctgcatacactgttaatctaggaaaattatctgtgggctgtccctgtccattaccagtgtaattctttgttagaagattttgtgtttgtatatccatgctacatcagggaagtggttggaacttttgaagacaataatatcacatcctcttcataacaaatcagcgtcatttaatcctttgcattcttttgcacaagcagcctggaaggggatttgcgtagaagtactcctcttgcctaggacttcgaccagataacctctgatatggacccccaagtctgttttcatgatgtatcttcacttcactttggaactcattccatgttagtgtaccttcatcaagcttgtcaatgagtcccacaagcttctgcctacaatcagttaaaaaattcagctcttacaattgaggtataataattacaacattcctagaactgtacctgtctgggttgatggttttttggaatccttcaaatcttctgtgaccctgtactgctttagccatatttccatcatacgtatacacaaaaacatcactttggacggctacattatagtccaaggcagctaatctgttttggtatagcttgaaaggctctaactcatctaccgttgccagactataatgtgtatatatgtttggatattcagcctttaatgaatccatgctatgtccaccatatatttcacctgctacaatatagatctttgtgctggaaggatagcccatagctttgaggaaaagagctacttcacgaggagtcatagggcagcgtccttggagtctcctctccctactgttgatttccttctctttccagtgccgcacgttgagtctcatttctctcagctcatctgcctctttatgtgttaggttgtggctgcaaccagtaaatgagagcatgtccttctcatacctgttaattgataagaaaaggaagtacattactgatctgcaagattatttgcagcaaaattatgtcagcttcacttaacatttccagtttcaatcaccttaagtgaagtgcgatataatgattggatccattcctcagtctatctactagagcagtactcagctcttcaatttctttgtggaatcttagtgcctcataatttgcccgacaacggagtcgttggatggatgggggaagaccattgttaacaattcgtgaatctgtatgtgtgaatttcacaactttggccttcttcagtgtccttgagaaagctctgtagtaagaagcctgcagaaaagtaactagcagttcataactcttcgactgcagtatattatgtctttttctaaataactttgatgcccacttgagtgattggtccataccttggcccaagaagtgggtgctctcatataaagtttcaatcctttataagctagtggcaaggaatccacaatcgaaatgtcaccctctaaagttttcttgaagtgttccacatcaaatatatctttgaaatcactgcatgttaggaccaaaacatcagttatatatcccagtagtttctctaggaccctcattatagtatatttatactggtcataaagagattaaccttggatcagtccaaaatgatttgtgatccagagtagggattactagtgttgcattcatgagcttagcaactgcaaccatgtcgcttatctgcatgaaagattttgaagcaatgtaagtgagctggaagtcgtaatcatcttgatatgtttaaaggttttttttccctaacatagatgtgtacatactcccagtctcatctggttcaatccaccattggcattaacaattatataaccagctgttgcactgttcattcctggcaagaagcatatgatatgtggttaagcgtaggcactcagtttaaactagcatgaacttgaaagatggagagtaatagcttactgtcatgtttcttcgggcgttcaatgcatttgccataaccttcactatctggcgtcatccatatcttcatctgttcattttgtaggtgaacttcagtatagagctcgttgatcatagaatattattactagcatagtagcatttcaaccatattttgctttcatgaatgggaaaaaacagctgattgaattaaaaaaaaatctctcttgtaattaggaacatcgtatatgacaatgatcatcctgctactttacttgcaggtctacagaagacgcttttaattagagggaaacaggtgataatcatgtttcatcaaataaatctttttcctagtgttctagtcatagaagcactattctagcacttagtgaggatataattgattgatgtatatttcccacttcattttctcatctttccttgtcgagggcatgggactagaattgcgacagtcagattttcattcctataacctaatgcagaggatttagatagccaggaaacactaggaacccactttttcttttcatttgcaagatttagtgcatctgttggttatttgtgtcttgaacctctgtttcaacttggcgatagtttcagtgctgaaacttgaaaaatgttttttctcctatgctgcttgattgttttggcactagcaatgaaatgaatgtttgtgtaacgctgtgagtttcttcaatgtgagtttcttgaaatgttgtagcaaatcccagctttgagtgcctggacatcaacatcaagcaatttggaagggcctcgcgctgcaggcgccaagggcctacataagtggcgttaaccttagggaatcactctcccgattgaattctgcaacggatgaccaccagcgataataactacgcgaaaaagaagaaacagcgatgtgctaaagaaaataccattatgctacaccacgggcgacaagaacaggcacttatccatcgacaaagacacggatggaagggcttcccctgtaacttctgaagaagaaatgtctctaccgtgttcagcgtgtttctaagcaagaatacaaaagacagctgagacctgaaggccatggacgctcgccatgaatttttctctaagttctatacttctcttgcgtacacacatggtgacatccagtccacgaagagagtaggttccaacacgtctgtgccaattcaatgtctatacccaggaacaaaagctggaacgagttctacacttctactcaaatatatatcattcatggcgcgtcataatttcctcttttcttaaataatcttgactctatctaccgtctagtatgtgcaccaaccgctaagcaccggtttgtgtgggattgattaaccgaaccgttaacggcgatacgtacttaccggcgtgtcaggtgactggc

SEQ ID NO: 18100 - DNA, 2513 bp, Oryza sativa
  unsure (1)..(2513): unsure at all n locations
cgaatacctgatcacggggagcaaaaagaggccccggatcaaacagccgccgcgatgccttgccttcaccgcttcgtcacccgccacgagctcgcacctgcgtgcgcgccctcgcgaggacgcctgcgtacgtacgacgtgcaaccacgcccgcggcacgtagggggacgaggcgtgcgcgctggggattttgcacggaggagaggtggaacgaagtggaaagattgaggcgttcgcgtttgcgccttgggccgccgttgcacacgcacgcgcgcacgttcgctgtcgtgtgggtcgtggccgagcacgtcgcatatataggtcgtttttctcgcctttcttttgcgcgcgggcgcgacgcgtgtagattacattggatcggcggcttccgtaggcccgtgtggttggttgatcgatttagcctgacatgaattgcaatgcaccatgccaccaccggagggcacatgcgtccgaaggggtagagcgacgcagacgatgcggacgttgaagtagccctcctatccggggtcgagcgggcttgcatggttggttggtgaggacgtgaggatgagcctatccggcaccagtcagcgaaatcctttcattaatcctcgtctttcaatttagtggagatggtcctgcccatttagtgccatactgctgattttaactggtcttttagcaagtggtctgctgacaaatcacaaagttttttttttcttccattcgtttccgtggatatggcagtgcctgactgcagaaacgtttttataacaacggcactgccaacatgttgaaaagtggttcggtgctagccttctcccggatctgtgtgttggtgttgtcggtgtacgggtgacggtatattttttcattttttactggttatgaccctccagaattataatattataattttttcctactttattaatagaatttcgtatcgtttcgtgcgagtcattcaaagaaacatgttgagaagttattatcagcctgatgcagtggctcgcaagcaggacaggcttacggctacacgcgtgcgctatgaatgctacgtcttcgtagcctctgccctcttagtcgtgaggaatttctctaatttgcccattgattctcagtctcacccgtcgaaatggacaaaagaaatgccgtagtgaccggggaacttcagaaaagtgactagctaataggcatgtcttgtaggcttgttacaacgtgtgtatctactccctctatattaaaatataaccacttttagtactcaatatttgtcttaaaatataacaacttcttcatcaacattcccttcccaaccaattacagccctccaaccctcacttttctcatctacctccgcttctcaaccaatcacaaactcttcatatataattttacctactttcttaataaccgtgtctacctctaaaacttcttatattctagaacagatggagtatattttatcaacattaacacgagctcacacgggagattgacttataaaacggtgtgctggattaattgtcactttgtcagtatgaagagatgtaggatattctcttgtgtttgattggcctggggatttggatcaggtgcagtcaagtgcaaaataagcagtagcagtacacatcattggatacaccctggacggctcagatcacacaatgcactgttcacagcactgtagcagtaatattgtagcacgggtcactgttcacatgggtactatagctttagacctgagggtgtgtttagtttatgctaaaattagaagtttggttgaaattgaaacgatgtgatggaaaagttgaaagcttatgtgggtagaaaaattttgatgtgatggaaaagttaaaagtttgaagaaaaaacttaaaactaaacaaagcctgaataaaatggacggtcgaagttacgtgcaattgttaagcggatcccaattcttggcctgggcatgcaggtcgcccaatggaatgatggacgccaatatgtatctgaagtgggaatccaccagacggacacgattgttggccgccgcgttgggtctagtcgggtaggcgtcgctctcgatccgtccttgttgcattaggcgcctagaccgctagagacgttaggggcccatacagcatcatctcctgtcaccgagtaaccaaattaattaagccgcagaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18101 - DNA, 1766 bp, Oryza sativa
acagggtatgttgtatagcgttggattaatattgttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtttgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtgagcccccggtggactttcgcaacaacggtgccaagtggcaccccgcatcacaagctcaaatcccacatgaaaatgaccaatcggcgatagatatatgagtatatccatgccaagattaagctaagttcatcaatgtgacaatatatatacagcgggagaagctatgcttctcaaatcaacctgaaagtgttcattccataacctaagaaattgagggaagagaactagagattcgatacaagggtgcaaaactgtaatggcagcctgagaaaagtcgctgggagacttgagagttgagactctgattcctttgcagtccatagcaatgctggtgctatggcacctggctctgtctcattcatccgtgaacatattgccatggcggacagacaaaatgcaggggcagaggcacctgagaagccagtcatcatacagaggaaaccaagcattctttgtctcctagcagattcccctgtcaatgtgaaagacaactagacaagccgcctgatgaaaagcagctgatcatgtgccattgggagtggcatctgagagtgtgtggttgatgtcctcgccatgttttccgttcatctgcacacgttgccgctggataatcggaaataggtacgttaggggaaatatcaaaatggttgctgcatataagttgctaggtactatgtagaagataaaaggcttgtggttatgttgcaattgaactacaatgaaatgtagatatgtttcattgttggatgaaaattttatgacaaaataacttctaagtttgggaagttcatttggagattaaaatagaacatagagtagctgattaatgctctatgatacccgatcagtagaatcgacagtgtttccatttaacaatttatggaactcttccttcatcttgcaatccttctctagtttatggagctcttcctttgttctgccatctttatctttcgctgtaactgggagcaaagatgatccatttgtgcgatctggcatttctgtagaattgccactaacgattgttacagaatgaaccacatggataatactgcataattaaaggaagctaaaagagggtacctggtagcttattgtcaataaagaatacaaccaaattgacagtatacctgacgaaaaagaatgcaccaaagtcagatgccactacaaggcaatcatattacagaaatgaaactttatcctaccaagcaacaacaacatccacgctgtagtgttttcgagaagcaattataagaagactctgaattatagccatca

SEQ ID NO: 18102 - DNA, 12603 bp, Oryza sativa
  unsure (1)..(12603): unsure at all n locations
tcagatcgccacaaccaaaaagcactccacgaggaactgcaaaggaaaaaaaaaggaaattcagatgattttccacccatctggacaaaagattcaacccaacaaatgatgaaaggcttacagttgatcaggagcacttcaagtacattatggggcggtggaagagtggccatttttgagccctgcaaaatgcaaagataaatgacttcagtaagcctttaacaaagtatgacagtatgtagttcacgagtatgctttagctatgatgagaaattaaggttacctcccgacagtgataatttggacctgggagctgagtggaatagaaagtaataatccgcaaaaattgtgaagcctagaggaaagaaaagaaaaacatcattgttacatcatgattataatggttgcagagataagttaaaagacatgggacagccacttacaactaaaaaggccagcaccctgcgccagagtagaacagtgtagaaacgtttgctatgataaataaaagggtgaaaactccactgcaaaaccataaagattgtcagtcaattacactactttatgatcaagcattacatgcaagtagcttaaacaaaccaaattctgttgatgcggagaggagcaaaatacataaacgcctctgctatactacaacacaaagaagtgcatctcacattctcaccattttaacatcttaattgtacagaaaattggtgcaacaaatagcttcgaaaaacattttttgttcttacagatcatgcagacaagaccttactaaaaggaccaaactaccatactgtagtacatattggaggtggcaataatttatcggagagcaattgattaacccatggtcataaggtacaaaatcacactaagctaaattatcaaattactttttcactttcataaatcaatctggatagccactattttcaaatttatttctcactgcagctctttcaaattgtgttgtttacttgtcaatatcagcagggctgtcattgccatttacactacaagatttctggctaacttattcaagatataagaagaaagggtcattacaaaacatacatcattaattatcaaatatgtatgaactatgcaatagatgatcatatgcagtgaagcaaaatagccacctaccaacaggaaggaaatgaagatgaatgtgaacacgctctcactaacatatcctttgtcctgtccaagttcctaaaaacaaagagaagtgccaccagtggcaggaacaaatcagtaccattgttctttgacagatatgagattaatttttaccaggtcacataccggaagagccatgaatcccaagtcctggagcagtggcccaggtcgatgcaagtaatgtactcctcgagcagccagtccatgaatgtactaattataggtaaaaggatgcatgaatttccaatatcatccattaatgaacagataatattatgtaagaagtaaatcttgagaagatgatgaagaacaataaaagttggacattttattttatttttccacgctctcaaaaagagaacctgtagaaaatacaaggagaagaaagattttatttaggcgccaaccggcatttcgcattgcaacctatcaagccatatgggaaatcaaatctcacgctttcccaacagttagtttcattctttctccatcgtgtacagaaaaggactgtagatcttactgcgctctaaaatgtttactcatctaaggaagtaaatcaattataataacacaaacatggagaaaaaaagttatatgaaatcaccacagttgagtcagatttctagggaatggagcatgtctgacagggagcagtatcacaaatggaaccaactatgtcaaaggattgggtgcgcgattttattaaatatcaagaggataggttgcacctaagttcaaatgaattcatctcctatatctcaactcaaaatagaaaataatgcaagtcctattatcccaaaatgttaattgcagtattatttctgaggtcaacttatgatatttaattattatcttctcataatagagcatatcctgttacagtacaagcgaatatatctgatgacaggcccatgaatatccaattcatttccagaatggcattaataatcatctttagttcaataaaccaacctacaagttgtttgcatgagcatgattacagtttcgaggagactacatgcaggacaagaaacatcacagtaactgcataataagcgcgctgattttatgaaaagaatttcagaaataaataaatacttgcaaaatctagacaaacataagaggcaatttatctaacatattttacaagagggaccaatagcaagctaattgtctcaaactctctaagcagggaacttttgaagaagacacaaggcaacaatttctccccatgatatgacatctatcatggtatattgcttttgaccttggctccagctcaaccaagattgccagtgcttgaactgctttctgtgaatttgcagtagttgctcatccaagtatccaacatttctcaacaagctctggatttttttttctactctgaggacatatcacataaacagattgaatcatacttccatccccaatactcccctcttgattaacaacaaactaaattcacctaaactgtgcagacatatagttttcatgcaaatgttcaatcagccacacccttgctcgaggtgaggtataatttaccacacttagttcatacaactaaaccctctgggcagtgttgacacagaattcgtaccggtccccaaatccaactctaaaattagcatagattgtacgatgcagagctagctaaaattgccgttcaaaaggggtcgaccacgtgctatatcaaaatttttgaaacacacagaaaatagcagtcaagaattacaaagcacgccacaaatatggcaattatgcacacggagccacggaggataaaaaaaatcaaaggaaataaactgaagtttacctgaaacaccaatccggcaaggagcaagcgccacttctcgaaaagaagctgcagctccaccgctatctccgcacacaccttcctccatagctgcacaaaggcgggtaaaaaaaaatcacaaaccatagctagaacatcccaaccccatgtgccaacgaatccacaccttggtagcctcccgagcgatgtaaaccgccatggccgcaactcccgctcctcgcccgccgcctacaggtacaccctggagggctcacacccatgctccgatccgcgcatcactgctgggatcacggcatctcgtcgcagccaggacctcgccacctcctcgggaccgccgcgagatcgccgcccgccgagcggaggaggatccccccaagcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggaggggggcgtgcatgcgcggctttcggcgggcaggactttgtttaaccgggcccaaaggggggtaaaaatcccaacaacacaaggggggcgctttacaacgtgctgcgggaagatagttggggacagcttctttctcgagctcacatacactgggcgcgctggggctcttaaagctaaactggaccgccattaagcggagtagttgcgcttctctttcctttctttttcccctgtttttagaggattgcgctattttttttggttaccagtgcttccaatgttccaagaatccaagttccagctcatctagggttccattcatggaattaaatgtagtagtatcatattatagaaaatngatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacctaatttctcttttcaaccaatcacccacatttttcaatcattctcacctactttcttaatacccgtgccaatcttaaaaatgcttacattttgggacggagtaatatttcatacacgaggtatcgatcatcatatgatctttgtgtatatgattgcttgtcttcatttctaactcgctcaatcttttttaatgcatcatcaagtggggtgattacgattcatgtgctacatgccgtgcacgagcacagctacgcatttgctttctgcggtttgccaatatcattgtagaagttctttggtgtttaaatgtattgattataatctgtttttatgcgattataatataaatataatatattttacagcaaaaataatataccctacaagatgtctttgccaatgatctccgtcgtcccatgtgcgccatacagttgtatgattgtatctgccactcggcaacaatggagccgcaaagagcttttggaagaagtttgcaatgtcctaatgacgtatttatcaatgttcaattagacttggctacggcagccaaccagagcctaacccggtttactcaaacttggcctgcacaaattatttagtttggcatattttactgttagtatcaattaacattatagggacatttaagtatttaactgatatatacgtctacattctggtggtgctggggaattcttttttttcatataaatcttcagtatttgtgattgaagatagcacgtgtacttgtttattccatgtattgaccgttgtccgctgtgatatcaacaaatgtacgtaccccgatactatacaaaacaattaatgtgtactctcctatgtagcacaccacaaattctttattgaaaacgaagcatagaacattatatagaggccggccggtgccatccttctctcgaaggatcaaactttgctaatccatcgttccatcttctgtgctaggttggcaccaagctagcgtacgctgtctatccgcggaataaccatccggtcatgcaaattccaccttccttgtaataccattccaagtcaaagctcggagaatacgaaagggaaccaagccaagtcttattttgtcattccgatacctattttccccatgtgaaattcgaatgttctcaacatgactcgaaactttgatactactacctgttaactgctttctcatgcagatcccagcgatccggatcggggttcataaaaaaaccgacacagctggagatggaaacatggagaaccaaacaaccccaagtgacgcgaacgtggtggtgatcacacgctgctacgggacaagccgatgacaagtgcacgtctgcgcccagcaactttgacatgtgccgttggccaagccaaatttaatactccgtatcatacacatctgtaccgaatcatctgcgtagcagtatcatggcgtatcatgcacacacgtggcggataagctggcttggacggctaaagttgtacgcgtccagagcgaggaggtgatgaaaattagaggagaaaggttgcagtcgcggcgaagcaagatggacaagcagacgccacaggggcacggcgagaagccgcggtatttgcccagatgggcgcctgttttgttcgaacccgacaggtgctttcagccggaaaggcgaggcatcatcatccgcgtcgaagacgcgtagcgatcggtagagccatcaacacacgcacgctgcggtctcgatcatgattcgcactttcacagcggttcgtttctggcgttttttttttctttttttgcgagcacgatcacgatctcagctagctagttttacatccaaaactagtactgtcgtgtacaaggaataaaatggaacggttttggggcaaaaatccttcttttccccaaggagagggagagttttgcacataataagccttcctctccgaacgaacatcaacatgagagggattgaaactgacacaagatatccagtttgcatcaggtttgatgaggatggagggcatttgtgttccttaaatgtaaggttgtcaggaaatgctggcgaattttgaatatggagcaaattcggttggatctccttgaaaatggggagttttgaaccaacagttcaagagaacaaactgaaaagataaaggtacaagaacatatgaaagtggaactatccaccgcagttgtttcgcctacatcgttagtccttatcagacgctgtatatcgaagagaaccttgtagtgctctgtacacatatcaacagacaatagcaactatcaacaggcgacaatcacccagtcgtcattattacttcgaggatcaggatcagtaaatcaacttgttgataaatagtccccaaaatagacgctcgtggatagcgagatgacgagagatttgacaccgtgacgaacagatgattccaaatgttcactgtcatatcctgttgtgtcgcccaactctgtcaaagaatattcaggtgtgatcagttgaactaactcagatttttagttgtgtcaaaaaaaaaagaacttagattttagtaggctgcgagggcccaaagcaaaacaaatactatgactgcttaatgatgggcctaaagccatcagtggtcatggcccaaatatggattcatgcagcacaaacgggctttagaagcgaatagtcctgacatagcctcctcaccactgggccagaaaatcagagactcgagcacaacgcccgaccttcccggaggcggacctatccatatcggaaagcatgcgtgcatccactcgaataacgtaaggctagattgcactccaagtttttatcgtgtgacttgggccccggaccagcctgccgggctgccggccgccggcggcgggcgacggaaggaataatcagcttcgggcacatagggtgcggtgcggatgcgtgcatgcacgtatccactgaaccgagccgcagccgcgcgcgcagtgggccgtcactccatcgatcgcgtggcctaccggcagcacgacccggcggcacatgcaataggatgaggagaagattgctcgcaaaccaggatcatccgatgaagtgattagccccggaccaaatcagatcaaagaggattgctgacgcgagcatgtagtagtgtagtactactcctctgttgactatagcatcgggtgatcgatggaacaccgtatctgattctgctgcactatgctgatcagctgatgcggtccacacgttggcacgttgctgtatattctgggaagcatggcgtgttctacgccaacacgacgacaagtggctgactttgtgtagtactccctacgcatttcaacggatgacaccattgattttttttatccaccttcgaccattcatcttattcaaaacttttgtataaatataaaaacatttatgtcatgcttaaaaaatatttaatgataaatcaagtcacgataaaataaatgataataatgtatatttttttaaataaaacaaatgattggtaaaaagtcaacgacgtctaaattatgtatgcaacacagcagccaaggagacacaagagagtcaaataaagctttggcatccgccaccaggacttctctaaactggtgacaggtgggaaatcaagatactccctccgggttgataatacttgtcgttttggacaggggcacagtcttcaaaaagtaactttgacaactattttctattataatatatataaaaatatcaacaaacatatgattttattgaagtacttttaaagattaatctacaaatatggttttcatatttttaagataattattttagaaattatttgtaatcaaagattttaaagtttgactttacccttgtctaaaacgactaatattatcagctcggatggagtatataattacctatgaaaatacttcctccataaaaaaaaactcaaccttctaaagcattcgcttacaattagaggagggccgccaaggctagagaagataagataattggacacaggttaattccagcaccaaatctatcaggcctgtaagctcctatcgcagggctggaccatggtcccaactcccaaacgaaagaaacagaaaggctcacgaattaaaaaccggattgtctcactagattctggttgtgtgcattgctgacctgttgtcaataccggtcccctcgcagtgagaaactaccaacaccaataatccatcgctccgtgcatcctggcctcctggggaaagagccgatggcccaaggtgatggacaaatttaaatgcaagtccgacagaaaacagctggtgcaactgtactctcgtactcgtacacatgcacatactcctacctaggagccaccttttccgctttgtctacgttcaggcgctcgtctcggctctcttggcgggcagcctcaaacgctccaaagttttttcacgtggttaacaaaataacgctccaagctagtatttgactttgtgagcaatgaaaaatgaaaaagacttggtaggtaagcacaaaggctccatttgtgttccgcagacgtaattcggcttttgttaattgccatggtagtcagtctgccaggcctccagcaatcagccatgagagcgtgacataagcgcagaacataatcaagtttaaatataaccgattacagttgactaaacacattggagagaattcttctattcccgcctctgccatttcaactttcttcacaatcacaaatattccaggtccgggtcttgtctcccaggctacggatagtaccgccaaaacattttgaattctccagtacacagagtgcccctaggatctccagtacaactccatcaaatactagcctcgtagcctgttgattcaaaaatatgtttttctactacttgagtcgtacacctgcattacgacgctccgctgctggatttgatctggagaacggagagagcaatcagaggatgcaaatgacgcaaccagcgcgacaacgagccgagaccaatcgatagagagaaagtggccgtggcaccgcccaactgctggctctcggcaacctgacggccacatgggcgccggttgcaccagctcagacgcaacgcaaaacccaacctttccaccgatcacgacagcctaacaatatgtgctcgcctagctagcctcctcgtgcacattcatcagtcatgacaccaagatccatcctactagtactatactgcctaccgtacggtgcagcaaagcaagggtacaaaggcgccttcgaacaggggattaggagggggattagtattagtagtagtatcagctttgctgtaaaggcatcgttaagaaaatccggatttcccaacaaggcgccgggcaaggttctcttttaaatttgaacagaacccgaggtttcgttcgacggcaaggtggtacaaaccgaaaacaaaaggacttggcacgccacacgagataatagctttacaaattgaccggtcagaggcctgcccggccacggccacacgacacgccgcaacaaaagacgacaggaaacagccagctgccgaaacggaatccacccaaaactctggccaaacgcccggcttggcaaggttatctgtatcctaatccacacgattatataccgagtgcccgagcctaaacgatatttttcacatgatcctatcaaattttagagagtatatccagatactgcgatcgctatgaaactatcaaatattatttaaaataaaataaattgaaaataatgggaataaatatactaagtttacataaaaaacaattaaatatattaaaatcaatattactagccacctagtcggacgttgcgcgactttagatacccattttaaaccccctatacaagaaaactcttatactggaaatgttataataggttggtttgttttgaattttgatcattaagcgtcattgatggattacctaagttgataagcatatggcctcaactatatgttcaaaattttattacacaattgatgttgtaatgtacaattccatgttcaatataaactcaaaacaatcctatatcccatctatctattcacatgcgaaaacatatttgtgctgcttgtagccaatatgctccttcctccgtttcatattataaaactttctagcattgctcacattcatatagatgtcaatgaatctaaatacctatatatgtctagattcattgacatatatatgaatgtgggcaatgctagaaagtcttgtagtatgagacggggggagtactgtttaagtaaatataacaatgactataaatcatcttttactaattcaggaaaataataataggaaaatattactttaacacttattcctttagctaggaagttcttcaaaccgcctccatcctgtaccagtgttatatcaagttcatattatattatactacctctgtcccaaaataagtgcagtcgtggatatccgtgcccaacgtttgaccgtccgtcttatttaaaaaatttgaaaatatttagtcacacataaagtactattcatgttttatcatctaatagcaataaaaatactaatcataaaaaattttcaaataagacgaatggtcaaacgttaaacgtgaatagtgcaaaacagcacttattttgggacggagagagtatatgcatagcacagagctcatcatcttcccttttgaaggagataaagccgaaagtagttaagatttagaacattaatatgtcacatataatctgagatgaattggattatacttgacttctattaggactgtccttaagacacccatcaaggaaaaaaacattttttatataatgattaaaaacccatattgtgaatgaagcatttaactatacacattccaactatttagaaaggcggagtatttatgcttagaaattctgaaggttggcatgcaggtcatgtagtcatcagatagaattcagtgacaggggaaacaaccatttttaatcagcatattgcagccatggtaccatcagagtattttgactgatgtttgagattactgctgatatgaaaccaaatgaacctagctaaaaattaactgttttaatctgaacaacttcaaaatttgttgcaactgcaatgacaaaattacatgatattttatctgagctttccttggttatattatgagtatcatgagacatccaataggtgtggttaaacatatgaacaatttgagcaagctagctgtgaggaaatgtaaaagaaaatgcagagacaatgatttggtaccgtagctaatgtttgcctgatttcagaatatatgtatggattgaaaagctactgaatcaattgcaaataaaatcacatatctggttatttcggaagaggatctttgacagctctcgtcattgatggagacaaagaatcaacgaaccagcgtacctcagcttctagcttcttgggtccagttatatcaaggaatcaagatcgtggaattcactcaactttttggcaatcaacaggaacatctctagtttgctatatgccctagagctcaccggcgaggcggtgcgtctcctcggagatgtggtagaagccggcgccccatttcatggcggcgagcgggccgggcggcctcctgccgcagcgggattcggtggctagaccgatctgtgggtggaggacggggacgaggtagtggagacagaggcggcattggtagaggggaagaggaggaggaagtggtggcaggcagaggcggatgaggaacttgcgccaacgacgtggatatggagggggcgagtgggcgcggtggaggaggagggtggaagtggaggtggaggaggcgacggcaatggggaggcggcgatggaagcgaggagatgggcaggcggcggaggcagcggtggataatttttttt

SEQ ID NO: 18103 - DNA, 3770 bp, Oryza sativa
agttgatttatggcgaaagaacttacatgagcgacttgaacctggcgttgggtgagcatgttgttgttgggcgcgaactggaaggcaccggcggtcttctgggcttgcaccggcggagacgggtttctcgcaggtgggacgaagcggccatggccggcatgcgcatggggcttctggggcaccgggatgctgttcatgcgcaggcgagcaacctgcccggcagcctcggagagaacgtcccaagggtccgtcggcggctgctccagcggcgacgacggcggcgagctgaactgcgacgcaccgccgttggggctatcctccccggaagccgccaacccgcacagcgtcgactgcggcgaccccgccatcacctccacctgtcacaaacaaaagaacacgatcagatttcgctacaacgaaggcgcaaacacaaagcatgtcgaacaaggccaaacgagacaccaaccaaccttggaacccgttccctttccaccctcgccggcgaggaggtcggccatgcgtcgcgcgaggccatccaacccgtcctcctcgtcgctctcgctcttggccgcaaccgccgccttctcctccacggtgaagaaatcatcgtccaagaactcgtcggggagccacaactccgcctcggcggcgccaggggtgcacacctccgccatttggcccacgaaaacacaaccccttccgtccgcgcggctgctgcaagcgtggacggaacacccactccccacacgaggaggaggggtaatataggacggcggtggtgttggccaggaattgccgcgcggggaagaaacaataataggcagcggcacgtacagggccaggagaggtgatggctgatggctcccctccccgcctccctcctccagcactagtacgctccaacctcctgtcctcctcgtctgtgtgagcgatgggggggacccaggaaggcaaaacgcgaagtatcagatgatgagatgagatatattatcccccggaaagcggatggacggaggaggggaagcggcgtgggggtgggatggaggggagaatgtccaaggacggctggggattttatcgagcggctgtggttacggaggtcaaagcggtcctcatctctgcttgtgttgggtggctttataaagtgagccggaaggagtgtaattagtgggtctgatttttatttttacggattaaccgcacaacggcacaagtacggctcaggcataggcatagcttatctcagttccatgataaacttaaagtctgtatgtaaaactataatattttaaattataaatttcacatgacatggaaacaaaatgattatccaaatgttatctacgtaatcatagatttaaatttgtaaagctaaaaatattcaactgtaacaaaaaaaattggatccagagctatatccaagagggcctacatctgccgtaaactttaaatgccaaatgaattgtttacggttaaaaaaaaagacttggagttaggactatttgggaagcaaattttggccttgtttagttcctaaattttcttttttcaaaacatcacatcgaatctttagacacatgtatagaatattaaatataaataaaaaagaaaaactaattgcacagtttgaatggaaatcgcgagacgaatcttttaagcatacttaatccatgattagccataagtgctacagtaacccacatgtggtaataaaagattaattaggcttaataaattcgtctcgcgattttcagtcgagttataaaattagttttttttcattcgtatccgaaaactccttccaatatctgatcaaacattccatatgacatctagaaattttcttttcgcgaactaaacagggccaaatgagtaaccgagtgtctggaataaggtagtcagtgtatgtgattaggactagcgtttgaaaccaccaaagataatagtaatgtgttttcctcctgagaattggtcctttttttttctgaaaaatgcatctaacttattgttgctatttttcctttggtattaagacaacacactccccccaccaaaatggtagtagtagttcaacaaatgttgacaaaaaaaccacatgataacaacaaaaaaggtttgaagttcacatcaacatctgatggtaatgtactacaccagtcctactccttgtggtacgatcggtttcttgttttccatttttgcgaggggggtgccaacctactcgataatccgggagagtactggcgagataggcgtggtacgaattaaattggtcgatgtggcgtaaagcacgatcgtcacgagactttcaccgggccgcagttctcgtagggcttcatgttcgtgtttgcaaccgcattcaattcgtgacctggttctgcacattaatgcgcgagtttcgcgccttgtaccgtctgtcctggtatgtacgctacagcagccaaacacgtcacgtatgaaaatactgcgcaacccaaagaaccggagcccagccgtatacccggctagcgacgcgttacaactgtacaagaggtactaacctggatgacatgaaactatgaaagtgaaacgcagccgaacattcgccggtggatttgcggtttcagggggccactccgtaggtgtgtgtggtgtggcccagccgagcagttgatggtcaccgctaagattgagcgtggaaacgaactacggcactgctggggtggggggcccaatgcagcagccaaaatgcgtgccatctatgatgcacatgttatacaatgtactccgtaccccacgtacacatactcctatatactccctccgtcccagaaaaagacaaacattggtttccgtgtccaacatttaaccgtctatcttatttaaaaaaaattatgaaaaaaattaaaaagacaagtcacgtataaaatattaatcatgttttatcatctaacaacaataaaaatacaaattataaaaaaatttcatataaaacagacagttaaagttggacaagtttgactttttttacgagggagggagtacgtatctctactttacaatgacattgattgtcgtacgagtaccgacagctggaatacgtggttcgaaacatacgtgccctggctttcctgggcatcaggccggtcgaggggaattccacaccgagctcgctgcccggtgggccccgctcccagggcagcaactcccgcggtttttgcaaccggcgaggcgcaccgcgcaccagccaagccacctcgcgcccacctcgcggacgcctcggccctaaaccaccacgttccgttcacctcctttatcgccgctaatctggcctcgtccgcgtgccttttcttttttttttatttttttgccttagcgggatcgcattgtttggcgggcagacgaaaatagcgtgaggcgctagcatttcgcgggagaaagaaacgtggaagcgaggatccgagaacgctggtcgctccccatgctttcgcatgcatcgtgcgtttgtgctccggctgaagtggagacataggggaaaacaaaacgtggtcgacgtgcaaggcgccaaggccggcaggcgcggccgacgtgcgtacaacctaaaagagcggagtttcgagtttaagagggtgtttggaaactaggggctaaactttagtccctctcttttatgagagggactaaagtcccaaacacccccccctaaaccacgtcagcggacaaagaatctgaaatttatgtcattccgaaaaaaaggagcgtctgactaaaaagatttgttttctgtcggt

SEQ ID NO: 18104 - DNA, 3663 bp, Oryza sativa
agcagtttgcaacgcagcgctagctttgaatcgcgcagctgagtgcgtaacgctgaggaaagaaatgaaagcgaaggggattgtggtgggtgatggcatttgtctccaagcaagcccgcaggctcccactgcgcggggcaaggcaagcaggcagcggcaggcaaggcactcggcaagcaagccccttcccttccccgggctttgctctgccagccggtttgtgcagaaaagttagcgcgcacacatgaagaaagcactgtctttaccctgcatgcaactgacaaaatgtggcagaagcattactactgtcccatcgtaccagagaaaaaaaaatgattagcccgttcacaatgcacttgtttgagatatgagaaaaaattgaaatgagagtaccggacatcaaacgagataagccattaacataatattaatcattttaaattttaaaataaattcatataatttttaaagtaaattttaatagattttttccgttcatgaagcgtgtgcgtttcttcccctccggcttctctcgaacacttcaaatggcattcaatcccaacctgttggctataagatttctctccacatctgcacctcgtgtgcccctaggaagcccctcgcactaccgcataagagcaagtttaggccatatttagttcgcaccaaactttccacaaactctcaacttttcatcacattacatcacatctaaaactttcctactcacataaactctcaactttccccaaacttctccccaatttcagaaactaaacacggcctaaggcttacatactacactattaataactggtctcacatgtcatacacacacttcgttttggagttcgtgctacagctggctacaaatctatagcccgctgcttctctctctcctcatttatcttattaaaatatgtttgcagctaggttataacctgctattgtacctgctctaaatacgacttccccaaccgcccctcaagccatgtgacgtgttccctcctcccatacacgagtgtatggccgggtttagttcccaactttttcttcaaattttcaactttttcatcacatcaaaactttcatacacacataaatttccaacttttttctttaaacttctaaatttagcgtggaactaaacacaccctttatctctctccgccgagtcgtttcgttcctcacgcatagcccatccatccctcgcaggtgatgacttagggcacccacaatgtggatgaaaagtgggtagtaagaccccttactacctactttaccattgtgaatatggatagtagagcagataataactataccaggcaatagcactactacctggtaacaagcataaaaaaatattaaactctcttctctcactcactctctctcttttctatcccatcattgctttacatgtaggtcatatcttactacccacatattgtatattgtgtgaggtagaaacaactatgagtatgtttagatttatttggaatgacaaatggaaaaagtgttggtggcaaaagttttgacgttgcaaaaatactagttggtgtttagatgcatactaaacttttgctattctagcacttttcggtggagagagagagagataaatagtggtcccaaagcacgttttggcacaatttgctactatggactagcaaatggcaaatgataaattgtcaacttttactagtagtgttagatccaaaatggcaaaaagtgctctaaaatggtaaaattttggaggatctaaaccgggcctataacctagttttgtgagtcccatcttactacccacttgataaatatttattgattatgcccttgggggagggtggaaagaagtacggctaccaggaacataccagtagggaggaggacacatcaacaatgttgcagcctcaccaggagagggtattagggctttttccttgttcttataaataggtcgtttttgtcaaattcgatctcaccaaaggcctatttgtaagaaagaataattgcattttaacattataaaaagaccctcgacgtacatatttttgacgccgatcccttttgtgttagcaacttaccaccatgtatcagcatcgagagatgatctatttttatttttttatatacgcattttcaaaataaaattttaaaacaactaaattataaaatagtcatgcaggatatttcggttggttccgttgccacaattcatccatcttactagtttatactcctcacttatatatatatatatatatatgtatatatgtatatatatatatatgtatatatgtatatatgtatatatatatatatgtatatatgtatatatatatatatgtatatatgtatatatatatatatatatatgtatatatgtatatatatatatgtatatatgtatatatatatatatatgtatatatatatatatatatatatatgggaaaatagttctatactcctagggagtacgtactccctctcccatccaccgttcatttgatcgatcagatatgtactccctccctcatcataacgggtttggctcggtggatccgattagtttttctaattaaaagaccggactgcttattccgtaatttggggtttgctcccaacaggccaaacagattatcccgaaaattggggttttggggggcggcgcggcgacggaactgcgcgacgacggaccagcgattcagctttcggggttttgggggtcagcgcggcgacggaccagcgattcagcggcgactgtgtggctggcggcggtacagagatagcagtttgttccttcctccagtgatgactcctccccttcctccagcgatggatcctctctcaacaacatgtgttcctgaagcagaagtaatcgatctagagtcggctgaatgcaggagcggggcaacaatggcaaaatcgatgggccatagcagtggatttcatccaaagcagcaggttagtattcgtttatttttgtacggcaagatcaagacacgttgcctaaaattttcttctttgccgcagggtcacaggaaaattagtttgtcaccacagtccaaggtatgccacctgaaattgaatacatgtatgcctgtagagagggattaggtgtagttcggttcatgtactctctcagtttcagatgctaatttttccccttttagtgcatatgatggttttttgggtggatgaagttaatgctgttttagcccccacccccataaagaaaaatgtagatggtagtacgtactgaattttcaacggtatatactcattttttctttggaggggaactttttggaatctgctagacggtattaagtattgatttttggtgtggcagggttcttactgaactctctgttaggcaatagtatatactgaatttttatgtggggagctttattctctactttattggacgatagcatatactgcattttccacatctatactgaatctttccacagtgattcatagactgaactttgatacgcaccagtatttactgaatttttcatagatatactgaatttttctatgggaggctttgtactgagctttgttatacgacagcatatagtatgtactgaattttgtatgtggtacatactgaacttttctagaagatagcatatactgcatttt

SEQ ID NO: 18105 - DNA, 4912 bp, Oryza sativa
  unsure (1)..(4912): unsure at all n locations
taattaagagggtacacataggtagaatttgctacgcagtattttgtacttcatctttgcatacatatatgagtgtatgctgttttttttaaaaaatagaagtatatgttgaaattttaaatacactggtccatgtagtattgtctatttatgaaatgaaaaactaattatctgcaggctttgaaggtttctggcacaaggggcagcctaaataagactgctgcacgggtggtatccaggtatcggcaaagcagagttttaaatagacagaagaaagacaacactacctttggtatcaactgcaggtgtcagcccaaatgcgtagtgaatatcattaaagaattcgatgataggaagaaggagttgattggtgaagttgggtttgatggacttttggatatcaagcttactaaggtaaacaggcagtttggtgcatggctactgagcaaagttgatccgaaatcatgcgctattgttaaagatgtcaaccaggagttgccattcggtcctaatgatgtgaatgcagtttttggcttgccatgctcaggtcaacctattatcccttgctctcaagatgaattggatgggaagaaacaaatattgtgcgaaatatttgagataccaaacttttcacacctgaaaatatcactcttagagagaatcctaaagaagcagtatggttatcccatgacaatagatgaaaagagggttttcatggcggcttttgtgctttatgtcacaacgaagcttttggcaccgcaatcctgcgcaaacttcatatctcctaggtatattatggctgtttctgatgttgacaatataaaacagtacaactggtcccaattcgttgtagatgaggtgaagaaagcagcagaatcaatgcccacctgctttccgaataaggctcaactatccattaacgggtgtatcatctttctaatggttagcatttaaaactgacttgttaatgcagcatacaatcaacacacatattgtcattgtgaatcatttttgcaggtaaaatatttgagaaatctccagttccggaaggttgggatcacatgtgttaaaacatgtcacatttctcagtttgaggatgatcaaattgctaggatgattcaacaagatgtagttagtaaacataacccaggattccccttccctcgttatgggaaactccaggtatgtacgataccctggctgtaatatgcctatttctggctgcaaaatttagctaatttccgatatacatgctgttcagttgatgaaggaaccaagagaaaacaacccccatgtgccagagctatctcccctaaacttatgctccggttcgaagatcccatctagagccattgatggcggtaaaaatttaataaaattcttggaatcacacttctcttcgttagacgtacgtggaactgtcgggtcacaggtatgtcaaccatccgtatgctatgttacttgattgtttcttcattaagttgtaattttcacatgatcaagggattttaaactaacatgtggtatatatgataacataaaacaggcatacgaggagttgaaatcttacgttcaggatggattcgaccgcatcgatgagattttgcctaccatatcagatttcgtcgacataagcaccatgcaaactgctattcacgcatctaacctattcaagagagctttcaagactaatattacaacggcagttaagatagcgataagggcagcagtaacgaaagttattgataccattgaggatatacaaggtcctctccatccatggggagacacaactgccatgggataccacacacccacaaactactccacacatgctacaaaagatgctagtcaattggatcaaccaacaggtaacgttgagtacatacaccattttaaaaataaaactcgtactacttgacactctaacaaattttcggacgctcttcatgtatcagatacccaacaatatgatcacaaaattggaggcttgcagtgtactcctccaaaatctaatggagctccaggttggtgtaccaaaagattaaaaatttcaaccaacaatgtgtttactcctgatcatgcgaatgttttcagattcgaaaaaaaggccaaattcttcagtatcgcctacgtcgggaactcgcatgactaaccaatgttccattatgctaattgaagaattcggtagcgatgggcagaagaagcgcaaatacaccgttgaaaacccaccatctcacttgctgaagcacaagtcaaagcgtgtagtcaaaccaaacaggaagctcatgtcacctttcatgtcaaagcaatgctcaacggagaggctggaatccaggattgctgacgacctgtattcctatataatgtctatttctgacgatgcatcattagagtaagtatcattcttcttccagaataattaagcatctcaccccaccaaatctgacattcatttttatccatggtttatttcagaaaaacatggctgcagagctcccatcctttcataatatcattgacgctacgaaacatccaagaaactataaagattgggagccaaatggattcagattctctcaaccttgcaattcgaataatgttccaacaagaagttgagagatttcacaacacaaactaccttggttggaggcatttcattaaccaagattttggggtaacattgcatgcaataaacaatatatttctttcatcaataaaaatataaattcaatgattctttctgtattgtcagatgtacgcgctagctggtgaggaattttgggaagctagccatcaacttgcacacttctcgggcccagaggtagtatatgatgtttcagaaagccacctggtgagtacaaatttgcagttcgtagattgtagaaactcttgtaaacaatagtacagaagtagtcccactgaaaaacctaaactttgcagatactgattcctgttcacctattcaatcattacgtgctgtacgtatttaacatggagagcaagaagttatcggtgcttgattcactaaacacagaagatccactaggggaatcacgtttcaccaggcatgacaagataaagatcatggtgtcacagtgtgtaatggaatgcatgcgtcttgcatctccagggtggaacatggacatacttaattgggactttgagacagttgaaaatataccagagcagcagaacgggtgagtgactcctaaaacaaacgaaatacaaccaacccaaagcttgtactgacactactttctcaaaaacatacagggatgactgtggcttttacgtattcaactatatggtgaactacgatggtcgtcgtcttctgaaccctattacagaggtacataatgctttcatatccgcacacaccgcactccaccataaatatgtcctcataaagctataaagaaaatactctaactttcgcaggacccgtactacctccggaggcaatttttgatccaccttttgactctgcgtgataacgaggcaatactaccagaatatgtggtggaccgtcttcgacaaattaaagacaattagtttagcaattttctacttctagctttaccagaacattttcatgtaatcttcgaaatacacttctgtcctatcttgacagaatcatgaaaacattgctatgcatggacaaagtatcgtctgggttgcaatgacagttgcacgaactgtgctatggaaattattcactatgccaaacaataacagtatgtcatttacttccatttatcattttcaacgggaggattcaatatatgcggtgactctgcgtaaattatgtcattgactctgcgtgataacgagtcaattgctatcgataattatgtccatttcagtgaacgggaggattcaatacattgcacagctaatttctatctccatacctaaaaaaaacaactcatatccacaccaaatcacactccttttgcaaacaatgatcgtcataaataccagtatactatatctctttctctctttatagagaaagcaccatcatccaaatgaaactaattacagcagacatccatttttaaccggtgcaaatacactacccaaaaaagacacaatttactactagaagcatactttacttaaggtcgtatatactgaccaatccacaggttacataatcttaataaattgctcataggatgaaaaaacacacgcctctcaaaaatttgttcacgtacttaaaacaaaacaacttctaacaatcagaggagtcccaactaaactacagggaaccatattctaaagttttctcttgtacgtagatgtccggccgcaagttcgcgaattatgaccagcttcgtggcatgtgtggcaaaacctacgaggaaagggcacttcatcatcatgatcaatgacttggttttcttcttcaacggactcacactcattggttgtgttcttcttctcaatccctacttcttttcttcttttcaggctggcaacctcaccacccgatttatacctattcaccttaggtcttcctctgcttctctttttcaacggtggaagtatatcagcagtcaaatttccaccctcgtcctcacttggcacgtcatactcactgtcctcatcacctccaccaacatcttcgtttccatctttagtcaatacagtagaccttgatttatgcctagctgctcgcttcggagcttctctactattgtcaccatcatccaaagataactgatttttcatgtcctccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18106 - DNA, 1378 bp, Oryza sativa
cggaggcagagcttccccccctctgccgcatcgccctctctccctcctccttttcccccaaagtggcaagggggcaaccccctttctctcccccccttttcccttttccctcccgccggcgtcatcctccccccccggtcgccgtttgggccgcgaccgccgagcgctggctcgctcccttgaccgcccaaggtcggtttccaaaccgacattgccgtcctataaacccaggcgccctcccttccttttttcccctcccaatcttccccgtttttcacccacgccattgccgtccctctcgccgaccgccgccgtcgcgtgtgccggaggagccagtgcgcgctaggacgcggaaggggactccgggcgctcgtcttcttcctcttccccggcctgaggccggagagatcactcccgtgccgtcggcctctcgtcactgcgccccatcacccccgcacggtagtgcctccctccgttctccctcctcgttccatctcctccccttagactcgggtagtagcacgagtagcctccccgtagctagctagcgccgccccgaccgttgctgccgctcgccgtgtgctcgccgccgtcgccgcccgtgctccgtagcacccgttcgtcgccggcctcgctcggcgtagctccgccatatccgacgctagcaacagactcccggagtcgcgtagatgctctagctcgcccgaatcggtctcccgtcgcgccgtcgccgtttcccccttctctcgccgccggttgccgctaccacaatccgccgccgtcgagcatcccccggcaaatccgagccgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcaaccacataggcaagccacctttgaacatcttgagcctatatttgaacttaagtatgttgcttgaaaaatattatgcattgataggattgcacttaatctacatgtcccgtctgcaaggcagattggcggacctacctaacttgttgcagttgacccctccattgtaattattataccatgttcccttgtaaccacctagttacgcctcggtaatcgtgcactctgcacgaatatcgacggtcgccttcaaacttaaaatctgataaacatcttgggtaaaacttaggttttacaaaacacttggaaaacccgacacctgggtcggtgcttgcgaacctaaatgaatttccaaattcgcagaccggggaacgtaccgggtgtacggttccccgctcttgcacttaaggaccgtttccttagaatt

SEQ ID NO: 18107 - DNA, 10428 bp, Oryza sativa
agccaggcccgggtggccgtttaaaagccgttggccgggtgccaaccttgaccaattcaaaagactgataccttgcacatactccgaccgggcgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtacttctgtactcatccttgccctatataaataatccccccccccagttgctgaagaagatgaagcggatcccgctgacgaggagttcttccaggagcaagccggctacgatgagttttagggtttcggcctagttcccaagtcgcgcctgtgatgtctggtccaagtcttggcttccgtttcccttttgtaatgtagttgtgagctcgggatctgtccgcagcccaacatgaccgtactcctactctataataaagagacctctgttgctgtgatattctgtcttcctgtgataccagcactgtttcctgggactggtatcaattaacaggttaatttggagcgtcacgggctagtcccgctcggggctagttcggggcgtgacactagcattatagtacttgctcttacctataaacatgtattacataattaatgtctggtcacacctgccatacacacatgcatcttgaagtccgtgctgcagctggctataaatctgtaacccgctgctcttctctctctttaaaatatgtttatagctggcttatagtgctattgtacctgctctgatcagccacacgttgatttacaatacaagacgacgtgcatgtcattcagcagctcagcgcactcggggcataagcctgaatactgaggtggtgttcttttcttctgaagatgaagatgaagttttttacgtaaaacgatgtggtataaacgtatgattaattgagttttaattattataaacttaaaaatatagattaatatgatattttagagccactttcatataaaaagtttatatacgaaacaccgtttagtagtttgaaagcgtcaaacaggaatcttaacggagcctcagctgctgcatatggagggacgcggtcggggaggagctgcaacagcgaggccatcgatgagcgcgtgctccatcgtgcacggaacgccacatttgcgtgcgcttatttatcccgtcgtcgcacgcatcgcgggtcgcactcgcaccatgcggcagagcgcgcttttgcttttgtatcgccttcgcccgtgaggcacacacaagtcatccctcgtgagtgtcacatcctaaaaattcaaaagatataaattgttgtttaaatggaattattagaatttattttaaaaagctttgaagagaagatctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaacccttccctctctcctcggcccaagccggcccagtccgcagccgcccgcgcgcgcgcgtccgctcgctgacaggtggggcccgcctgtcaggtcgtcgtcttcctcgcgacggccgccgcccgaaaccctagcaccgcgccgccgccgtttccttccaaatccggtcgatcctttccttctccggccgaattgatagaggggaaatgatcctcgggatctcctctaccttttcccctttggaaatatcggctaaatcggcttggaaagtgtttgattcgaagtcgaatcggatcggcttttctctctccgagcccgacctttccatctcgtcgccggtcgccgtgggccttcgccgccgcctcctagcccctttaaaaggacccccggagtcgccgctacccgtcgccaccctcgccttcgcctctcgtcgccggtagagctctagcgccgtgtgacctagcgccgccgtcgccgccgtcgctccagctgtgcgccgccgccattccggtcatcgccgtcgctcgggaagaccgccgtcgtggtcgccaagtcgccgctgtcctcgtccgccccttcgccatcgccgaagatcgccggagcaccatcgccgccgtcaacccgaagaccgccgccgtttcttcgtcgtcgccgtcgccgtccgttggtcttccgccgctcctttggtcaccggtgagttcgccgcgtcgcgctctacgtcttggtgccctccgttcgtgccgaagcgccgctgttcgccggcgagcatgcacgcccgagccgccgagccgccgccgccggtggtgacgtcatcgccgacgtcatcgtcgccctctcccgtgagccggtcgtggaccgttcgatctcggccgtccgttttggatcaagtcgatctcggccgtccgttcgcgtgaaccgtcgccgtgcgcccggtccaccgcgaaaccctagctgctgacgcaataaatccctttttccttttcaaaaataattcattattgcgtcataattcaattgaaatccatataagtgttttaatccgatttaatcttcaaaaattcataactaattcatcttagctcggatttagttggttcaagtctctaaatttttccaaaattgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctatcatttctattcaactattgcatttattttcgaatgtcattgggtggaattaacctattgtttgctaaagcccttttgttcttgattactttattccttgataccttgggttattataacttgactagttgagctttatatattggttcagctagatattagatataattgcttagccctgcttagaaacattagcacactattgggataacttaagatttactattatttaatgatggcttaatgataggtcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccatactgagaagtggcggagataagcccacgggggtcgctggggagtccatgtcttgtttataagggggtgattatgatccaggaaaggtgcgctgtaatggattgtgttgtgcaaggggtattgtcacaactcctttccgaggtaccgtggtggtattgaggcacatggtgacatgatgtggggttgtgtcttgtgggtacagtggtacacctctgttcagagtaaaactattcgaatagccgtgcccgcggttatgggcgggtctaacaatgtctttcgtgattagtctcacacatctcatcataataaaagatgctataattggtaataatttgattagctcctggtttggaatggtatattcctggtttggagataggactgtgcagccgggatggttgttcagaatggttgggcctatacaacagggtatgttgtatagcgttggattaatattgtttaattattacttaactattttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtatgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccagcaaaagttttacaatattgtttagtttaatcttgctgcaatgaaataaatttatcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttttatgcccaaattcctcatgatcgtcacgaagaaaagtgccgagtcaaagtcaccttgaacagtaatagtgaagatatcccctcagtgatgttcgaagccggaggaagaaactacatccatacatgtcaggaggtggcaaggatcgccataggagagctccgcgatcgctacagtgatcagttggccgacactgagtatcgctaccatcctcgccaaccccagggaagtgaccgtggcagctaccttgagactgagggaattgagaatgatgctaccacaaggcatttggttgagatgctgtgggctatggatgaaacccgtgcggagactgtgttagcggctcaagatcgtgaagatcggaatcgtggtaagatttgcaagttagaggacaaggtggatcgtttggagaaggaactagccgtattgaagggagaagcaccaccgcagaaggccagggttcgtctcaccgcgaggaagagagctctatttgtccctcgctaccaattggtgccaaaggtccgtgtggtggagaaagaagttaccccagccctagcagatcctccggtcgtcaatgtaagtgatgatgaaggagatgaatcgaagcgcacccattccaagattgagtggggagcaactcaagatgatgaagacgagctgaacgagccttcaatcaactccgatgcccggaagacctagaatgccttgtcaaaccgttgtcttagatcgttgtgttagtttgcttgtttaagtttggttgtgtgggtcttgcatgtgatttacatcagtggtgggatgtaagtgcatgcgtttgtttgcttttgagtgttaggaagttggtgagtttagtggtgtgagagtcttcagttttgtaataatgaaactcagttaagatcaataaaagttaaagtaattctctgccctaagtagttttccccggtttctcttcttgtgccctgcccatgccagatggtgctcactcgcagcaacgggaatggccccaatagtaacaataacaataacaatgaagggaacccaactcttgcccaagttcttgctcaacagacacagcttatgaacatgatgatgcagcaactccagaaccagcagaaccagggaaataaccatgcacctccccagaacaagttagcagaatttcttcgtgtgaggccgcctattttctctagtaccgctaatcctgttgaagctggtgattggctgcatgccatagagaagaagttggatttgcttcagtgcaccgatcaggagaaggtctcatttgcatcacaccagctgcatggccctgcctctgaatggtgggatcacttccgccttaataggattactgctgaacctatcacttggcttgagttcaccgctgctttccggaagacgcatataccatcgggagtggtgtctctcaagaagaaggaattcaggtcgcttacccagggatctcgctctgttaccgagtatctgcacgagttcaatcgtctggctcgttatgctccggaagatgtacgcactgatgaagagcgccaggagaagttcttggaatgacttaatgatgagctttcttatccactcatgactggggattatcctgatttccagaagttagtggataaggctattcgtcaggaggacaaatacaatcgcatggagcagaagaaacgccggattgctcatttcatgacgcaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctttgacacagcaacaacctgccaagaaggagcaaggcagcaagcccgtggtgtgtttcaactgtggagaaccaggacattacgctgacaagtgtccgaagccccgacgcgcgaaggttgtccctgcccagagcaactctaccgcaccagcatcaaaggcccgtgtcaatcatgttgctgctgcagaaactcaaggtgctccagatgtgattttgggtacgttccttgttaacttagtccctgcaacagtgctttttgattctggtgctacacattcattcttatctatgagttttgcgggaaatcatgggatggaagtagaagatcttagacgtcctttgatggttaataccccaagtaatcaagcactctctttgcaacatagccccttctatcagaatagaaattcaaggagtaccatttctggccaatcttatcctgttagaatccaaagaccttgatgtcatcctagggatggactggttagccagacataaaggtgtgatagactgtgctaacagaaaaataactctcaccagcaatgatggtcgagttgtaactgtgcatgcattgtctcctgagtttttaaggtcaagactgaaccaaataactttggaagagattcctatagttcgggagtatcccgatgtgttcccagatgatttacctggtatgccgcctaaaagggatatagagttcagaatagatttggtaccaggaacaactccgatccataagagaccttatagaatggcagccaatgaattagcagaagtcaagaggcaagtagacgatttgcttcagaaaggatacatcagaccgagttcatccccatggggagctccagtaatttttgtggaaaagaaagaccatacccagaggatgtgtgtggactatcgtgcactaaatgatatgactatcaagaataagtatccgctgcccagaattgatgatttgttcgatcagcttaaaggtgccaccgttttctccaagatagatcttcgatcagggtatcatcagttgagaatcaaagaggaagatatacctaagacagcttttaccactaggtatggattgtttgaatgtactgttatgtcttttggacttaccaatgcccccactttcttcatgaacttgatgaataaggtgtttatggaatacctagacaagttcgtggtagtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatctttttggtactcgtacagaggtgtataccgatcacaagagtttaaagtatatctttactcagccggatttgaacatgagacaacggagatggttggaattaattaaggactatgacatgggaattcattatcacccgggaaaggctaatgttgtagcagacgctcttagcaggaaaggctattgcaatgctacggaaggacgacagttgccattggaattatgcaaggaatttgaaagattaaatttgggaattgtcagtacaggtttcgttgcagccttagaagcgaagcccactctaattgatcaagttagagaagcccaaattaataatcctgatattcaagaaattaagaagaatatgagaagaggaaaagctatcggtttcttggaagatgagcaaggaactgtatggttgggtgagagaatctgcgtccccgacaacaaagatttaaaagatgcaattctgaaagaagcccatgatactttatactccattcaccctggtagtaccaaaatgtaccaggatctcaaggaaagattttggtgggcaagtatgaagcgtgaaattgcagaatacgtagcagtatgtgatgtttgtcagcgagtcaaggcagaacatcaaaaacccgccggtttgttgcagcctttgaagattcctgaatggaaatgggaggaaatcggtatggatttcatcactggtttacccagaacgtcatcaggtcatgactctatttgggtgatagtcgacagacttaccaaagtggctcatttcatcccagtaaagacaacatattctggaagtcggttggcggaattgtatatggcaaggattgtgtgtttgcatggcgtccctaagaaaatagtgtctgatcgaggcagtcagtttacttcaaaattttggaagaagcttcaggaagagatgggttctaagctgaactttagtactgcttatcatccacagacagacggacaaaccgaaagggtgaatcagattttggaagatatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcgtagagatctaagttttgacgcaggagattatgtgtaccttcgtgtcacgcctcttcgaggggttcatcgttttcataccaaaggaaaattggcaccgcgttttgtgggaccttataagattatcagtagaagaggagaggttgcttatcagttggagttacctcaatctttggcaggagtccataatgtgttccatgtgtcgcagttgaaaaagtgtttaagggtacctaccgaagaagctaatcttgaacatatagaagtccaagaggatctgacctatgttgagagaccaatccatatcttggaaatagatgagagaagaaccagaaatcgagttatccgtttttgcaaagtccaatggagtaatcactcggaagaagaatcaacttgggaacgagaagatgaattgaagtcagctcatccgcatctgatcgccagtgcttccgaatctcgaggacgagattctgtttaaggggggtaggtttgtcacatcctaaaaattcaaaagatataaattgttgtttaaatggaattattagaatttattttaaaaagctttgaagagaagatctaattttaattaataaattccaatataaaatggggccaga

SEQ ID NO: 18108 - DNA, 440 bp, Oryza sativa
ccgaattcctctcggcccatctccctctccctccccatccctctctctctctctctctccctctccccctgctctgcccgtgcgctgcgcccgcgtgcgcgtgagccgcgccgagtcgagcgcccttcgccctcgctgccgtttcctgtcgacgccgcccaaatcgccgcgccgcccgttgcttcccgcgcgcgcgcgcgccatggtggccgaccggccagtcgccgccgccgtcagcgcctgcccgcgcctgccgcccgtgccgttgctccgctccaaaccgcccggccgtcatcgccgtcgtcatcgacttggccccgcctctcctcgcgcgtgcttccaagggacggaggcagagcttccccccctctgccgcatcgccgtctctccctcctccttttcccccaaagtggcaagggggcaaccccctttctctccca

SEQ ID NO: 18109 - DNA, 9437 bp, Oryza sativa
aaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacctttcccggccgctgctctacgtcgccggaataccaccgaaaccccatttccctcgcgtcgtcggtgagttctctctcccctccgactccggccggcgtggatggtcgccgtgggggttttcctccgccctaattcctctcctctatttccctaggtgtcgccgtcgctcgtccgcacctcggcatcgccggtcttcgccgcctccctcgtttttctccgccggccattgccgcccctccggtgaggtctccctccccttcctttccttctttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgcccttcccctctctctccccgtgccgctgaccggtgggccccgcttgtcggcgccgcgccaccccgtgctggcgtcagccctggaatatattgcgcaataattaattaaggactttttctttattagtaaaaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgatcatgttgatcctatattgcaaatatcctaatgttttctttcaaatactgcatttgttttgcaattatactatgggatggttacctattgttacagccatgtttttggataccatgctcctttgttagcttgggttataacatgattagactttggactaggaattgcttagccatgcttagttcaactagcacacaatggggagatctcttttaaaacctagactataggtttataggttaatgttggatcggtaccaccgctctggtgttggttaaataaaatgaataatcatggtgggctgtgggtgcatggttttgctagtcacgcccatggcaattaaggaccggttcgcgggaaaccctggaagaacgtatcgtacttaccacaagtcagcgtgggcaacggctgggcttgtagtgtagcttttctctagctgacgcatccaggcaagggtgggcgtgatggagcggggcgggccctgcgacggcctctatcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtgggtatagttgtacacctctgatcagagtaaaactattcgaatagccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatccctgcatcatacccccattctggtatgacttgctgagtacagtgggtagtactgtcttgctctatttctccccaatcccagagtttgagtttgtgtcaaatggcgggttctccgaggagtaggcttcgtccgtgccgtcgaggatgcctgtggagtggtgttcccgctgcagtcaagtccaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacaagttggtatcagagccgaccttgaccgtaggacaagccaaatggaaacctaagagccctctgaatccttttcatttgcataagttctttgcaattggattttattccgggaaaatttgggatctgctcttgtggttcaagggaaaaatcttgtcgcccgtttaaatgggatttgccaaaacgagtcagtctagggttttagtaaaaatttttttaagatttattcgtcagtcagttgggatttgatgggtgaaatgtattaggtcctagctcaggaacatgggttgcaaggtatttatgctttatttgtaattacaagtatgtatctaaattccccattattttacctctatgtaagtccgtcttatttattcgctctcatgcaaaatgatttatgcataaaattttgctcttattcgattctcttatttgagtcctttattgctttatttaaatttggatttgagcatgcattgatcctactcctttgtcttctttagatggccggtcacccacccaaccaccatggagagggcatgattgacttcgtggcagagttggcacgcatgacactggtggtaggctaccccaacgcgccggagtacacgacgattccaccgctcagtggcgagcttcctcaccgtgtccgcttggaggtccatggctacgtggggacttgccttgctaacatggtggttgaggcgtcaggaggcacagcagaccacgcatgtcaggaggcagcctacctgatgatggccagactccgggagcgccacaactacatcttccacgacacggcgtaccgcttccaccctcgtcgagcccacggcgacgatgtcagttcgttccgtccgacagctggcgagaacgacaccaccttcggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttgaagggtcttcccgcgccaggaggagtccggatccgcactacgccccgcaagaggacgactgcacccgtgcgcatccagctcgcgcccaggaacccacctccgcccgcagctcccgcagcacctccagttccgcccgcagttcctgcagctccagctccagctccagctcccgcgtccgctctctccttcgctccagcatcagccgccaggggtccaggcagtggtactggaggttggttgtctgctactcccagtggcagcagctccagtggctcacagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttccccgtctgctctccctccagatggtctacaccaggactggcaaccgcacggcaggcgagggcagcaatggcgaagaacgcgctgatggtgtgcaccccaacagcgattccggcaatggtccgccaccccttcccgagaatccgacactggcccaagttatggcacatcagactcagatgatggcagccatgatgcagcagatgcagcagcagcaccagcagatgcaccagaggatgatgcagcacgccgaacaacagcaccagcagtttggtccccctccccctcaatccaagctgctagagtttctacgcgtcaggccacccaccttctccagcaccaccaaccccatggaggcgaatgactggctccatgccatagagaagaagctgaatctcctgcagtgcaacgatcaggagaaggtcgctttcgccacacaccagcttcagggtcctgcgtcagcttggtgggacaatcacatggccacccgcccgccaggcgctgaagtcacttgggcggagttttgccgtagtttcaggaaggcacaggtgccagacggggttgtagcgcaaaagaagagggaattccgggtgctccatcagggcaacaggacagtgacagagtaccttcatgagttcaatcgcctcgcgcgatatgcaccggaggatgtccgcactgacgccgagaaacaggaaaagtttatggcaggcctggatgacgagctgaccaaccaactgatatctggggactacgctgattttgaaaggctggttgacaaggcaatccgtcaggaggatcagcgcaacaaaatggacaggaagagaaaggcggcgcagttccggtccaaccaaggtagtcagcaccgaccgcgtttcactcccggacagcagggtggacctaccaccatgatcgtccgtcagcaccgcccgttccactctagcaacttccaccagggcgctagcggcagtccgaaccaccagggaggccagcccaaccgtggtgcagctccacgcccaccaatggcaccagcacagccagccccgtccgcgcaagccaagaaggagactggcacaaaaccggggtcctgtttcaactgtggcgagcttggccactttgccgacaaatgcccgaagcccaggcgtgccggaccaaggtttatccaggctcgtgtcaaccacgcgtctgcggaggaggcacaagcagcaccggaggtcgtactggatacgttccctgttaactcaatccctgcaacagtactttttgattctggggcaacgcattcgttcatttcaaagaagtttgtcgggatgcatgggttaataagagaggaacttagcacacccatgcgggttcataccccggggaatagttccacttcggtacaattcagcccttctatcacaatagaaattcaaagatcaccatttctagccaacctcattcttctcgaatccaaagacctagatgtcattcttgggatggattggctaaccaagtttaagggagccatcgattgtgcgagtcgcacagtcaccttgaccaacgagaagggagaaacggtagtgtacaaatcaccagactcaccaaagcaaggggtctctttgaatcagatcgagacggaaatcccagtggacaccgtggagaaaagcttgaggaaattggaagatatacccatcgtctgtgagtatccagaagtgtttcctgaagacctcactaccatgccacccaagagagagattgaattccggattgatttagcaccgggaaccgcagcaatttacaagagaccgtacaggatggcggccaacgaactagcagaggtcaagaagcaggtcgatgagcaactacagaaaggatacatccgaccgagtacttcgccttggggtgctccggtcatttttgtggagaaaaaggataagacgaagaggatgtgcgtcgattaccgcgcactcaatgaggtcacgatcaagaataaatatcctttaccgcggattgatgatttgtttgatcaactgaagggagctaaggtgttctccaagatagacctgcgatcaggctatcaccagttaaggatccgggaagaggatatcccaaagacggccttcaccactcggtacgggttatatgagtgcacggttatgtctttcggactcaccaacgcacccgcattcttcatgaatctaatgaacaaagtgttcatggagtttctggacaagtttgttgtggtattcatcgacgatatacttatctactcaaagtctgaagaagaacatgagcagcatctccgtctggtactcgagaagttgaaggagcaccagttatacgccaagttcagcaagtgtgatttctggttgacggaagtcaaatttctgggtcatgttattacagctcagggtgtggccgtcgacccatccaacgtggagtcggttaccaaatggaccccaccgaagaccgtgtcgcagattcgaagttttcttggacttgcgggatattaccgccgattcatcgaaaacttctccagaatcgcccgacccatgactcagttgcttaagaaggatgagaagtttaaatggacagctgagtgcgataaaagttttgaggagctcaagaagaaattagtatctgcaccagttttgattctgcccgaccagatgaaagacttccaagtctattgcgatgcatcccgccacggacttggatgtgtcctaatgcaagagggcagggtggttgcgtatgcctcacgacagttacgtccacacgaagggaattatccaactcatgacttggaattggcagcggtggttcatgctttgaagatctggaggcactatctgatcggcaaccgctgcgaggtatacacggatcataagagtctgaaatacattttcacccaaccggatctaaatctccgacaacgaagatggttggaactaatcaaagactatgacatgagcattcactatcacctgggcaaagccaatgtagtggcagacgcattaagccggaaaagttactgcactgccctatgcatcgagggcatgtgtgaggaattgcggcaggagtttgagcacctcaacgtgggaattgttgaacacgggttcgtagccgctctggaagcacggcctacgctcgtcgatcaagttagagccgctcaagtaaatgatcctgaaatagcagagctgaaaaagaacatgagagtcggaaaggctcgggatttccttgaggatgagcatggcacaatctggatgggagaaagattgtgtgtacctgacgacaaggaactgaaagatctgatactcaccgaggctcatcaaacccagtactccattcacccaggcagcaccaaaatgtaccaagaccttaaagaaaaattttggtgggtcagcatgagaagggaaatagccgaattcgtcgcactttgcgatgtttgccagcgagtgaaggcagagcatcaaaggccagcaggcttactccaacctcttcaaatcccggaatggaaatgggaggaaattggaatggactttataacaggactgccccggacatcatcgggtcacgattcaatctgggtagtcgtggatcgactcaccaaggtggctcactttataccagtacataccacctatacgggaaagaaattggcataattgtacctcgcaaggatcatgtgtttacatggagtacccaaaaagatagtatctgaccgaggtagccagttcacctcaaaattttggcagaaactgcaggaagaattggggacccgtttaaatttcagtaccgcctaccatccgcagacagatggtcagaccgagcgagtcaatcaaattttggaagacatgttgagagcttgcgctcttgactttagtggagcttgggacagatgtttgccatatgcggaattttcgtacaacaacagctaccaagccagtctacaaatggcaccatttgaagctttatacggccggaagtgccgcacacccctcttctgggatcagacaggcgagcgtcaactgttcggaacagaggtattagcggaagcagaagagaaagtcagaatcatcagggaaaggttgaggattgcccagtctcgacagaagagctacgcagataaccgtcgaagggagctcacttttgaggcaggagattacgtgtatcttcgcgtcactccgctccggggagtacaccgctttcagacaaaaggcaagttggcaccacgcttcgtgggaccatacaagatcctggaacgaaggggggaagttgcttatcagttagaacttccatccaacatgatcggcatccatgacgtgttccatgtgtcccaattaaagaagtgcttaagggtacctgaagaacaggctgattcggaacacattgatatccaggaggatttgacatatgtggagaagccggttcgtatacttgacaccagtgaaagaagaaccagaaacaaggtcaccagattttgccgagtttagtggagtcaccattcagaagaggaagcaacctgggaaagggaagatgagttgaaagctacccacccgcacctcttcgccagctcctccgaatctcggggtcgagattccgtttaaggggggtaggtttgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaataattttaaccaattaaaaatcaccaaagtgcaattttaattccaggaaaaaaatcctttttctttttctttttcttttttttctctttttcctcctttctttcggatgggccgctggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgccccgccgaaaccgccgccgccgcacccacttcctccgctttccccgcgcccacgccacgtcgccgcgcccatgccacgtcgccgccctctccccgcgtctcccggccgcgccagcgcacgagaggggcgggattcgattttgaatccccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgag

SEQ ID NO: 18110 - DNA, 7144 bp, Oryza sativa
ccaatcccagagtttgagtttgtgtcagatggcgggttctccgaggagtaggcttcgtccgtgccgtcgaggatgcctgtggaatggtgttcccgctgcagtcaagtctaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctggacgtgacagaccctaaggacttcaggatggtggtccaacggtgctgaatctcagctccgtggaggcatccctcatcccccaaggggtcctcctcctctgctgcgatccagagcgcgccaatatcctggccatcatgcaggtggtcggggcgtcgggggagcgggccccccgaggccacgatggcgtgggcgggagcagcaggggggaacaatctacctcgggagggggtcgtgcttctgggccccgcgacgggggcccggggggcatccgtcctgccgacactcggggaaagaggaagcaggagggtacccctcccccatctcctccccgagggggcggggcggtgcgtgccagcagcaggcgtccggagggtgccgtgccgactccgcagcccgagggggagcgaaaaaagaaacggctccgcaagatgggggggatcgtgccatgccgggggaacctcatctcgcccccgaggtggtcgtttagccaacctccccgcaggttcgtccccgcgcccaccgcggccgtattcattctcccatctcccaaggcgagttttcactcacccatttctttttgtcttctggtttttcttctgcctcagcgagatcccgtcgcgcccccccccccccccccccgatattccaagtccggccagtctgaggccgaggagacggcgactgcagaggctcggaggcgggaagctgaccggcgagaagccgcggaccgcctccgggaagccgaggaggctgcccaggaggccgtccgggctcgccaggctgaggaggccactcgggaggaggccagactccgccgggccggggagtccatccgggaggcagaggcggcgcgcgcacgcgaggcggcctgccaaacccccgacccgaggcgacgatgacttccgaggccacccacgacgaggccgcgggcgcgccgctcggtcccgacccctcgggcgacgcttgggacgagccagcttcgggggacacccccgagtccggcacgtcgatcggcgggccgagctgcgcggcacccacaccgaggcggctttcccctctgtcttccgctgccccaccgagcgcggagcccctcctgcaggccttggccgccgcgaacgtcacggtgctggacgggttaagtgcccagatggaggccctgcaggcggagcgggcggagctcgacgcggcgtgggcgcgcgtcgaggaggggcggcgctcggtggaggccatggtggaggcgggccgcatggcacaccgccggcacgcttcacagctcgaggcccgtcgtagggacctggcggagatcgccagggaggtggaggaggagcgagagactgccctcatcgccaccgccgtgctcgacgaggcgcgggacgacctccgcctccaatacgggagccgggcggcggagctagaggagaagctcgacgccgtccggggagttcttgacgccgccgttgcccgggaacggcgggcggcggagaacgaggcggcgttccggcagcgcgaagaggcccttgaggctcgcgccacggcgctggaggagcacgcccgcgcgctggacacgaaggagcgcgacctggcggaccgcgaagccgccgtcgccactcgggaggcaacactggcggcgcacgaggccgcctgcgccgaagaggagtccacactccgcctccgcgaggacgcgctcaccgagcgggggcgagctctcgaggaggccgaggccgcggcgcagcggctggcggacagcctgtccctccgcgaggcagcgcgggaggagcaggcgcgccgcaatctggaaggcgcccgtgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgctgagctgcagggcgcgctggactcgtccgccggggaggtcgaggcccttcgcttggcgagcgaggtagggcccggcatgcttcgggacgccgtctcccgtctagaccgcgccgggcggcaggagggcctctggggcgggcggcacgcgaagtacgccgccaaccaggggggcctcgcccagcgcctctcagaaatgaccggggccctcgagcggctccccgaggagctcgaggagacgatcaagtcatcctcgagggacctcgctcggggggcggtggagctcgtactggcaagctaccaggccagggaccctgacttctctccgtgggcagcgctggaagagttccctcccgaaaccgaggacggcgcgcgtgcgcaggtccgggacgccgccgaccacatcgtccacagcttcgagggtacggcccctcggctcgcgttcgcgctcgactccgacgaggagggcggtgacgatggtgcggacgacagcgacgacgaggccggcgacccgggcgcgtcggagtgagccctcaggcccccgccaatcttaataacttttccttcttcttccgaggccttcgggcccccttcttgtatagactgacttaatctgcaatcaagtaaagaggaaatttctgcgtcagttctgtttgttgtgtgtatgagacgaggatggtctgtgccgcggtccttctatgtcttggcttgaacaagggctcgtgcccaggtcccagcctcaaacggcgcgggtcggggctagtgcctggggagatcctcgtgtcgagactggccaggccgggagcgtggtgaccgagggttatggatgacccgattgtgggcatttgccgattcccccccggagttcaccacgccccggggcacggctcggttctgggccccgtttggcgattttagccggcccgggccaccgagggcagggtcgagcacgagcgtgctaatttaagccaagattcttcaaaaggaaacgatggcacagacacagtcctcaggaaatcgaaaatgcttttattgaaatacggaagagaaaaaaggtaagtatatgcatgtggtagcccccggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcattgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtggggaggggaggcgaagcagagcttgatgcccatgtcttcgcagtagtcaccgaagagctcactagtgaactgggtgccgttatccgtaatgatacagttaggcaccccaaaccgagcagtgatgcccctgatgaatttaagcgcggagtgcttatcgatcttgacgaccggataagcctcgggccacttagtgaacttgtcgacagcgacatacagatattcgaacccgcccggggcccgcctgaacggacccaggatatcgagcccccagacagcaaacggccacgaaagaggtatggtctgcagggcctgggccggctgatgggtttgcctggcgtggaactggcacgacctgcaccgtcagaccaggtcgaccgcatcgttgagagccgtcggctaatagaaaccctggcgaaaggccttgccaaccaaggtgcgtgaggcggagtgggctccgcactcgccttcatggacatcggcgagaagctcgacgccttgttcccgaggaatgcacttcaggaggactccgttaaccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagtgctcccctcgggtcccgaggcctggactccgacgggcctcgggggccattcaggcgcgtccgtctcccctagggggtcgggtcgggccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcggggggcccgagctggcctcgggggcggagacgggctcgggagctggggtccactccgccacaaagtcggcgagggcctggctcttgatcgcgtggcgtgattcaaagcgcaaatcgaattcagagagttcgattgcccatctcaccacccgtccagtaccctctcggttatgcaagatttggtcgagggggtaagacgtaaccaccgtgacccgatgcgcctggaaataatggcgcaacttccttgaagccatcagaatagcgtaaagcatcttctgggcctgagggtatcgggtcttggcgtcccggagggcctcgctaacgaagtagacgggccgctgcacctttcggcggggccgatcctcttcgctaggggccacatctccaggacgctcttcgtccgagaggccacgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggccttaggccgccattcggctcgggggcctctgctccctgctctctcccgggtcgagtcgaagcagggtggggatgcgcggagtgagggttgtcctcgtcgcgctccacggccaatgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcctggagcgtttgaggagcttaaataggggtagtgccttctctcccagcctcgatatgaaccgacttagggcggccatgcagccggtgacgcactgcacatccctaagcttgctggggggcgcatccactctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcacccagcggtggagtcgacaatctgatctatgcgtggcaaggggtaagggtccttaggacatgccttgttaaggtcggtgtagtcgatgcacatccgaagcttgccgttcgccttgggaacgacgaccgggttcgccagccactccagatggatgacctcacggatgaatccggcctccagaagtcgcgccacctcctcgcggatgaaggcttgacgttccggggcctgccgccgcactatctgccggaccggccttgcgccgggccgcacggcgagacggtgctcaatcacctccctggggaccccgggcatgtccgccggtctccaggcgaagacgtcggcgtttgcccacaggaaggagacgagcgcgtcttcctatttgtcatccagaagaccaccgattcgtgtggtcttggacgggccgtcgcccagggcaacctccttgaccgagacctcgtcgcacgtgaccatccgctgccttggggcggccgggacggaggtggcgagcctctcgtcgccacccgcgggcttggacgccgcggcgaggtggtccgcgcgctgctccatacaggcaagcgcgacttttaggtcgccatggacggtgatggggcc

SEQ ID NO: 18111 - DNA, 4987 bp, Oryza sativa
caccatccccggggccttgatggcgtcaaaggctgcgggggaaaggatgttgagggctgcacccccgtctatgaggacacgccccaacttcacattgcaaacggtgggggaaaccaccatcgcgattgtcctccctgggcaacgcacggcgggtggtcggtctggtcgaaggtgagggcaacctccgaccaccgcgcccgccgcgtcgcctcatgggtaggggccacggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgaggtcgtggagggaggtgttgtgcacggtacaccacttgccggttgggcgctcccacctgggagcaccggcctccttctttttgtcgctcgcaggcctcccctttcggggggcccgcgaagcgccctcgacggcgaggacatgaccctcgtcgtcggaacgggccgaccccttcttcctcctcccgtcccgccgccctgaccgagcggcggatccgggggcggccggagctgccacaccagaaccggaggagttccaggtccaggcctcctccttgcgagccacacggtccgcgagctcaaaaagttgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagatcattagccaaccccgtgcctgacccttcagggccatggggaagtaattcgccatgaccctgtcgtcacccccggcagcctcgatcccggtcgtgtagatctggagaaactcggcggggttgacgcttccgtcgtatttttcggtgatggtgggccggaatcttgggggccaacggacgttccgaaggctcgccacaaaggctcgacagccagcaccgccaaccggggacacggggggccggcccccgtgcccgaaccgaagtggcgctccggacgaggaagcgccctccgttgcgtgggcggcgcgacgagcgtcgcgccggcgctcgatattgaggcgggcatccggccccccacgcacatcttcttgggtcggaggcgttgacgagggaatggcggacgaacggcgggtaacggccgccgctcgccgcgccctccgcctcgacgacatggagccggctgcggcagcgccagaggcctcggtggcggaggaccgcccgccggcgcctaggcgccgctgcgccgtcatgaccaagtcggccacgtcatccagctaacatcgggctggagtctctggatcggggacgacgggcgggtgacgcaagagcgcgcccgcagcctggagcgcgccctggggcgtgccgccatcgccgtagacgaggcggcgacgcgccctgtctcgccgtcctcccccgtcgcccgcgggcggcgaagtcgcggatcgtccgacctccccgagcgcctccccccgcccaggatttcggcgagagggggacggtggggtgcgagcccgacggcgcgggttctgctccccatcgtcaccgctagcgttcggagagaggctgtgcgccactgcccgttcggccattgggctgagcgggcgaagcttggcgcacacgaaagaggacgagggcttagaaagacccgcgcgccccctactggcgcgccagatgatggagcgtggggctcctcaccgggagaccgcgcaggcccccctttgccggttcggccgggggcgctaagtgagtttctttgccctcgatctgaggaacgtcagcgagagaggaaatgcgcaagacacgggcgacgtagacaggttcgggccgctaagaagcgtaacaccctactcctgtgttctggtggatctgtgcgtgaaggaatacaaagaggccgagagcgaaagagagttcaggctctagaaaccattcgccagagtcccccctcccctcctctcttctccctctttttttctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccccgaccagtcgcggaccggataagcgtgcgctgcaccgcattaaatgcggcgtggcgcgctcgtccaatcctgctataaatgcggttaggtgagccccgctgtgctcacctaacccacacgcgtggcgccaaaaccacagggggtcggggcgccccagcactcggggccgaaacgggggcgccccggccctcggggccgaaacgggagcggtccgacccctcggggagacagagggaggggtggccacgtcatcctcgggcccgacccccccgagggggtcaggccacgtgggtgaccgcggcttcccaagcctctagtcacaatacccccggccccatgtcaccgacaacaccgatcacaaaagtcttaagtatatgttcacacagaccgagttatatatgaggcagagaagatggttggaactaatcaaggattacgatcttggaattcattaccatcccggtaaagctaatgcggtcgcggatgcgctaagtcgcaagacctattgcaatgaagctcaaatatggccagaccacggtcgcctgtgcagagaattggagaagttaaggctaaccgtggtacagtcaggtgtccctgccagcttgacagtgcagcctaccctagaatcgcaaatccgggaagctcagaaagatgatgaagggataaaagaattaataaaaagaatacaggagaaggaggacaccgatttctccatagacgatcaaggcacagtttggtgcggtccacgcatctgtgtaccggccaaggagttaagagatctcattctaaaggaagctcatgagtccgcctactccattcatccaggaagtacgaagatgtaccaggatatcaaggcatacttctagtggactggaatgaagcgagaggtcgcagaatacgtagccctgtgtgacatttgccaaagagtcaaggcagagcatcagaggccagctggtctgctgcaacccctaccgattcccgagtggaaatgggaagagatcggaatggatttcatcaccggtttgccaagaacccctagcgggtacgactccatctgggtaatcgtggatcgactcacgaaatcagctcatttcgtgccagtgaaaaccacctttgatggaaagaaactagcagaactctacatgacccatgtcgtatgtagatttggctgtcccaagaagattgtgtcagaccgaggcactcagttcacctcaaggttctggaagcagttgcatgaagctcttggaacagatctaaatttcagtacagcttaccatccgcagaccgatggtcagacagaaagagtaaaccaaatcctagaagacatgctacgtgcgtgtgccctggattttgaaggcacttgggatcgttgtttgccgtatgctgagttctcatacaacaacagttatcaggccagcattcagatgtcgcgaaatgaggcaatgttcggaagaaagtgccgcactcccttgtgctggaatgaggttggcgaagcactggtattcggtcctgacatactcaagacagcagaagaacaagttaagctgatccgagaacgtttaaagacagctcagaaccgtcagaagaattacgctgacaatcggaggtgtgaccttgaattcgaaaaaggagaccacgtgtacctgcaggtatcacctctccgtggtatgaggaggtttgggatgtccggcaagttagcaccccgctacatcggcccctaccccataaccgccggatgtggcgaagtggcttatcagcttgagttacctgaaggtctcgcagatgtgcacaacgtgttccacgtatcccagttaaagaaatgtcttcgagttccagaagaacaagttccccttggtaatatcgagctggaaaagaatctgacctacaaggaaagaccgatcaaggttcttgaagaggctgaacgtcagactcgaaggaagactatcaagttctacaaggtccaatggaccaatcattctgaagatgaggcaacctgggaacgagaagatcttctccgcgccgagtttccggagctgctcccttaggtgctgaatctcggggtcgagattcttgttaggggggttggtctgtagcgcccgttccgtcgtggcgcctagcgggaaaatgtaattcctaaaaaccctaatttcgaaatatgtttccttgcttattgtctagtgtccgtgccattccggatctcaaatccccgatcgatcgtcaagttcatcctgaatccaatccttcccaa

SEQ ID NO: 18112 - DNA, 7797 bp, Oryza sativa
tgtgccggaggagccagtgcgcgctaggacgcggaaggggactccgggcgctcgtcttcttcctcttccccggcccgaggccggagagatcactcccgtgccgtcggcctctcgtcactgcgccccatcacccccgcacggtagtgcctcccttcgttctccctcctcgttccatctcctccccttagactcgggtagtagcacgagtagcctccccgtagctagctggcgccgccccgaccgttgctgccgctcgccgtgtgctcgccgccatcgccgcccgtgctccgtagcacccgctcgttgccggcctcgctcggcgtagctccgcccaatccgacgctagcaacgaactcccggagtcgcgtagatgctctagctcgcccgaatcggtctcccgtcgtgccgtcgccgtttcccccttctctcgccaccggttgccgccaccacaatccgccgccgtcgagcatcccccggcaaatccgagtcgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcagccacataggcgccacgtcggcgccagctcggctaagaccgggtcgagctgacccggccagctgctccctccgttccccccgtgcgcatggtccgcggtgagccatgaggctgcgcgtgggcccgccgtatccgcgtcctcctcgaaccgcgcgcatgcgccgcgcctcccctccccaaaccctagcacgccccgcgtgcacctcgctcacggtgagccgagtcgccgacaagcgggtcccacccgggaccacgcgggatggacccggcccaccggctctctctctctcctccccgcccgcgcgcgcgctttgggccgccttcttgggccggccggcccattaagctcggccgagccgcccctttctctcgggccgcgccctagccgcccgaggaaagtataatttccctcccttcttcttttcttttcttttcttttccaaaaaggatttaaataaatccttttcctttagaccaaaaatccaataatcttataaattcaatatcttctcaaccgtaagtccgtttgactccgttcaacttctaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaagtatgttgcttgaaaaatattatgcattgataggattgcacttaatctacatgtctcgtctgcaaggcagattggcggacctacctaacttgttgcagttgacccctccattgtaattattataccatgttcccttgtaaccacctagttgcgcctcggtaatcgtgcactctgcacgaatatcgacggtcgccttcaaacttaaaatctgagaaacatcttgggtaaaacttgggttttacaaaacacttggaaaacccgacacctgggtcggtgcttgcgaacctaaatgaatttccaaattcgcggaccggggaacgtaccgggtgtacggttccccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggacccctctcgttggcatatggtgaacctgtgtcggctttcgaaatgccttgtcgtgaaagccttaaggtctctagtcgtggccgttctgcacgggctggatgatccgggttagtaatgtcgtgtgggtaaagtgtacccccctctgcagaggttattaaactattcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagtcgttggccgggtgccaaccttgaccaattcaaaagactgataccttgcacatactccgaccgggcgagacgcactgtctcatccgtgtcgtttgagaagatctcacttagttgtttcagaaaagagtttaaataaaatcaattgcaaaaacaacagcctttccttgaagcctgcattaaacacttatttcccatggcttgctgagtacttctgtactcatccttgccctatataaataatccccccagttgctgaagaagatgaagcggatcccgctgacgaggagttcttccaggagcaagccggctacgatgagttttagggtttcagcctagttcctaagtcgcgcctgtgatgtatggtccaagtcttggcttccgtttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtcccgctcggggctagttcggggcgtgacaagagatggtatcagagcccaggcttggccctagggcgaaacccgacgtttaggacgaccctaaggatactaagttcaaaactacttgcgaaaagctaaggcttttttttttggtttctttattttcaatagtttgttgctaaaatggttactgatcttttctccctctttcaaaattgtagatggtagtgaacgccagcttcagttcccacggttttggtgagggtcaccacgtcgctcagcttcgtgacctcgcccgcttccttggcttttcgtgtcccgagtacacggggtactccgtggaccatgttccccctcgctgtgagctctctgtgtacctttaccctcgtggaggtatacacggagctggtcttcgcccacaccacttcactgtggctaggcccactctccagatcgcgtaccaggacctctcctggactgcgcttcgtcgcttcgcccacgactacagccaccgtctcgggggctctgccttccggcagcttccacgccttccttctagccacgcagacgccaggtacccttgtccgtacaacgagtctcggctagtgctgactcgcatggttgagctttcggaggctcaggccactcagcacgacctactcctcgaggcttaccgctcccttgcccgccgctacgccgctctggaggcccgtctggccgaggagggagtcacctcagttgacactgtctcttgggactcaggccgcctctgccacgccagccacctatcctcccacagctctcgcggctctgcccgcactcccagtggcccgcgctcccccagcttgcgtgcgccgtactcaccagtgtactccccctacccacacccagttagcccctcctacacccccggacacactcccgttgcttcctcccgccgtggcccacgctttatccgcactgcgcggaagcgtgttgttggttcttccaccgtgttccgcttcgactacccagctcccccaccgccagcggcccgtgctgctgacggctctcgacaggttccgctggtcccttcgcgtcagccgatcgacgtttcttcgactgaggagccgactacaggaggcagccaggcagacgaggagtagaggaggcagtcttcagcagccgtccgtgtgttaggcccttttgttccaccgccaactcctttggagtcatggcgaggtagtgcatgcgtgcgtttgatgtgggtgttgtttggtagtctggttctcctaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctctcctgggagtttagatggctagccgcccccgccgtgctgctcgtgcaccagcccgctttggttttgaggaaggtagagttgagccaggagcaaatcatgagtcagctaatgagcaatctcaccacagcaaccgttcgcaccgtactgcttcccgcaatgcagaagttgagcaaccccgccgcagcaaccgctcgcatcacacagcttcccgtaatgcagagatggaacagtctcaccgctctcaccacgctgccggtcacaattctggagaggaacgcatcccttccccgcctcatgtggaaaacaacatgcaacacttgatggcagttcagacacagatcttgcaaggattagccgcggccatagccggctttcagcataatgcgtatggaaatggccaccctcacatgggcaacaatagatccaaactgacagacttcctgaggtctcgaccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactacaatgcacaccctgaacccactaacattgcttgtgatgagtttgctacggctttccgtgcagctcatgtgcctgaaagcaccattgatatgaagaaagaggaatttaacaggcttaagcaaggcaacaacagtgtcaatgagtacctaagtcagttcaacaagttggctcggtatgcccctgaggaagtggacacagacaagaagaagatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtctaaccatcaggggaattcttcccgaggcgcaccacgccctcgctatggtcaacccatgcaatatcaccaattggtcactcaggctaaccgccagccaggctacgcccctcgtccttagatgaaccgtccggcacctcagccacagcagcatgccccaagtggcaacactgcgccaaacagtgttacctctttcaagtcaccgctaggactatcagcagttcagtgtttctggtgcaaccagatgggtcactatgccagacagtgccctcagaatcctaccaacaccaactcagggcatgctaatggtagcactgccagaactcctactctagcggcagctcagtctcgtcctagctctcaggcaagtggacaaggttctcgtgcttccaacaactttggtcgaggccgggtgaaccacattcaagccgagaccgctcaggatgctccagacgttgtgatgggtatgttctctgtcaactccgtacccgcaatagttctgttcgattcaggagctttccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaggtccatcaccttgcaaggacctggaggaaagcaagtccgctttacctctaacacccctaccgcaagtcggtctatcctaacctgtttacaagtcacctccttggagtcggtgcccatagtctgcgattatcccgacgtatttccagaagaattagcgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgctcctggttaagaaaaaagatggctctgagagaatggtaatcgactatagagccctgaatgaagtaactataaagaacaagtacccgttgccacgaattgacgatttgttcgatcaacttaaaggagcaagagttttctctaaaattgacttgagatcaggttaccacaaattaaaaatcagatatgaagatatcccgaagaccgctttctcaacacgttatggtctatatgagttcacagtgatgtccttcggactcaccaatgctccagcgttcttcatgaacttaatgaacaaaatcttcatggaatacctagaccagtttgtcgtggtattcatcgatgacatcctgatatactccaagaatgaggaagaacatgctgaacacctgaggctgataatgggaaagctcaaggatcatcaactattcgctaagttctcgaaatgcgaattctggttggaccgagtagcatttctgggacacgtgatctcctccaacggtgtcgaagtagatcccagcaaggttgaagctgtacttgcttggaacccgcccaagaatgtgtcagagatccgcagcttccttggcttagctggatattatcgaagattcattgagggattctctaagctagccagacatatgactgagctgttaatgaaggaaaagaaatttgaatggtcagcagcctgtgaagacggctttcaagaaatgaagaataggttgaccactgccccagttctcaccttgccagatatccgaaaagattttgagatcttctgtgatgcatcaagacaaggcttaggatgtgtcctaatgcaagaacgaaaggttgtggcctacgcatccaggcagctcaggcctcatgaagtcaactatctcacccatgatctcgagttggcagccgtggttcatgctcttaagatctggaggcactatttaatcgggaacagatgtgaagtatacacctgacggagggtggggctcctcaccgggagaccgcgcaggcccccctttgccggttcggccgggggtgctaagtgagtttcttcgccctcgatctgaggaacgtcagcgagagaggaaatgcgcaagacacgggcgacgtagacaggttcgggccgctgagaagcgtaacaccctactcctgtgttctggtggatctgtgcgtgaaggaatacaaagaggccgagagcgaaagagagttcaggctctagaaaccattcgccagagtcccccctcccctcctctcttctccctctttttttctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgctgaagcc

SEQ ID NO: 18113 - DNA, 1837 bp, Oryza sativa
cggttaggtgagccccgctgtgctcacctaacccacacgcgtggcgccaaaaccacagggggtcggggcgccccagccctcggggccgaaacaggggcgccccagccctcggggccgaaacgggagcggtccgacccctcggggagacagagggaggggtggccacgtcatcctcgggcccgacccccccgagggggtcaggccacgtgggtgaccgcggctacccaagcctctagtcacgatacccccggccccatgtcaccgacagtagcccctggcgttacgccagggtgatcgcccccctcgagggaagcgctcgggcgtgacgccactccttaggcccggtgacaggtggggccggtccctacaggcgggcagaaactcagcggtcgcaaatcgcgcgcatcggcaagggaaaaccgatcgacagtaatgagcggcctctttaagaccgctacattactcgagcagcgcgcgaatcgggacgagccggttcatttcgcctggagacatgatgatggcgcttttcacggttggcaagcgtagttaacgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgctgaggaagggattcgtttctttcctctcgccactcttcccttgccttcgccacttgtgctctaactcttcgtttcctgtgccctaccctcgccgcactcgcttgttctcaagctcctcctccgccagcgtcatggcacggggctccgcaccgctcgatggtagcgtgctgccgccttcccgcatcgtgagcgagaggcaggccgggctgccgcaccgattcatgccggaatctgccaccggccgagaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacgcccaacgcgataatgacgttggccatcttcgcacacctgtgcgagatgtttatcggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcagggctccagctggcgggcgacggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaatagggctgcaggaatt

SEQ ID NO: 18114 - DNA, 686 bp, Oryza sativa
attcctgcagcccaggccgggaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagccc

SEQ ID NO: 18115 - DNA, 1741 bp, Oryza sativa
  unsure (1)..(1741): unsure at all n locations
aaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaataagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaagaanataaagatatctttattcatacaaaaatcataaaatattacaccaaataattcttaaaaactatttgtaaagttttaagtaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttc

SEQ ID NO: 18116 - DNA, 10898 bp, Oryza sativa
cagtgacccgagtactatattagcaagctgatcacataactgctacatgcatgatgatactacatacatgcactgattaacacatactagtaacctttgagataatttatttttatttatttgattgtcattttgattatatggttgtattcgttataattaaatctttacaacaagatctcagaaggttatattttgattgaaaaattatatatgttttaatcgttaagatttaatgtttcacgtgttagaaataaatgttccatctagaatttgattatgttgcacattttaagttttttatctgatagatgttgttttactgttgcacacgggatcaataaatatattatgatgtttcattacttatttgtggatgttgcacatcgtattatttgaatgtttcatcaagtatattgtgtgcaacagttacaaaaaattagtgaaacataagaaaatatctattaaaacatctaaataatactgtgatcgacattttgttgcaacggtaaacttaaaatttgtaatacaaagtgaaattccatttgaaacgtttatttctcacacatgaaaatctaattgcacatgctgaaaaacacacacacacacacattatttttttcatcggatcatgtgagatcttattacggtgatcttcctataacatagaaaaacaccacatgcaatattacaaataagtatctgaaacatcaaccaatatttattgaaacattccaataacaccgtgtgcaacactaaaaaggtcatcagaatacaatgatgtgggatattgttccgaagatttgattataatgaatccaactacataatttattcatagtttggataaataggtggaggaaagaaacatttgaattctccaccattatgaacagttttactaaatctgagtgcatgcacggatgcacctacaccaattgatgtgtacgttcgatttcttccttccacctggatggctgatgtgaagcatttttccgattttgttaacacagtaagtaggagtactccattggaacatgacgcataatactactctacttaatccgtaatatgcggaccatatatatacatatgcctatactatactccctccgttaaaaaaaagccaacctctctcgtaggttagcttttgtttttttacggaggaagtgcatatgtagagtgggtatgcaacagggtttatgttaccgtcggtaaccgcgcggttaccgcttttaccatgggggtatggtaatagaaaataccgcggtaatctcctttaattcaaataaatttaaaaaataatttaaatttttaataaattttacacggttatcacgtgctgcgcggtaaccctagcccggcggtttggaaaacctggtatgaacaagccgtgacgacgtgagtgaagcgtggcgtggattggataagggaggagaaacaataactccctcctcctcctcctcctgctcctagtactagtagagcagcggcggcaatggcggcgcctcctctgctgagcctgagccagcggctactcttcctctccctctccctccccaagccacagctcgcccccaacccctcctctttctcccccacgcgcgccgcctccaccgccccgccacctccggaaggggcgggccccgccgcgccatcccgcggggaccgcttcctcggcacccagctcgcggccgaggccgccgcccgcgtcctcgctccggaggacgccgagaggcgccgccgccgccgggagaagcgcaaggccctcgcgcggaagccctccgccgccgcctgctacggctgcggcgcgccgctgcagacggccgacgaggccgcgcccggctacgtccaccccgccacctacgacctggtagtactattaattcttccttctccacccacccatgacatgattactactcctacgtagtaagtaataatatgcatatgaatgcatgcgatgcgagcagaagaagagacaccatcagctgagaaccgtgctatgtgggagatgcaagctcttgtctcatggccacatgatcactgctgttggtggccatggcggctatcctggagggaagcagttcgtttccgcggaccaactcagggacaagctctcctaccttcgtcatgagaaagctttgattatcaagctggtaaatcacaacatgccctgccctgccctctaatgtaatcaaacgcaatggctgatgcaaatccttcacatcttctatgcgtctgcctcttgccgctcattctcgctgtttacatgcaggttgacatagttgacttcaatgggagcttcctggcgcgtgtgcgcgattttgctggtgctaatcctattatactagtcatcacaaaggtgattcttctacatactgcatgcatattcgtgtttcaggattaaaagctcattcttttgtaattgtaggttgatctccttcctagagatacagatttgaattgcattggcgactgggttgttgaggcagttgtcaagaagaagctcaagtaaaacttcttcgcccctctttctgttccagtaactattgcatcaggttttccatttcattaattggaaattaagcgtgcttcttggcatctgtagcgtacttagtgtccatttgacaagctcaaagtcactcgttggcgtcactggggttatatcagagattcagcaggaaaagaaggtcagcatgcaatctgtatttgttttcccagttatattgtgctaacctgtccccctgtaagccttttccaacacttgccttgcacaattgaatggtagtttttattgtgtcatatgtacacttatttcttcacttccttggctgttatacatttcataatactgatcataatgttgttcttcctttcttgttagggccgagatgtatatatactggtaagcaataagcactctccatctccttttttcaattatttatgaactcttgtgctacagattttacaggcataccattgtatttttgtatggcaaaacactaagcttgctgccatttgtacaaacctaacaagctgcattcatatatcaacaaatgttgatagcttgatgcttataatgttctattgatacctgatcattatgttagtaatattatggaaagattcagaattggatgttacccactaactaacatacatagacccatcttcaggttctctccttcatttttcattatttacacagaatgattgaaccttgcaattcataatgcttcaaataacatgagtaatttatttatgcctaatgaatctagtacaccattacagggttcagcaaatgttgggaaatctgcatttataagtgctatgctaagtatgttcttaccattcttgactactattgctgtctccctttttcaacctattacttgttttgttcgctcattctgttctttgttacactaatagttagagaccataatttgtagggacgatggcatataaggatccagtggcagctgcagctcaaaaatacaagccgatacaatctgctgttcctggaacgacccttggtcctattcaaattgaagcatttttaggaggcggggtacggttccatcttttactctgtacactttagttttaagatatataatatgccaaattttcttgttgacctgctgtaccaactttatctatgtagctagagaatgaacttaaatgttgtcttatatattgctaacatgcccaaccaattattatacttctctgacacatgaaggactataataatcttgaatacatgcagaaattatatgatacacctggagtccatcttcaccaccggcaagcagcagttatccatgctgatgatctgccttctcttgcaccacaaagtcgtctaagggcacggtgttttcctgtatgtatttgtattcagtggcacacatgtttctttctcaaaacatgcacactaatcttttcttcagaatataatgttgtgttcaggctaatgatacagatgttggattgagtgggaattcattattctggggtggactagtccgtattgatgttgtcaaggtgcctagttgagcccaatttcaattccaaaaattttctaccacttctatttttttccattctgtagtacttaccactgattattaatcaatcaatcaatcaatctaggctcttccacgcacacgactgacgttctatggacccaagaagctaaagattaatatggtcccaaccacagaagcagatgaattttatgaggtacacctgtgtttgctaatcagacaacagtatgcagctaatcatttgttgctaggttgagctacttagaaagcatcaagctactggcatactgttttgttctcaaagttctatcaaatttagattagtatttgcaacccacatacatacctcttcctttaaatatatatgctcatataacttccatgccttccacaccgatgctcacttgaaatctctatggatggtataataactgcatctatttgccatagttcatgctttctatatttctgttcatctaagaaaactgaagaccataacatgtaaaatagccgctaattaaaccagcttctgttctatgtgctatgtgaatcaggtaaataataatagtatgtgttctgctgatcagggtggggttcgaaatggcttttttatttaacgagttgtctatttcacctttccagagagaagttggagttacattgactcccccagctggcaaagagaaggctgaaggatgggttggtctgcagggtgttcgtgagttgcagataaaatacgaagagtctgataggtaactccttgcaagatgcaagatggcttcaattattcatctagcatgcagtaccagggggctttaggatcagacaattagtggttgagtaattcagatctcatgtttcatgaagaatatggtgtgtgttctctccaagcatctgctttcatatgttactgacatttgaggatatgtttgttgtgcagacctgcttgtgacattgcaatttctggtctcgggtgggttgcggttgagccacttggtgtgccatcaagcaacccagatgagagtgctgaggaagaagacaatgagagtggtgaactgcatttgagagtacatgttcccaagcctgttgagatctttgtccgacctccattgcctgttggtaaagcagcatcgcaatggtacagataccaggagttgaccgaggaagaagaggagttgagacctaaatggcattactgatgcttatagctattttagttacgatgacagcatcgtgtagtccaaatagagcacgtaattatatatgttctcagatgatgtgatagggatgacagttttagcatcagctgattaaaattactccaataatgattcaggaaggaattttggataaagacatcgacaagtgaagctcttgcgggtactctctgtttctaagatcttcgtcctagcacatataccatcacatcatttttcctttgcaacactatgtgtgacgcactgacgcttaaagcgaatgccgtaatgaatacttgaatatagttaagaggcaacaattttttttttcagatctgaatctaaaaccaaccaaacacttttcaacgggtctccaactccaacgagagctatcttccaccagagttaaagtttggagccctaccaaacgggccttcatattcggccaatgccttctatatatgttctagcttagcattcgcaacgtgtatactcaactgtcaactttgtggagctatatatagaatttatttagcaaaagaaaagaaaaaggaagaaaaaagccctacccagaaaacgtgtatccaaaatacgttttcaaagttagaaagcgcattaaaagcactacgcaaaagttcttggtagattttggttcggcccattggatcttccgactcacacgcaccaccatgaccgacgggccctcgaccaccggcgattcgccgccgccgccgccgccggagagcggcggctccatctcctccatggttgcctcctctgccgcctccgctgcggccgcggccgcggatttcactcgccgtggcgaggccttcggcgccgatatggcctccgcagctagggctgccatggacaccgccatcgcccactctcagtcaaccgccatcgccgccgcagaagctgcctcctcggccaaggccgacgccctcgccgccttccccagcctcacgctcaacgcaaaggtgccaccttcttgccccccattccccactcgctccgatctcagcaaatttgctaaagctcgatttcttttggccttttcccccctctaatctctaatgttaggaggagttcgaatggttaaagaaggagtacacggttcacgagcaggtggtgttcggcaagatcaaaggtgcattttcctgttacttccgtaactcaaaatccagaaatttacagattgatttgtattgttggcctgttttattatgtataacaattgaatttcgattgcttatagatcgtgttgtctaacatggttctgttcttttgatgttcgatcaattattgactttcagttaccgtgtttgcagagggtgccatcatggccatcgagcatccgggaattgctgcaggctccacagcaattgctggaattgtgctcttcaaaagtaaataccatctcctgaaagtcatttctttggtggcttacttcttgtttgttacattcacaaaagaatacctgcttctgtaatgctttacacatgatacactttagatgatatgaagagggtacctgtcagtaccatatgttaaaaatacattgaatccttttatgtaacacaagttagaatgttggagcaaagtgttccttaatattttttgtaacaacaaagatacgctattggaagtgatttcttatcatgctacttatagttgactgaaatgtactgagaccttcttgagctaattaattagatccaacttagaaatcacaagcagattcagttcaacctgtcttattataatcatcacattattctgattaattggatttcattaattctataagagtgttgtgaaattcactttcaaattatcagcctgtacatgcagagctagttgcctagcatctgatgagacaaggatgttgatgcaagtttggtctgtgattgtttcaagaatctaaaatgttcggccttttcttatatatcactaactttagtgtgactaaattcgttgcagggccaaggagctacctgatccaacgggtgcgacgcatatttgtaagcaaggaggtacgcactgactgcctgtctagctataacatttctatgaattcttgacattgctacttgctacctgcctacctccatgtctcgaaagttgcatacaccatcttgtttacagattgtcacctccttactacttgctgactagcttcacagttcgaacctatcagatgtaatgctttagtgctcattattactgtcatggacatgttgtgatacaattctttgttctgaaacagagcgaaacacaaattcgtctaaaactagcatacatttttttaatgaaattcatgcatgctacctacattcatgaaaaaaaaatacagggttgattttctttagaatgaatacaacctatgttgattgtatttcataagtttccaaattgcagaccctactttctggcatccaagctggcgtgaatcacatgagacaaactgtcaatcttgtgtccaatgaaagccaaaagttgctggtatatttctttattttgttgaaaactgaaccatctgttgtcaaattggccatttaagttcaaacattcttcatgtctgattttgtgtatgcattccaggatagagcagcaactgctgaaaaaagatttcagaaaggatggaacacactcaggcaagcctattttttaaagccttttaccatttatttttgtcttcccttctctaatacagcattggatttgctgtctacttgtttcagggaagaagggcgtgccattcaaagtgagctgaaccaaataagtgatattgagaagcaagcagtaggtgtgtaataatttcttgcgctattgccttttcctatgtcaatttgaattttagagcggaaattgcctcatcttgaatttgacatataatgagttgtgtcctataggtctcaagagcattctcaatcagcttcccagagcacatgcatctgagtttcaatcagaggtcagtatattttctggtatctgaacactatgatgtttactgaaacgattaggtgatgttgaagctgtcactgcaatttgtttttttcccatgttgtgcaaatctgttggctaatttctttgccaaaaggagagggtatagaagttttattcagtcaatgtcggcatcgattttataagtagtgtgcagaaattatttttcatggtttcatatctcataattgcagcattacattattttatcacaaaccagttttacactaaagataagatagtattttgaagatgggagttctgtaatgttaatttatagcaagcttatttttttaattgcagatatctggcctagcctctcaggtgaagaaggagaagagagtacttaacaacaccctcacgaagattgcgaactatggtgtccctatctgactgtcgaaacgcagcttcatttgctgtagtttttatcaatgaagagattctgaagacatgggtgaatcttttactttatactacttgtccgcggaggggaaaggaaataatacgttttatcagtcttggcgagatgtaaatttgccgctggtgctgcagcagcaacataacatttttgtagtgttttgcatcatatgggcattctctgttgcattgtccatgaagtgaaatggacatactgcgtcgaccttccctgcaattaatcaaattatgttttttttttaagtgtgatgggtgcgagactttatgtgcttcagagcgttaaagtggattcaagaaaactttttttctttatcaaatctgatgaagtggttacaattcttcagtactgtataacggatatgcttatgatactattatggctggaaatagaggattgatagggaagatcgccctcaagtcgccggcttctccggaagacggaggctctgatctgattgacttagtgggcaaggcccttaatatctttattgcttagtccttaatacaatagcaggccccctttatatactaggtgccaatctaatatttaggaaatctaagacaaactaggaataggaaacataatcctaaaccaactagaattagatatatctactgattattcctattcctattcctatacctatggtatttgattccataacgccggtctataacatttccctcctcctcatgaaacagctcgtcctcgagctggaaactgggataagcttcgcgaaaatggtccagcgtttcccagctagcctcctctggagatgaacctacccattgtatgataacttcttgaattccttgattccacctagctttgatagcagcagctggtgcagggataacctggccatgaacaatgtcaggaacctgaacaatatctgttggggccacaccttcaattttttttagtaaagccacatgaaaaacattgtgaataagagctcgaggaggaagcttgaggcgataagcagcatgaccaattctctcctcaattaaacaagggccataaaatcttggggcaagtttagagtgtgcttggtctgtaataccagctgccatgcgatggtgtaaccgtagccatgcctattcaccaacctcaaattcaatgtcgcgatgagatttatcataccaactcttcatatagtcctgagcttgaagaagtctctctcgaatttcaaccaaaaatccatttcgactcctcatctatttgtccacagccacaacacaggaagaccctggctggtaagcagaaatagtaggaggatctcgaccatacacaaccttgaaaggtgtctcacgaagggaagtttgataggaagagttatagcaaaactcagcccatggaagccactgtaaccaattctttggatgatctcccgaaaggcaacgaagatacatagtgatgatgcgattaaccacctcagattgaccatcagtttgcggatggaaggctgtgctcatatttaactttgtattagtgaagcgaaatagttccttccaaaatgtgctagtaaaaactagatctctatcactcacaatagaacaagaaataccgtgcaagcggacgatatcatcataaaatgcctttgcgactgagagagccgtgtatggatgtcctaaagcaataaagtgggcatacttagaaaaacaatcaaccaccgtcaaaatgactgacttccctcgaacacgaggaagaccctcaatgaaatccattgaaatatcctcccaaacagcagaaggaactactaaaggttgcagtaagcctgcaggatgtcgatgttcagtcttgttttgttgacataccgagtagctcttaacataatccttcactaatgaactggcatgaggattgtaaaatgatgcacgtaggcgatggagagtcttctgaattccctcatgtcccatcccgtgcgcatcagccaagagcaagggccaacatgcagaagctgtaggaacataaatcttgccctcaaaggtgaccaaaccatccactaaagaccaacctgtcgtaagtaaaccagcctgaatctgatcccttttggtaatgagttctagcagtgtgttggtctcttgtcgcaataaatcaaatatttcaaaagatgggccagaaatagcgtgtaattctgctgattcttcacgacgagataaagcatcagcagctccattgtgttttcctggccggaactcaact

SEQ ID NO: 18117 - DNA, 83863 bp, Oryza sativa
  unsure (1)..(83863): unsure at all n locations
tcctgctccgtggtgtaaaacagcaccaaaacccacaccagaggcatcacaatcaataataaatcgtttagtaaaatccagaagttgtagcaaggaagcagatactaaggccttctttagcgctagaaaagcaccatgggcctcagaggaccatgtgaacccttccttcttcagaagcttggtaagaggagatgctatggcaccatagccatcaatgaactttcggtagtaaccagtgaggcctaagaatccacgaagagcgcgcacagtgcgaggttgaggccactccgcaacagcctctaccttgctaggatccatggccaccccacttgcagaaacaatgtgtccgagataagtcaccttttcttcaccaaagagacacttggatcatttaagcaccatttggtgttcttgtaacaccaacaaaactgctctaacatgttgaagatgttctgcccaagaagaactatatatcaaaatgtcatcaaaaaatacaaggacaaaccgtcgtaggaagggagccaatatgtcattcattaaggcctgaaacgttgctggagcgttagttaatccaaaggccatcaccaagaattcataatggccatggtgggttcggaaagccgtttttttgacgtcatcaggatgcatgcgaacttgatgataaccactacgcaaatccagtttggtgaagaagcgagcccctttgagctcatcaagaagatcatccaccaccggaattggatatttgttctttatcgttttgctattaagggctcggtaatccacacaaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaaccttgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactccctccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttattattgtacctgctctatgtgtggaccttgaacatcaaacaatcagatctcgataggctattatacttaaatatagatataatattgagccgtacatttcgatgcctatgtatatgctactatcttcgtcccaaaatataacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagttggtttttaagttcgttttattttgaaaatacatatccgtatttgagtcagtttttaggtccattcgctttcgaaaatatagaatgagttgtataagaaatctcttaaaaaaactcgcatactaacttgaggcgatcggaatcctaaattcataattgaagctcatgattttctaaaaaagggcttgtttggtacagctccaactcctaaatataactccaggagttgagtctggagtggagttgtggagctgccaaaacccagctcctcaactctagtacattttgtgagagagctccacccaactccactcccaattttggtggaactgaaactgattggctgagctccagctccaggaggggtgaagctggagctagagctgtgccaaacagacccaaagtatatatccaaacaaatttctacagtgaattttatcttaactaaactgtataacaataataagattaaagtaactttcacccgtttgcaacgcacgggcatttttagtggaaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacaacaaaagaagaagaagagaaaaggatggcgatggcgatgcgacgtcgggtgtcgtcgtgagcgcagccctccctcgcgatccacctaccccgccgccggtaagcctccacctccgccattcctccccccacccaaaccctagatccacaccctcctctccgcccccgagatctcctcgatcccgtccgcgattccacgccgacatggctgaccccttcgtcgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttcgactccacagatcccaagtatttggagagcatttatcctgggtggaaatacgacgaggcgacacagcagtggtaccaagttgacaattctgatacgcacggtaacgccacccaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaacaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagagccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatggagagcatgtacggaagccataatcaagctcatacaaacccccaagtgcctttgtcaaacagttatctcagtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgtggacaacctgcagatgtttttaatgcagacaacaacatcagtagcaattatggttctcaacagcctatggaggtaatacataattatttttcactttctagatgcgcgatactttggtcgtaggattattctgtagttagatgtaatagtaataattgttcttaacttttcatagcacttgcctgtcccatattgttgtacaataatggcttttcatttctttgttactgcagtgtcatggtgctttggttttttttttcttgaagaaaatgttttgcttcattgataatgcattctactgttctaccacctcgttgttggctttctgtttaaatagtggctcactttataattcattgttttgtcacacagcctagtcctaatggcatgttggatgactgggaggagaatttggctatcataactgcaaataggacaaaaggtgacgacctagttattacccatcttggagattgcctttggaaagagaaaaatgaggtctgtatgatatgtatttgcagaattaaaccctttcttttttgtggtcaagtaccttatatgccttttgatacaggttgcagctgctcattcgtgctatttagttgctgagttaaatattgacccttactctgaaagtgcaaggttatgtctccttggtgcagaccaccttaagtgccctcgaacttttgccagccctgaagccattcaggtatattactgctagccattaacccattacctgtaaatatattgaatcttagtgcaattttccctcgaagctctatcttttgctttttaatgattagttaatgcaagcatactgtctcagtgttttataagcaattattgcatagatacatagactggaaatgcaagattgtgtgtaaccgctaacctgttgcttcatctttttttactctgctgtccactgttctgaactaatattttgaaatgcgataacagaggacagagatttatgaatatgcgaaggtgcttggtaattctcaatatatcctgctaccctttcagccatataagctgatatatgcatacatgcttgcggaagtgggaagggttgctgattctttgaggtatgttgttgatttgtgcatggccagcaaatgatttcaatgctatacctaaactcctgctttcacattatgacccatttgaatctccttaaaggtactgtcaagcatctatgaaggtgctgaaagcctctggccgtgccccagaattggaagcatggaagcaattattttccaccctggaggacaggatacgcactcaccagcaggtaaatccttacagcttgttttgcaatgtagctgagttcctccctctccctattaatgcacttgtgttgattgctattgtttagggtggatatggcacaaaccttgcccctgcaaaattagttggaaagattttcacctcactcgataaatctatatcgcgcatgatgggtacaccttctgctccacttccgccattgccacagggtgctgttagtgatagggagagttacactgcacctggggctacaaagtttgcaaatagccaatcagtaatgaccatgtcatcgttaatgccatctgcatcagtgcagtctatgagtgagatgtcagatagtggcaggaagattgcacacaacagaagtgtttctgaaccggacttcggcagaaccccgaaacaggtaattatgccctcggctgaggtagacacttataaagacagcaggttctgattagtgaatgccgagtgataaaattctaattcttccgtttgtttgaaaaataacagggtgctggatcggacagcacacagagtactgctccaggatctggtagttcacgctttggttggttaggctccacactacagaagacaatgggatttgtttcaaaatcccaccggcaggtactttaactgagctattgaattggagccactccacttttgttcagtttctcttccatatagtaaagctaatactgagatccttcctatgtcttgaaggctaaattagggcaacaaaacaagttttactatgacgaaaagctaaagcgatgggtggaggaaggtgctgagattcctgccgaggagcctcctctccctccacctccatcaaaaccctcattccagaatggtgtggtagactataaattaaatggccccatgagtgcaagtcatactcccaatggattcatggaagggaaatcttcaacttcttcagagcatggttcgggaatgccaccaattccgccaagccagaaccagttttctgcccgtggacggatgggtgtccggtccaggtaatctaataattctgccacttgctcatgtctttctctatattctataaaatattgaccagaggaaagttatgtttatttttagatatgtggacacattcaacaagggtggaggaggaggagcagtcccatcctataacaagccagctgttgcatctgtgacaccacccagtggtgccaaattctttgtgcccactgcggctgttgttgctgcagagcagatgcctaaccaaacagcggaaacacatggtgaaaccttccgtccagatgagcgttcatccccagctgaaacgtcattttcttcacccccaccagcaacacaattttcagcaccactgatggtgcctaccattcagcggtatccgagcatggataacatcactaccccgaacaatggatccggattatcatcgggaagtaacagcagctcattctcaagatcacgagcagcatcgtggagtggaacttactctgaacaaattaatgctgtggcaggtgctagatctcctgaccagcagaccatgccatcgcccctcatgcctgggaagcagtcacatagtcgttccaacagcaactcatctgttcagttcaacagtttgacagaggatcttcatgaggttgagctctgatatgctgcgactgctcagtatgacccatgattttatagaaacaacctgggtaaaataccttgatcctctcagcaaaccccctagaggagggagggagggagggagggaaaaagagaggaaatgttttacagtaaatgaagggaatgccacaagtgaaatggatatctcctgtcttgcacaaagttgtgggatggggaagtaaagcaaggtgtgcccgccctgtactcgtacaaacagttgtttttttgggagattttgtaggtattgttggttattatgggtttagagaaggggataaagagtcggatgtccttttttacatgtgagaagcagagagcatgtggacaccattgtacagataatccaccccagcccagccccagccctgcccccatattataattcattgaagacgcagagaattgggaattcatccgccccacatccttttttgtcattgtattattatcattttttttcttcataattttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccagagggtttttttttataggaggaggacgcttgtaaatctgcttgataagatagaaaaatctaggccacccttataccagtattttgggggttttttttataggaggaggacacttgtaaatctgcttgataagatagaaaaatctagaccacccttataccagtattttgcgggtagcctttcctcagtaaaaataataatatattttcaaagggcaaaagggctccgtctgacatgaacaccctcttttttaggctgctattagacggagccaacagtcatctgccagataaaaaaaaaagtcctctcaaagtgcatgaggcgtctagatctgtaaatttacaaaacgaatttttaaaatattaaatgaaagaaattaaaaattagaaaaaaaatggtgaggtgaggaggtaggcaagtcaagtcgaaaaacatgatgatgacgactgctaattcggcccaacaagtagtcccctcccctccctcgacgagagaagacaagacaagtcgcgacctgacgacccgaccttcctcttctctcccgctgccctccgccgccgacccgcaggggatcgtggggacgatcgatcgaggaggagagacccaaaccctagccacccaggcgccactcccattgcccccttcgccagccagccatgtctgcggcgcacctcctccgccactcccgcaaggttccttcctctccctctcccctctcctccatctcttgtttaattctccgcagcattctctcatcccaacaccgaacgcatcttgttccgatctgtcgtgcttatgccattccaggtcgatcggaacatcaccagattcccttcagattcccaatctaatattcctactgcagatggctcacattccaatctacggctctcacttttgtactgcagctgcggactctacgtgatgctctagattatgatcggtctgctcttgtacgctacttctccgctgcttctgcatcctttcccacaaagggaggtgctgctgctggtatgtgctgtactagtagcctttttctctttttctcaattgatttactggagtatatgcatgcaatctgtttgtttgtttgtttgtttgttcaaccaatctggagatgccctttcacattactaattttctgtgctcattatttatttctcttgtttaattgtatcttctgtttgtaatctatgtaattctgctgcggctgtggtcactgcttataagtcctgcattgtcatcatcgttcaaactgatgtggtgctttgcactctcacttcaatttaatcagaatacaacttttgtatcttgtatcagttatcctggatcctccagaggtgcttcttcttttgcacctacatattatcagtttcacaagaatatggggcattcatcaattatgtattctggactgtaatctaattaatataggcaaattatcaattgtttacactaaaatctgtacaaacaaactattttaacacaagcacaatgctttctcatcttttttacctctccactccgttattttccgtaccttcgaccaaacatgttttggcttcctgagccaatatcatcatttttatttattaaggtgtcatttgccgttgacttagtttaactacgctcatatcctccagtgcagacagcagctatttttgtcacgtggcagcttatttttacagagagaagtttctgttgttcattgtcacccgtgcttttggtttctgcaggtgttgagaaaagaattggtggcgccagattccctcagtgcaagcagcctgggaaagagcttgagaccttcaaggttatgttcatgaaaaataatccgcattctgagatccctattgtcatatcctgattgtctagtttgtcattttatcttttcaggtgtcactaggaggactaaatggaagatatgcttgtagaagagcacctaacaattgtatcccaaccactattaccggtctcaacggttcattgtcatggtatgttttgttttctgctatgctattgttagcttatatggctgtgtaggaatatattgaattagagaaccacccttgaaacaagagaatatgaactagtaatacttgaacattgagctaagacaaaccataaaaaaattattgacatcttctgtaaggcccctgagatatgcctctctgctctttagtgctcttttaccagaagaaatgaccccatgacagttctaatttccattgcatcttggtaatattcctcttttcctgtttcttttcccagtggacaggtgtcttcagcaagatctttctcaagcagtgcaggtacttatcccagcagttagttagtcttaagtgggtttattggttgggcctcacttatgtgtgatgctttttgggaagtgttcttggtgggaggggttccttgaccctttctttataaatatttctctcttcttaatgaaatgaagcgcagttctcctgcgttttttgggggaaaaaaacaggatatcgcatagcagctcctcagttttttattgatcttttttgcacttatctacaatgttgtttttttgccatccttctttttgttctattatttgcttcactttatcccgtcttcccatgtaccaattgtttcatgcatgtgatcctctattctgctacttttttttggatatttttctccacatctgtatctccgttgaattttcaaaactttttttttgtatgtgttatataagcatttaggttatttgctacaaaataagtatatcccaatctcacaccacatctccccattgttttggttactatgttaaaattttctatgtaactccaatcaatggttccttacagagcatgtaaagtaaggtcctctgttagctctcttaattcttgacgcaatttgcttattccagacctgccaccacatcaggaaattgggatgccatcactctctcctacaatgactgaggtatctgttacgcaaaaaaaaaaaaaaaaaaaaaaaaaaaaacccgttgctccttatctgtatttcttgaattgcatccatcggtgttacacctttaacaccagaagtattacaccttacacttgtattgtctgtaggggaacattgcaaggtggctgaagaaggaaggagataaggtctcacctggtgaagttctctgtgaggtggagacggtaagttttctaatatgtaaggctacatgccatatattgtttagatttatttttagttatgcagttagccagttacttctattaagctgcagtagaagctaaatatcctttgaatgcattcctgctgactaggataaagccactgtagagatggagtgcatggaagagggctatctcgctaagatcattcatggagatggtgccaaagagatcaaagttggtgaggtaaaaatttactgatcaaagaacaaccaatttatgactctcattttactaatatgattattacagttgcctctgcctataaatttttctgacgtaatcttggttgatttatggccccactgttccttttagatcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgtagtttttttttcgtgttacctatctaggctattaattggtagattttattgaatcatacttaataaacacaaaacaggttccactgtcaagcgtaatgggaactggtcctgatgggcgaattttgaaggcggacattgaagattacttgggtatgccctttctcttgtcccctccaccccccttctctctctctttctcctcccttaatgatgaaatctgcgtggaaaaatgcaattaactagttttatatatttaccaatgactatagattaatttattttcaactatatcacttcctagtttttttagagaaaccgctggggaagccctcattttgtagctagtcatgtgtgctcctggacatctcatgctaattctgaatggtggactcataatgtcgaattttattggggtgtcctccccttgccagctgtcttcttgttcaatctttaaggctcaatcacaagaaaacaagctgtatcactcaatatctttgtggttggctatcatatccattctaagataaccatattcagatactatttgatcacttaattcaatatccactggaccagtatatcaagttttcagaagaaaaaagaggctatttatctgactcagttttgcacttatgcttatttgtgtacactgtgttagtagcagcactagtttgattcaaagtaatattaatgtaatttgcttgagcttgccaaggttcaagttaaatgtgtggctgtcactagcctgttatgtatgtcagatttgctgtgcttttattctgtatgagaattcaatcagcatctaactatcattttttattaacaaagcttctgtagcaaagggtggcaaaagggaagctcttgcggctccagggttaagttacactgatgttcctaatactcagataagaaaggtaaatttcaatgatacagaatcttgttaggttgattttagccgatgctattggtctgatagtgtattatcttctattcttcacaggttactgcaaaccgcctgctaagctctaaacaaactattcctcattattacttgacagttgacgcccgtgttgataatcttatcaagtatgttgaagcctagctttgtaatttaaagcaatcctatattacataggaaacctatgtaatgattcaattccatactgctggttttgtagctttttaaaatagttctttatttcaatctaatccaggttgcgaggggaactgaatccgttgcaagagtcatctggcggtaagaagatatctattaacgatcttgttataaaggtaattgccgttttcttgtttcttatgtctaccaaccattgagttgtcgcagattgggtgtatgatgtatatcagttcacagactgttaattttctcctgacctccagatctgaattgatcttaatttgatgtgcaggctgcagctctggctcttcgaaaggtccctcagtgtaatagctcgtggatgagtgattttatccgccagtaagttgtcatggagcatgtatcctgggattagaattatgttgacaagaaggtgattatggtaaatttatttctcgtgcagataccacaacgtgaacatcaatgttgctgtacagactgagcatgggttgtttgttccagtaattagggttagtaatctgaacttgtctatttatatgaaaaaaaaaaaacattggtttctagcttgtacctgtgtttcaggatgcagacaagaagggacttggtacaattgctgaggaggtgaagcaggtggctcaaagagcaagggataacagcttaaaacctgaagattatgaggtatatggatcgcatggtagctaatataagcatgagacaacatcatttttccttgaaaattctggtgcttttcagggaggcacattcaccatatcaaacctaggaggtcctttcggaatcaaacaattctgtgccatcataaatcctcctcagtcagcaatcttggccattggtactggtaagtcatgctaatatgtttgtgtaataataacggtagcatcctgtattatctgcatttctttctagtatcttttgagaagcatattatctttgttgccccatcctattatttttaagtcgggcttctactcagaaatttggcatgatgttacagagtgccaactgcttagtagcatttagccttttataaacagggcttaagcatagaattcaaggtgtagtagagtagtatcctttcgcttctgtattctacgtttctacattctagataaacttctgctaagaaggtccattcacgttgcagtgttcttgtgatgattacatagggtgtcattatttacttaatggccttttttttgtttggacagctgagaagagggtgatacctggcagcgtagacggccagtatgagtttggttccttcatgtcggcaacaatgagctgtgatcacagggttattgatggtatactcttaagccttatctgaatacatgatagttctacggaccataggctagaaaataactttgttcatgtgtgctttctctaggtgctatcggcgcagaatttctgaaagcattcaagggctatatcgagaatccaaactcaatgttactgtgaagttaaagatcagcaaaactattcttctcatgtgctcgaataacgcagagtggtgctatctcattttgtataataccggcacggtgttctgtcaaggaggacccgaaaaccaagagcacataaccatagacagaatgacctggtttttggattaaaagctttttctgtttatcttttttttttttgtttgtttgtttcgttccagttatagtgggaattaggaggatcaacttacaagcatttttagcacctttttgtgggtttaccctcggcaagtgtgataactggagagagtaaattcccgggaaacaatgcagtatagcctgtatacgatttgtcccttttctttttccccttcatagtgcaaaaccaagaggcgcagaaggatctttcggaataaattggcaatcttggggagtatggcttatactgtttcttaagcttttgtgtagagaagtagattattggtcataataaatcatgcatttgcttatttcacatacatgtttgatgtgctggtttaattttgggcctttaatggagtacaataaaacaaaaggaagcttgttaagaaagaatatgcctgtgtgttcttctcctccaagtcactgattttcttttttggctgcccatgggaagtttgatcgtgtattgtctgcttggtcggtgcattgttattttcttccacgtgagttggcacaagtgcgtctcatatttcttgacctactcctatgtgcgttgattggttgtcattctttgaagctgcaggaccgagaaggtaagacgaatcttgtccctcgcagtatgcatttcagcgttcttatggaagaagcttctaatcaaaaggaaatgaatcgctctagtaatcccaaatccaacacgcaattctgaacgtcaaatggaacggaatgctagaaagcgaagggagactagaaggtcaaaaacttggaaaaaggaggagatgaaaaatggaaccgatttcataaggagctgagcttttcatagctccgcttttgataatttcgatagcatagcataattatcctccaagaaacgccggaagcaagagcaaaaccagcaaacggccaccggttccaggacagggttgcttccgggaaagatgcatgatgcacagttttccatcaacaccgtaccaaattaagtgtttctttgacagcgtgccagatttggatcggtcattcgttgcggaaagtagtaccaatgacttactgctactattaatctactactgtttcgcttaagtataggtaaaggaaatgtaaccctatttcgagaaaatatattagtggtagataggatagctaggagatccaaagagcagaatggtatactgcattagatatatccaatgtgccacgatgagtggtttttctttatctgtttgtactaatttgcgcacttttgaccgataagcgggccggcatctttttaaatagagaaacacgcgatatgatgataggcagtgagatttcttcacaaatactgtacagaacagtagagcagtagtagtagggcacaaattgatggaatcaacttagcaacctttgtagaccgtcgtcaattttacaagggagagatatagtagaatgcgggtacaacagttcatgctgtgttgagttatatattgtttttgggtttgtgattaaacagtgtaacaacacggaaaggttcaagacgagcaaacacgtcagcatgtacaaacgcagtgtatgagttaattaattatatggttagcgtgtatcgacattctcgataccagtttaaaatatgtgatgatattattagaccttgcacccctataaattagggccggtgaacaaaaccatcaacgccttagtttttgattttgaagaagaaattgttgtcagcatcattagatcttgtgtgagtatatttgagagtcaaatcagcatgagcggtttggaaaaccgccgtctgtagtgtagcggttttgtctccagagcgacctcttctctataaagaggaggagaacttccatggaatgagccacaaaaccaccatcgatcatttccatttccattttcaggagagatccacatcgccgttggcctttcatccagtgagtgagggagggagatctcgatctcggtctcgcgacatgaagaaggcttcgtctctgtcggagctggggttcgacgcggagggcgcgtcgtcggggttcttccgtccggtggcggacggcgggtcgacgccgacgtcgcaccggcgtcggctgacgaagatatcggtgatcggcgcgggcaacgtggggatggcgatcgcgcagaccatcctgacccgggacatggcggacgagatcgcgctggtggacgcggtgccggacaagctgcgcggggagatgctggacctgcagcacgcggcggcgttcctcccccgcgtccgcctcgtctccgacaccgacctggccgtcacgcgcggctccgacctggccatcgtcacggccggcgcgcgccagatccccggggagagccgcctgaacctgctgcagcggaacgtggcgctgttccggaagatcgtgccggcgctggcggagcactcgccggaggcgctgctgctgatcgtctccaaccccgtcgacgtgctgacgtacgtggcgtggaagctgtcggggttcccggcgagccgcgtcatcggctccggcaccaacctcgactcctccaggttccgcttcctcctcgccgagcacctccaggtcaacgcccaggatgtccaggtcaacaccttacccctctctctctctcctccactgccattgccattgcccattgtccattggccattgttgctgtctctctctctctctctgcgacaaagtgacatgtggtgtggggcctagctaaagcatatggttggctgagtggtggtgtcactgcccacccacatgtgatgacatggcagcctttagcctttatcctatttccatggatgactagcttcctgcacacatgtgacaagagcgaacacatgcttctgacaacttgataaaagcccaaagatgcttagttagtgctgatatgatattattaagattcaactgaatagaatcgaatgccttgggttgatgctcctagctactactatatgtggaataatacaacttaggatccgcatacgggagaacgttttggctaaaatttccaacaagacaaagttattatcatttgactaatcgaatattagtaactacaaattttaaaattagttttttatatataaaatcaaattgcgcgcctagcatcattatattttctatcatataatagcatatatgttttctcactatattattcaaatatattaaaatgacaacataattttaaattttgcaatatgtgtaatattcatattatattttatatacatgttagttattaattatttttaatatcaaattttagttatttataaattgtatatattcctatatggactctagactcgtcttttaatatttcctttttttaattccgaattttctgtaaattgtatttctatatagactctatgctcttcttccaatattatttatttttatttctgaattttcatattatattttatatacttgttagttattaatatcaaattttagttatttgtaaattatatatattcctatatggactctagactcgtcttttaatatttcttttttaaattccgaactttttgtaaattgtatttctatatagactatgctttttttttcaatattatttatttttatttctgaatttttattatttctaattgtatttctatgtggactctaaactcatctttcaatattcttcaatttttaatttcgaatttcagttactaataaattgtattcttatattgaccttaaactcttcttcccatatttttcttaatttcgaattttagttatttgtaaattgtattttttatacagactctagactctacttttaattttattatgtttattccaaattttagttagttttaaattcctatatggactctatactctacttctagtatttcttttttaaattccgaatttctattttttttcttaattgtatttctatatggactctatcctctacttctaatattccttatttttaatttcaaatttctattatttcataattgtatttctatatggactctatactctacttctaatatttcttgtttttaattccgaatttcagttatttcctaattgtatttctatatggactctatactctacttctaatattccttatttttaattccgaatttcagttattttctaattgtatttctatatggactctagtctcttcttctaatattccttattttttaattccgaatttcagttatttcctaattgtatttctatatggactctagtctcctcttctaatattccttattttttaattccgaatttcagctatttctaaattgtatttctatatggactctgctttttctttttctccgattaatgtgagaatttctaagccatgagagcgaatgtggaagctcctttttctattcctttaattatataatagataatttgtatataggaaacttttgcatcaaatacaccatttactagctaaaaatgagttggtccctctttaagaaacgaaacgcagctccagcattaaacaaatggagagaataaatcttagaatgactatcagaaagaacagtctaatctattatgatgtaatacggcatttttattattgaaccaaccagagagaaagatgtgaaggtgcatcagtagtgattaacactgaatagttacggggggaaaaagtccattttaaattgggcctaacatttcatcgctccacgattaattaaatagtggtgatattagggttctattgaacaattaatcatagtgctaattactattgactagacattattagtgacatgttagttgaggaaattgacaaaataatgaatgaaaaataaaaaaatgcaggcgtacatggtgggagagcacggggacagctcggtggcgatatggtcgagcatgagcgtggccgggatgccggtgctcaagtcgctgcgggagagccaccagagcttcgacgaggaggccctggagggaatccggcgagcggtggtggacagcgcgtacgaggtgatcagcctcaagggctacacctcctgggccatcggctactccgtcgccagcctcgccgcctccctcctccgcgaccagcaccgcatccaccccgtctccgtcctcgcctccggcttccacggcatcccccaagaccacgaggtcttcctcagcctccccgcccgcctcggccgcgccggcgtcctcggcgtcgccgagatggagctcaccgaggaggaggcccgccgcctccgccgctccgccaagacgctctgggagaactgccagctgctcgacctctaataaatcttattattatcatcgtcgtcgtcgtctcgtcacggaattaattaaagtacctactccgtacttagctagctacaataataaggattcattgatcactacaagagtgatcgactcgactgtagtatgtgtgtgcaatataatgtgctgtctatcaacaactactagtattgtcatttttttcgaaccagggaactttttaatgataagaagaaaaagacaagtacttattgtcgagcactcgtggacaacactgtgattgattgccttgatcaatcttaccaatttttggtagctgtaaataatttacatagtttgttggggcggatgagcaagcaagcaagctgaatgggctgttgatccggacgaacgagccgcgcattccttgcttaattaatgggctgtcagtgggcgaacgaacttggtggggcggacgtcaatcttttggcccaaaatttcatgacaagtgcagtgcggtggaaggaaaggagttgggccaggccggtaggattatttatgatgggctgggccggaaaaggcagcgatgatatagagcgggctgggcctcccaatggctagcaactcttcataggagaagaatcgtgcaacaatacacgcccaagagaagaaaccgcggcatggaaggaacaaatcgtggtgcgctctctgcgtctgcgtgtgcgcatggcatcgtgcagtccacaggacaggagacggcggatcgcaagacatccgcgcgcatcgggattccatcctttccctcatgtatactatctccgttccaaaataagtgtagccataaatatccgtgtttagcagtttaaccatccgtcttatttaaaaaatattaaaaaaattagtcatacataaagtactatttatattttatcatctaataacaacaaaaatactaatcataaacttttttcaaataagacgaacggtgaaacgttaaacatgaataaagctaaatcagtacttattttagaacggagggatcagtactctgcgtgagtgctcgtggcgtgctggttggaaacgaccattgactgattacgtgctacacgtggcagacagacatgtgggccctccccactcccttccatgcttcagcttcacacgatcgatcgatcgatggagatgcggcgatagttgcgctcctcctcattcacagtccacactgccatcagccatggggggcagccaccacctcttccgcttcctcgccgccgacgaccaccctttcttccccaccttcccaacctcctcctcctccttcctcctcgacgacacccacccatttttcttccctccctcctcctcatgcccactcggtttcacctctcctccttcatcgtcttgcccactcggcttcacctcctcctacgacctcgacgccgccttccaccaccatctcgacctcgacctcgaccttgacctcttcctcccaaccccgaccccacctgtaaccacctcctgccccgccctccgcgatcccttccttctccaccactccctcgcccaccgcgtctccgcgcttgagctcgccgccccacgcagcaagtacacctacgaggccgaatccgccggcaggaagatcaagtggaccacccacgacaagcccgacggcgaccggaccttcaagtgggaggcccagatcgacacccccaacgacgatggcttcgaccgcaagtggaagtgggagtccaaggcctccgccgccggcaccaccaagctcaagtgggccaaggaggtcaagggcaagggcttcctccacccatggtcgcacgcctactccgtcgaggaggtcttcggggacgacgaccaccaccacaaggcagacaagacagcagaaaacaaggtcaagcagcacaacaaggatacttctgccaaggaggagaagaagaagacgaacaagtctaatgttcagatcgttgagatcgacgacaacactgccggatgcgtcgccatcaacaaggtcacatcttctcctctacatttatttcattatttatttattcaattggacttggtcctagatttttcctattcagagtttcagatctaggagtagcagcttgttatctcaagcttgcgacgtgaggtttgcgcaccgatttgcacaaatccgtcatgtttctgatatgcaaagatctaatatacggagtacttaactactactccctccgtcgttttgactttaagattatggacaaacataataatatttacagtactaagttagttccatcaaaccaataattaaatatattttcataataattttgttttgggttaaaaatgttactacctttttctataaacttgatcaaatttaaatagtttgacttttaccaaagtcaaaacaacttataaactgaaacggaggtgtatttccgatggcattttgtaagggaagccatacccataaatgtgattagcaattgctagtaacagatagtagatcgtcaattttcgtgtgcgctgtactgacaacacaacactggttttctcaaggcgtttgcaagcagctacgccaagggcaagagaaagcagctgtccccgcaggatgctgcattgttgatccagatgaactaccgggctcacctagcccaccgctcgcaagtgctgcgctgcctccgtcatctggcggtggccaaggccaagctcaaggacattaggtccttgttctacaacatctcttaccgccgccgcatttcgcatgactctgaagagcgtcagaggtttgccgacaaaatcattgccctgctcgccactgttgatgcccttgaggtattaagctcatcaccctttctgatcatgccgtttttcattaacaagtggcccccatcaaaattttgcattccagacaatttcttcttgttatatagttatttttatttattactatgggtgacgattggtaaccatgccaatgcatgtgttgttatttacgcgtttatcagcaatgttgtttactaccaaacgttatttgattgatgaaatcatcagtgtagacatgacagtaaaccacacccaattttcttccgatagtctagtttagggtcctgactgaatttatggatatcaatacctgcaacaacatggctctcatacagtacttccatgtaagataatctaggtgtaagtgaagaaggatgaaaacaccagaaaaatattttctagctttcttcttcccccaattcttcatcagaataaactctaaacaataacacatttgttgatagctacgtgagggtagtttcttaaaaagaaaagaaaaagcatctaacagccataaaaaaacaaagaatactgtacatatatattgttttatcatgggctctataaattggaagattaagtgccatgaaatgctttgatcttttgccatgtgtgaatgttttgtgcttacagggaccagactatatggttcgcaatgcaaagaggtctatgctggaggagctggaggggatgctagagatcgtaggtcctcagtcactagggaagccaaggactctgagccgcagaaagtttgagaaccatatctaatgatatgaggactggtgtcaagggcaagtgaaaggcaccatcggttctatttcgtagtgcggcgtatgaagatgcttgatgggggacctacctttctgaatgtgtttacggtttagacagaatgttgtgtctgtaactctagttgtatgatctatcttctgcttgaactagtacttatgtgttgctagactagttagagcttctttataacctcttgttgtttgaggaagcttcttgtagaaactgtttcataatttgtcatgaaatgatgtgcggcatgtgccccctaataaataagaccattaccatatggtatgcatattggcatggtgcttttcaaccgatgcatctaaccgtgcggcgtgttgccaagcctccgcgttaccggccacatccaatacggataactgcaaaaaaaaaaaaatgctaaccgattgggagaggcaatgatggaattttttggtattccgggtcgttgttgtgttcaatatgtgaagcatcccgttcctctcaggcaaagaaagttccaattcaactggcaagcactgcaggtgactgctgaaacccccatatgttggtgtgtgccgtgctcatggttatcttgtgccgctttaagtttctgtagaaggtttgcgtgatgtcattgcatgcactgggggctgtacttatactgatctaattgtaagtttgtatattataccatattcatcaggctatgttcaagtttgtaccacttagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaatttttttgcaaaaaacgcaccgtttagtagtttgggaagcgtgcgcgcggaaaacgaggtgttttctctctcaatctccctcaatgtcctccaaacgaacgctgccttaggttgtatttctcattgatcagtatattgacatcgaagtatgattctttgtattttggtaaccctgtgcacatgttaacgagcgcggcgtgcttatacttcttgtaatataaatgcttgactccgcccgccccaatcgatcccgagctcgagcaccttggtcacccatcccgttgtttccccactctgttccaagctggtccttccggagcttcgagtctctgccttggcttgggccaccactccataatttttttttagataatggaatgaaacattcctacctttgctcattagagctaaagccaaccacttcctccctacattccattttccacatttatttaactggccgattgcaccatccccatccacccccacgtctcttctacatctccctcccggacccaaccaccttccttcctattccttccacccccaagacccatggcctcctccccgccgtgacgtttaactatttattactcctagtctatgatatgtggatggatgatcttatggttaacatatactatcatctatttaaatgcatattacaactaagataagttaagacatcttccgccttcccgcagcagaggagcatcatccaaaggcaagggaatgacagcgcgtgcaaggctccacaagagtcagggttgttataggtgaaactttatcctcgatgtaccttcgtacagcaatggcagctcttgcggattccttgagcacagcgttgctaacaggccagcaaatcttcccattactttccccacaacacctatcatcaccacctctaagtgtgtccaacacaagacgctcaagtgagactgcggccttgacgatgccacatgttagctcaaccaagctctttgcggagttgaaccctaagatcttcacgctcttgaggcagtcatggctgagctcgggcagctgcctcaaatgtggggaagaactttcaataatcgattcatgtgccatatcgtcctgacaaacctggaggtgataaaaaggaagattatatatgaatgaatcaatggtccatccgacagatatctttctttgcaggatggaataatggatgaacagcacagccttacatccaagtataaagtctccaaggaaggagatgcatcgacgaaagaaaccagaaagaaataatcataggatggggaaaaggtccctcccgcaatctgaattgttaggtgcttgaggtagaggaatttggtaggcaacattggtatattaaccgcctgcacaacaaatgcattgtcacatgcagaatatttctactgtcatatgcatatgtatagctactatatatgcagggtcttagaacatacctcagagtccgaacctaattccatagtctcaaggagggcgataggcaactagttttgtaaatttttcaaatagaaaattatttcttgttaacaaccaaatttggtaacatctgtgtcaggaaagaagattggatcaaagcgaagtcggaggcgaagatcgagttcggaaacagagtaggaatcggctggagtccagatcggctatgattaggatcggctgggtctgagtcgggctaggtaagccgatacagccgattccgacaatacgacttgtgtacgacatcgggttcaagttaatgtgcttcaagatgattgccacgcatggatagagtcctgggaaggcaattgtatctattaattaagatattttatgtagattccttatagataaatgtgggcaaaagtctgccgcaaagacttatggtatcttagagtttgtaagagataatagtcatgtccggtatgggcatatcttgtaattctcgggtataaatagaccctgagccctatgtaattgataacacacacgttcaatacaatttcggcgcatcgccaccctttttgctttagttttgtttcgacgagttcttgcttttgggttgagctgcatcggtttcgatcttcaacaagaggtaaaacttgttatgatgacttgtattctcgggattagtgcttccatctttatgatactctaatcttatttatataattcgtcgagttatcatatatcttacataatctctagcaatatcgccatctaacctactatcggttaacatctgttagcagagggcaaccgattaggttagattttgacgttgatctagattatataagatatctaccactctatgaaacttctagcggcttgattgtctagatatcgttcttcatttcatacttaatgttgtatcagttaagtttgatctgttaagtcgtgcttagaatatcgatctctagcctgccttctagttgccgattagaatagcatcggagtttcagccgatcttatccgatttaactatatttgttatatatgctttattgacatgttaaatctgctctttatatcaagatattgttgtatctaagtatgttaggcctttgtttgatatattatacatgctttaatatcctgatatagagtagtatcagagtattagccgatacatgttagatctatttgatcggctacgctataaacatatatagtcctgttattgatatatatttcaatctaagtgatttatactgtctcggcatggtgactgatctatcccaatcatttgatttaagtatatatcgatataaggagtatatatcgttaatatctacagccgatcgagtagatttagttcttctttacttattcatgtctgccgatcgatacacagatgacatcggctcaaaggtaaatgatatgtcatcggcatctagccgatcggctatcatttatagatttaaccacggtttctttgcttctatttcttgttgattacaggatcaaatcaactggcacgctaacacacctgaaggtgagctttggacctgcactggagttaagcagatctcccgggccacgtgttttctgtcaacacttttgtaaatatttcaataaataaaattaaaaattaaaaaaaaaatcacaactagtgcaccaactgcatgtggacaggagggagtatgtagtatacatgtagattgtgaatggcggttggaccgcccggctcaccggtcggacaagtggaccgctgaaacgagagttcgtccgggtcatccatcggtccggctttttttactaaggtttaaagggcgaaaatccgattcgttgtaaaattaagggatctcagatgaacttataccatttcttgaaatccggggcgggctggcgtggattctacccggcctgctcccttacttcggccccatatactaccagcccacgaggcccatgcatccactcttccagaaacttccggacttccagagtcttcgacacggatagcgcctcctcccagtcccatcgcacaacgaccgttggattgttgagccacggatcgcgcgttgatccgagcaatctgaactgttgctgcgccacggattcgttcgctgtctcaaattcattttcagatttcccgctccccggttcaaaatattcagcccaatttctagtataaatacccggcacaagtagggaatcaatcgcccccaattcgatcgagagagagagaaatggctctccagctgagcggtctcgccgaagtcgtgcgcgaggtcggcgtcgccccgggcccccgccgcgtcgtcatcatctccgacatccaggcaggcgacgctgctgtcatcgacgagttaatggcgatccagctcggtgtcgatgcgtcctgggaattcgtcaacagggagcggctcaggaggatggggcgcacctacaacctgctcaagatggtggaagcggttctcccaggcctcatcgacgacccctaccacgcctccgacttcctccgcgacatggagcataaaatcaggacccgcgctactttctccggtgtctccttccgcgtcctcgccgtcgagttctgcaacctcctgcgcgactacaacgaccgcatcatcgctgatcctcccgtctctacccgcgaggagctccaggaccacatcaacgagctcatcgcccaactcgatgaccttctgcaccagacctgcacgctgcgccaagatgacccggttccatgaaggcaagcggaaagttcatgtgaggaggtcccgatcgtacctagttgttcatctgatctgatggtagttacagtagcagtagtagtcaagtagtcgaatcagcatgttaatcctgtttgaaggagcaagtagcagcgagtaatgtcactagtagtacagcacagcacagcaacacaagtatatgaggatgtacccgcacaaccacagtatagacaagtgtgaaatatatggaaccaccataagttggtttgaatttgttctcaatcgtgttgcctgcttggtttcagttcgttggtggcaagtcatctctcttctgaatcttcttgtgaagttgttttctgaatcttgctgtgaaattgttttttctgaatcctggtggtggcaaatcgtccgtcttctgaatcttcttttcccctagcttctgttctgtccggtttgtgtacacagatctggttcgcgtcttttcacccaaatttttagatgtttctgtctgtgtatagaatcgtccggtcgattgtgtttcagtttcttgcaggattagtctgctggccaccgtgctctctgctagcttgtggtagtaaatcctttctcctaccttgatggttttttttctcgcacacatcgattctgatttcctccggttttttgctcgttcctccgatgtaggcgtcccccgccctcttcctggcaggggctttggagcggtagagatgcagttccaagtccttccccggcaacccgatctgccatgtgccacaacacctagtaagtggaatatgttttgattgccttgtgccagattataatgagaatgagaaaggtgacaattacttctgctgtttgcctccctcctgattcacagtttcatactagtatttagcaagtttttctctgtgttttacttaatgagattgctgtttgggttgtggactttagtattgtttctgctagttaatacatatcctgcagtcttcagtctaaccacctacttcatttgcttgcttgtctggaagggaaacacttggttgcattactgtgtagattatgtcagatggttctctagctgcagttactatagtaaaattgatcatcctctgaatcattgcaggtgggaggtggcatgaatatcaaatctgattgtgacgaaccatccccgtatgctgctattcttgcttctcaatactatgttgtactgttgtttcaagatttgtatgcaggcattgttcttgcgtaggacaaacggacatatcttgggttacctatttttggaattctgttgagtttgaactaacatattgccttgctgtacgttgagaacaatttgttttgctcatatacaagtttcaccactagtatgtcttgattgccgtatgttttgattataatgaggatgaaaaggtgacaattacttctgctgtttgaagagagctctaaacacatgatagatgtgccttttgattcacggtttcatgtttagcacgctctcgatcgatgatgtaggaaggtttatttgtgtttacttgatgaggagcaggaacatttcttacattttgctggttgggatgtggattggtaacgtgttcagttttcctactgggcagttgcatgggatgttttggcatgaaattgattttgacacaacttgtaattgttgtgtactctctccgtcccaaaaaaaacccaatcctgggtttgaactccaggttcaaacctaggattgggttccaggttcaaacctaggattgggttttttttgggacggagggagtagtagctatagtcagtttttcctcacttaatagctatagtaaaatactcaagaggaagtccagggagcccaaggtggggaatgatactcttcgacccactgaccgtgaaggagagtactatactacgtgcatgtttggagttgctcatatcttcgcatccttcaaatgacacattcattttaactactgttttggccagctactagtactaattcctgcagtctccagtctaaccacctattcactgacttgtcaggatggcattactgtgtacttctagattattttggttggttctctagctgaaattgatcatcctctgaattattgcaggtgggaggtggcatgaagatcaaagctgattgtgatgagtcatccccatatgcagctatgcttgtttctcaagatgttgcactgtgttgcaaggtttgtatgcagacattgttcttgcgtggagtataggacaaatggacagatcttgggtgactgttttctggaattctgtctcattatgctctgtgcggctggaggcaacaagacaaacacacctggacctgatgctcaatctgctctcagggctcttgctcttgctcggtctgggatgaatattggtcgcattggtaagctcagagtttcaaatactagttgatgctgacacaatcgaaggatacggaaatgttgttgatgctgtgcacaatacttgcagaaagggaggtagtagtagggaggaggctgtgtcgtaggccatttatcgccatggacatggagagtatctcctctttggatagtcgctccaaagcttcccgaagagagagtttcgctcattgtcctgaatttctgactgtcacttaatttggccactctgttttggttaaggaaatatcaagttttcatgcttaacaagacccaatctagtataccttggtggttccatataatatggttggattgttttatgagtttgtgccatctactgtatgagtttgtgtcagtttatcttttgtgagcataatataagtgtgatcttgttggctgcatgatttctggggtacagcttagaagttactcctatttactgtacttagatggatggttggttgtgctgttgaatcacttgtggagtagtagtacttaaattttaacatgttgcatttgcatggagttttgtcagggttcagttgcatttgaagagaatgtacgggtgatcatgttgcatttgtcagggtccagatcacaacttttgctggtgtgctgtcctgatctggtttcatgtgatttgttgaatgatgatggacctgtgtgttgaatacgtagtaggagtaagtactactccttgctgcaattttacaccattgtcgaatttatgatgatgcttgactgaaatttcagacgtctcaaggagggataggcaggggcgcagggccttttaccattgaggttacttgggccatggcaactagtaccactatgggcagtgtggctacaacatgtatcttcagattttttgtgttggccttatcatagcatgctgctctgctctgctctgacgttaaacaagggctacgagcaggcttccctgaaagaccagagaatttgagttcattggtatattcgacaagggaacaatttattggtatattcgaccaacaaattcatttattcatattgttctatcagtgtaaaagtcgaagaatattgttctactagtgtctgtcaaaagcctagccgagcttgagcttggatcaagaagctaagctcattgctactccatccgttctaaaatgtaagagattttagttgaataagacacattctaacgtccatcctaaaatgtaagagattttagttgaatgagacacattctaagttcctgtgtagaatcataatattaggatatatatcatccaatcaaaatcataatattatgatatatctcatacaatcaaaagcctttctattttaggacggaggaagtagctctcaaatgtatatatgaagatgcgtcttggccctatataaattttatgcacataaaactaagcaagaaaacattgcactgcaaccatgacatacggagtatatagtaaaagcagttcccacttgcgatttaagaacgcaccaacgacgacatgactcccaactgggagctggaaacttaaactgaaaactcagttttcaattcctcagcaaacgaacaggtccaaataatccaagaaacaaagcatggtttatctataatttgattaaagcgacaacattgtgcatttcagatagcttatcgcatagtcttaagaaaataataagggatagttaaagatgaaactacaaagatcttatgactaacatatactatcatttattgaaatacatatcacaactaagataagttatgacatcttccaccttccagcagcatagggatcatccaaaggcaagggaatgacagcgtgtgcaagtccccacaagagtcagagttgttgtaggtgcaactttatcctcgatgtaccttcgtacagcaatggcagctcttgcggattccttgagcacagcgttgctaacaggccagcaaatcttcccattactttccccagaacacctatcaccacctctaagtgtgtccaacacaagacgctcaagtgaggcagcggctttgacaatgcaacatgttagctcaaccaagctcttcgcggagttgaaccctatgatctccacactcttcaggcattcatggctgagctcgggcagctgcctcaaatgtgcggaagaatcttcaacaatcgattcatgcctcatatcttcctgaaaaacctggaggtgaacaattaaagaatatgaatcaatggcccagcagatatatatatgcaggatgttgaacagggtggcccttacatccaagtataaagtctccaaggaaggagacgcgtgaaggaaagaaaccagaaagaaataatcataggatggggaaaaggtccctcgcgcaatctgaatggtcaggtgcttgaggcagaggaatttggtaggcagcattggtatattgactgcctgcacaagaaatacattgtcacgtgcagattatttctactgtcatctatagctactatgcagcacataaaatcttagaacatacctcagagtctgaacttaataccatactctcaagatttggcataatggatggaagctgagcacgagcatagcacacgacattcggtcggatcatggacaagaccttcattgtcagtgtttctccaagtgagaacttgatccctccactaagggaaatactggacaaattcggagcttcacacacaatcacttgcatcctgcggcatgccataacactcaggcagctgagatgctgcagcacacacggtatcttcaggaaacttatcttgttgcatacattaagtctcaactgctccaaaacaagggagttcaaaagaagggactctaactcgtcacctgtaatatgcacaccacacagatgcagttttgttaggcttctcaaggggccaagttcagccatgggatggaaggcacagaaggtaagctgaagacatcgaattgagtctcgaacaccatcagataaaagtgagcatgcaaagatgtactttttatgtagcgtaagagtgagctcttcaatccctggtgtaacagcaacctcaagccatctatcaatgtaaggatatgtactgtcctcatcagctacattaagcttcaatatcttcgcagtgcccaagtggtttctcagaatgctgtcaattttgcacttgaaatttcccctagatgtcctcgggcaaagtgttttgaaattcaagctgaggttgggatgaaatctccaggaattcagaaaggaatgagaaaggcaagcagcacgagcagcagcactcatcggcattaaggaatgtatgtgacgccagatgtcctgcatccataagcatgggataaaatctcaaattaaggccaaatggaattacaacaagagaaaaaaaaagaacaggagaaccacatggagtatctctgccccaggttgctctctatatgattgcacaaggtgcaggatggtgcaattgattgtagtccatgatataagtttatgtgcatttgttcaaccaaaatgcacatcgatgattagtttattgtgcaatagcatattataaatagatcagtatagcaaagaaacataaatttgtaacttcagcacagggtgtaagcagaatctcgtgaaactagaagtcttgacatgtttattgtaagatagacataaaccttgctaaatgcaatgaaaaatataacatattgaaaaaaccatataaaaggacatcatgaaagcagttcaacctgtcatttcgtatggatttaggtagcaaaataaaaacatcaatgcctagcatgaatagtgaagccaaaagaaatagggatcactatttttatagactgaatatgtcaattaatgcttgtaagaacttggatacagcaacatttcagtatcatcactgcagtaaagcatcatatgcctatgtaagtaatcaaaactggatatttttcatattcgtcttaaatgaatatgcatgattgacatgattaggcctgctcaaacttataatgaaatcattcatacttaggcatggctcccaattgcttatatcaggagggagcacatgttacagttgttggacttaagaggaaaatgcaactactgatgcatgccacgccttatggccattgcccaacattaaaaaaaaaaaaaacaaagcaactacgcatcttattaggctgggccttctaagagagctagaaatagtcctaaatgtatggtaagtgcagcgatacagaggtagctgacaatattttgacatattctgtggttaaagatgtgtttaaagacatactgatgggaaaagatgaaagccgtttcaatatgtttaagaacaagcgttatattatattactgcttcctgaaagacttagacacagctgctacaataatggttcatctgcaaaggctagtaacatcagtcaaatagacagcccacaagtgagagatcctagggtgtatgattatactatatatttttatcaggagtaccatgaaagaatcaacagtcatgtctcattatcagtagatatgctcaggctctggcctggaggactagtgagaaaagaatggaatgcatacggataataagaacgcaatgaagatattgccagcctttgaacaatgaccataaataataattcactaggagtttaggacaatgttcgattgcatatatattttgtgactataaataataatcaactagcgcagtggggtgaattaggatgattaaagcagttaaagcttacaatctaagcttgcgtcagaattttacagtgctgttagcatacctcaggaaggtacgggagtgaataaatcagtgaatcgccatggccaacttgttcagagggggagttattagtgctacccactgtacaattcgatttatctgcagctgaaccagcacgattataattataatagcccatcagactgacaagaacacattagagagagagagagagacaaacaacgtagggggctaccgaccaatggtttattgggataaaaagatcaagaatttttcaacgaataaatgcagatattatggggttaaaaggagctgaatcggtgacctaacctagcaaagcagcaacagttgaatgttgtgcaaattataattcggtatccatctaacattagtcaacatgaaccgattagcgaacaagaactgatccaggtgagacgaaccagagacagggctgggaggcaaagggagttgaggcttactcatgggcagggctggggctagggctaggttttgccaccgctgctcgcgttgcacggccacggaggacatggcagatggcattcaggacgacgataactctctctccccccttggcccttggatctcagactctcctacctatctatatagctcttctagtatgagagttctgtttctggtttcctctccaactcgttttttattcgattggagctggactttactatatgtcaaaacggattattagtaataaaaaacaattttatgagtctcaaatagaaactactgctacagcagagtccttaacgacttaaaaaaacaaatattcaaatagaaactactactacagcacgatggattgggcacgattaattaggttcagcccgacgggcgtcgtaggacagcccgcaatgtgcagacattcgtttaattaggttcgtcaaccagcaacaagactggattatttcacgtgaaaatatttacacaagcacatgagtactccctgtcccaaatcaaactaggaacaagagagggaaacctaccaagagagggaagaaaatacaaaattgcaaaaacaaaaaaaaaacaagagagcagtgaataggaaacagattgaaagctactagctcaagaacatgcaagagaactcatagattcagcagagccacaagcactaatattgctaaatgacatgtcaagtgattaacaacatcaaacagctacaatctttcttgaaaactacatcaaacagctacaatcctaacacagatcgacattgctcaactttgtgtaatatcatgattagaaaattctcaatctcactcttcgtagtatggtttaaattcgattccctgcgctgaagtataaattgatcggtcaatacacagcatatttgattgcacacatcaaacaaatcgcaggagtagagtggcacatcaaacaaatcttgaacacgaaccgaagaagaaggaggaaaaagaactgaccggccgtcgtcgctgctgcacaaggtgtggccggccaattggaactgcaactctcttccatggcagatctgccaatggagctcgaagtagttgcctgctcccacgccgatggagcccttagagctggaggcggcagcatgggcagcatcgcagcgatggacggcgttcgctgctggatggatgggcgacgagtaagtcggcgtcggtgacgagagtagcggcggctgcgttgccgtctcgctgcccagcgacgtctccccgtctagtgcaatcgtgccctaatgggccaaaaaattttgcaattcgcgggcatttttgtgggggcgggactgcgggccgcaaaaaaagcccgccccacttgcacccctagacacgatgcagaatcgctagagatggtaccatgacttcacggagacaaacagcatgctactccatccatcctcaatggcgaacaactgacacccagtaattaagctcgagtatacgagcttcgaatagagactaacagaacaatgatgcaacgggcaaacagaacagaagcaacgcgactatgaacaaaaaggccataggctgaatgctcaaaaccataccatctcagcaacaggcaaagacaatttggtttggaggttcttaaaaggcgccttaaataaggtaaacagtcgcattacagctagcagcaaacatgagttcgcgaattgatcaacataacattaggcaaaagagctcaaaaaaggatagtctggggcagatagttctatatccttgcaaacaactcgctatagcaaaactccaggcagacgcagcagcagattttaagcgttggcagcagcctgggcggcagcatcccgcttcctttgctcctcgatgatgctgagcttgatgcccttgcccttgggcaggctcacccaaggcttgttgcccttgccaatggtgaacacattgcccagacgggtggcgaattggtggcccagggcatcctcaacgtggatggtctcgaagctgcctttatgcttctccctgttcttgatcacaccaacacggcctgtgttccttcctccagtcaccatgacaacattgccaacatcaaacttgatgaagtcgacaatcttgttggtctccagatcgatcttgattgtgtcgtttgccttgatgatcgggtcagggtagcggatggtgcgaccatcataggtgttcaggtaggggattcccttctggccaaactgcacagaccgaaccttgcaaagcttgaactgtgcacagaaaaattagaatcagccagcattctaacttgaattaatacactcaaaagtaacggaatgcacaatgctacaatcagttcttctctagaggtaaactaaagaagcaattctcaataacagttcaatcaaagcaaaatatctttctcagcacaacataaatttcattatttcaaacagaataccttcatataacaagagtgtgttcagcaagaacagtaccaaaaattaatatgtcctaaccttagcatcctcatccttgacagactgaaggcggaaacgtcccttggtgtcgtacagaagcctgtagttctcaccagtcttggggatggaaatgacatctgccaaaaaagaatatgtttagcacaaagcaccaagtgtttttacatcatacactgaagcatatattgattgcaataacgattgagcatacccatgaaaccagctgggtaggtcttgtcagtcctgaccttgccatcaaccaagacatggcgctgcatgaggatagaaataacctcacggtatgtcagagcatacttgagcctgttcctgataatgaggatcagaggcaggcactccctggacttgtgaggaccagaagatggcttgggggcctatggtaaaaggtaattagaaatataagctatcaggtaacagaaaaaaaaaagataagcttcaagcatgtgtagttaagtgtaaacaagaatgacaaacttacaaaagctccaccaagcttgtcgagcatccaatgcttgggcgcattgagcctcttcagatgcttcttcaaaccccttgcctggtattacggtaagggaaaaggaaatgatcagcacaaataacaacataactgcagagtagcacgacatgaatacaatgacacaatgaaatcacaaggttatgaacagccctaacatcgctcatggcaatggtgcggcatggtttctaagtaatctttgttaattcttaacaaaaaaggaatctagacaccagaacctataatccttgaagccaggcagatatacaagttgaaccttggcacgtaacagaaatgtagaggaacaataacgcagcaaacagcacgagctaaaccctcaaactagcattgacagtacaattatacaaagcatactgaaaataacgagctgtctaagatcccacaaatgggcgacagccaaggatgcaatgtccaatcctagactctactactagaagcccaacattgtgcatagctgttcattctcgcgcaacgctgaaacataaccactaggaactgatccacaatctgaagccagccagcgagtacaaattcaacataacatgcgtttaaatcctaacaggctgtagcgtggtacaaagctatctactcaacatacgaatcctacacatcacaaagaaatctcatggaccaagagcaaaataaccaagccgactactaagctactacatcctagcaggccacgcgccgcacacgaactcccactcagggagagcggggaatggaactaatcccaccgaagctacgaacgagaaggatgccacagatcagccagatccgcagacgcgagagagcgcgcgggggggagaagcataggacggaggagagggggtagggggctcaccatggttgcgaggtcgggctaggtcgccgtgctctgccgccgccgcctgctgcttcgtcctcctctgctccgcgccgcgccgccgccgagatgacaagagtgggagagcgagggttggagaggctatatatactagttggtgtagggttttagttcaccggatttacgagtttgccctcccgctcccctcatgggcttccacgatttattccagaaattacggcccgttttaagaccctcatggctgaattcatggcccaagtagttagatcgggcctagtttggtcccgggttgcttggatcatttgcttctcggcccattagactcttacatggctgtgatgcatcgtgggctgtattcttgcagcttaggtgaagtgacagattttatccaataaatgggcccatgtaacacaattaagagcatgggccgaagtgcagggttgcagcttgttctttcggtgtactttttccttaagataagattacaagcctgaattttacagagcagcacaaaggcccagacctcaaccaaagagagcagaaactgaaatctctcaactctccaaagtagttgttgtctcttctacaaatacatcacacttttgattttaatttttgaaaggagctacatgccgtcgtgagttgtgagtataacaaactcacactttgacttgtataacaaagtcgtttttcatgccatctgaaaatgacattgcaacctgcatatctctagttatttacaacagttggttcacctttgattcaggcggttcaactaggtaggtccgtataggttttgttataactttttttttttgcggggaaacaaggatatattactcagaataggagttctcacaaagcaaatgtgagatagcaatacaagagtcatccggccagaagtaagttaaggattcacttcggcctttatttgctaagaaatgattaatgctattctgagtcctgtgcactttattaagtgcaatcacccttgttccagccatcggggaagattaaggggggaagaaggggcggacgctgggacgtgccacgtcggatttttgctacagtcctacagtaccggggctggtctttttgcgaaaaataagttcaatcacctcgttgactacgcacgcatcagcagacaataccttattcactgacttgatcagctggattgcttcttggcaatcggattcaacgacgatgggcagcagagtccattggagggccagggctattccatctctgcaagctagcagctctgtttctaaagctgatctgcagcgactaatgtggccacagcccaaaatttcctggtggccctcttaacagctggggcaacactcttgtcagctcaaaattcagtgcaatttctggagctgattttgagcaactacagactggcagtaggggttgcgttgaaggatattgagccgaaagacattgttcttggtcgatttcttgccctccaggtcacaacacgactgcatgtgccctgaaaatcgagacgttggtgttccttgttgttttctgcaatcattgcatgttatgttattgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactgtattttatatgtatctgcatattccgttagggatatagattgtcttttgtaacacggactcctccccatatataaggggggtccgggtgcctctaggggcatatgttgtttttccccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggttgcgtcaagcttttcgccgatcagtgcaatgggttccatctccggcatcgacgacctcgtcttcccacccgggcagacgtttcggttcggcagcctcgacttcgtcaccaacaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcatcttcaccaacgtcaccagatcaagatgatggggcttacccaccgatcctgatgaagctccccgacgatttggcggccgtctccatcacgacagcgtctctttcccgtaggcctaggcggaagtcggcttcaacaccgatttcgcctagcttcagggaagttggcgtcatcctccaaccactcggcacggtttcgacggatcagctagatggcgactacagctctcctaccgtcgactcgcgccccaccgacatcgtggagtacgacgagtttagctctcgctaccacgacccggatctcgacgacttcgacggaagcctagatgacaactacacccctctctattttggcgtcttcatggccaataacgagacggaggagcaacgccaagcccgggagaccgaagcgcgtcgcgagactgaacgccgccgactggaagaggagcatcaagcacaagaacaagaacggttacggcatgagcagcaggagcgtgagcggaccgcgaaggaggctgaggatcgacggcagcgagctttggaagcaggacgccgggcgcgtgatctcatcggccagcaagatgttgaagggacgccgatttttcgcacccctcaacagaatgcggttgccgcgatcaccctcctcgacaccctactcagggaaagcgagctcaatcaatccgatcacgtcgtcaacatcttgaaccagacgaagactatgattgcggcttcggtcccagttaactccgaaagcgtccacacgccgactggcagccgagtcccccacttccgatctcatgactaccgtcatccaagcctcagcatcaccggcgcaggatccaatcgcaggagcaggggccacgacgagcggtctgttcactcacctcccgaccaccatagggagcgccgagtggaacggcctcgctcaccacctcgtcgccgccccgtcgatcttcgcgacacaatcatacagcgccgcgcagctcgaggctatcatcactcgccggaccgccacgacgatgaccttgacggagtagcagccttcaccgacgacctgcgtcgagtggactggccagccggcttcaagccgactggaatagagaagtacgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcagaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagcttcgaagtcgccgatttcgagacagcataccatgccatactcggacgcccggcattagccaagttcatggccgtcccgcactacacttacatgatgatgaagatgcctggtccccgaggagtcttatccctacggagtgacatcaagcaagccgtcacatgcgacaaggagagttgcgacatggcccaaacccgcgagatagcgtctgctcgagaggatatccgactggctgcagccacggcggacgaaggagaagtgcccgctaccaagacttcaaaaagtggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctggcaaacccagttctagttcggaagaaaacagggcaatggcgcatgtgtgttgattacactgacctcaacaaatcctgccctaaagatccttttgggttgcctcgcattgaccaggtagttgactcgaccgccggctgtgagcttctcagttttttggattgctactcggggtatcaccagatccgactgaaggaatccgactgcttgaagacttcattcatcacgcccttcggggcatactgctacgtcaccatgccatttggactcaaaaacgcaggagcaacttatcaacgtatgatccagagatgcttctcaacgcagattggccgcaacgttgaagcctatgtggatgatgtagtcgtcaagaccaagcaaaaggatgatttgatctcggatctggaagaaaccttcgcgagcatccgtgctttcaggatgaaattaaaccctgaaaagtgcaccttcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactaaagaaaacagatgatttccagtggggacctgaagcacagaaggccttcgaagatttcaagaaactcctcaccgagccaccggtcctagcctcaccacacccgcaggagccgttgttgctgtatgtatctgccacctcccaggttgtgagcactgtcttggtcgttgagcgtgagaaagaaggccatgtccagaaagtccagcgaccgatttattttgtcagcgaggtcctagccgactccaaaacgaggtaccctcaggttcagaagttgtcatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagttccaagaggatacccccgcggagaagatggagcactggaccatgcattttgacgggtcaaaaagactttccggcactggagcaggagtggttctaatttcaccaactggagaaagattaagctatgtactttggatacatttttcggcgtcccacaacgttgccgagtatgaggccctccttcatgggctgcggattgcaatttccctagggataaagcgtctaatagttagaggcgattcacagctggttgtcaaccaggttatgaaagagtggtcctgccttgatgacaatatgatggcatatcgacaagaggtacgcaaattggaagacaagttcgatggactcgagctaagtcatgttcttcgacataataatgaagccgccgacagacttgccaattttggatccaagcgcgaggtggcgccttccgatgttttcgtcgaacacctttatacgccgacggtacctcacaaagatactgctcaaattgcgggcactcatgacgtagctatgattgaagccgactggcgagatcccctcatacgatttttgacttctcaagaactcccttaagacaaagatgaagccgagcgggtttcaaggcggagcaaactttatgttatgcatgaagctgagttatacaagaaaagcccttcaggaattctgcaacgctgcgtatctttagaggaagggagacaattgctgaaagacatacattctgggatatgcggaaatcacgctgctgcacgcaccattgtcggcaaagcttaccggcagggttttttctggcctactgcagtgtccgacgccgacaaaattgtgcgcacgtgcgaaggttgccaattttttgccagacaaattcatttaccagctcaagagttgcaaactatcccgctgtcttggccgtttgcggtttgggggctcgacatggttggtccgtttaaaaaggcagtcggtggttacacgcatctctttgtggccattgataaattttccaagtggattgaagctaaaccggttgtcacaatcacagcagataatgctcgagacttcttcatcaatattgtgcatagatttggagtgcccaatcggattatcactgataatggcacacaagtcactggcggagtttttaaagacttttgtgaggactttggaattaagatttgctatgcctcagtggcacaccccatgagcaatggacaggtggagcgagccaatggcatgatacttcaagggattaaaacgcgtgtctttgaccggctaaaaccctatgccggcaaatgggtgcaacagctgccatcggtgctttggtctttgcgaactacacccagtagggccacaggccagtcaccttttttccttgtctatggggcagaagcaatgttgccgagtgaagttgaattcgaatctttgcgctttcgaaatttccgtgaagaacgctacgaagaggacagagtggatgacttgcaccggttggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattatcataataatggagtgtgattttttatcaattcaatttgcttacttggtttatcattgccttgttcgatttttctacttagtctgcgaggactgaaagtttttaatagcttctttgggttttaggctcaacaaagcttgataaaagcttttaagaaatcaaagatttggctggaactatcaagcacagcataaatacaccagtattgtacaaattgagcctccatttgttacattcatactcagtcagagtcagtcctttcatcatcagagttattgttgctcggctgaaggtcgttgttgtggaattgctctacaacgtcacttgcaatcttgtcagccgcattttgagcattgttgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattaaggaacatagcttggacaagtggtgtagcgacattggcaacttcatctcttgctccttcaagcctctggatcttaccaaccaggacgtcaaactgagcttgagatttgattttacggtctacaaaacacatttataataagaatctgctgcattaaaaagaggaaagttcagattgtcagctggcagtaccttcaacctccttcaaggccgagtccctttcagcagctagttctgttttgtcttttctcaaggcttcaatttgcttctccatttgagccatcctggtggcttgcgctgtttgaaatccaaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacggcttcaagagttcccaaatgaggaaccagcttttctaaggttgtggtcttggcctcattgcgaagatggattctctgcacggtggttcatggattagttttgctaacgagaaaacaaagtcattaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcgccagtcggctgactttcggcagtcggctggctttcggcagtcggctggttttcggcggtcggatcagcatctttggataaatttgactctgtggcagccggatcaggattttttccagttggatctatatcggacggtttcctgcaaagtgtcctttcggtattcagcgtaatttctatgagagaagcatgccgaaataaaatggtaccgagaagtttatacctggaagatgttctaatctttggcatttgacggccagccagttttttcctgggcatggtatgctttgggagtttattgggcgtgcccttgtccccagatttgttgctgtcatcgccttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcgaatgctgtgcgggatctctctttgattggagctaatcgacacttaatgaaatgccgagtgatttgctctccctgtaagccttgctctttgagcttcagcatgcgttccatcagttctaaggcttgggcagcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgtttggttgaggcttaaggaaaaagattcggcggaacagagcaaaatgaggtctaatgcccaaaaaagcttcacagacatggacgaaatttgcaatatggactatggagttcggattcaaatgatgtaagctgattccatagaaattcagtatcccacggaagaactttgaggttggaagagcaaatccaccataaaagaaatgagagaagaccacggcctcgtgtgtatcgggggtcggaaaagcctcatcgcacgctggccgccacccgatgatctccttggcagggagaacgccgtgcgccaccatctccttcaggttctcctccgtcacgtcggacggcgcccattggccttcgaagctttctttctcttccgccattgattttccccgaatacgttgatttgattcgagggatggcttgggagagatgaggaattgaggcggtggatcacgggaaggattttgatcactttttgaaggtggatttgagtggaatggtgaaccctagtttgccggcgtagctctgtactgtagcaaggagtggggaaaatggcgagagttccggcggggaagacgaagtgtcgcttggatctcgggttttcttgttaagggtatcggaggtgcgaatgggcctaggcctgaatagtatctcagcccaatacttttaacagcgtggcccattgtgttccttagggacttaggcattttttgctttggcaatttatgtacacaatagtgttgcccaatgctgataaaatcctttttacgcggtcatataattctttggaattattgcaatgcaaattaaaaggtgcccgacagaaaggcgttatgctgtttttgtacgtttttttaggctacaaaagctgtctgggttaacttggaatgacttgtttttatcatagtcatttcctcggtatgttatatgcctgttttcattgtggtaaatagtcatagcctaggctattagacttattcattaccatgatttttataatatttggtgggtaatctttagagtcttatattcggatgcctgtcaagtgtgttcattcgtgaactttttagagtgttaaccacttggatttcttttattatggctaaaaagcagtcggctggaatgcctctttaggcgccgtgtatgcttttgtcatatgatgcataattatgctattattttgttctcaactatatgtttagtttgttaactaatcacatagttggaggctatacctaattaggtgcatctattcgatgcaccatattctttatcttttcgccctttacagtcttcgttttcgctactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatatcttatgtgtatcttgggtttgtttctcaacttgtgcatcaaggaaataccctgagacttagtcggtcacgactatattttatatgtatctgcatattccgttagggatatagattgtcttttgtaacacggactcctccccatatataaggggggtccgggtgcctctaggggcatatgttgtttttccctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttatcttacacttaagatcgatcgaccgggcacacaggtatcgatcgatcgttctttaaacaattgcattattgggatcaattatttgggaaccatttctcggagaatctgtatatccgatacttaaagaaacagaattattggagatacacactcatagctaagctgctgacaatgcacaacaagtgtcaaacagaaacatccaacagcatctcgactctctctctccgatgactcggacagacactcaacttaacttccttgccctcagctgcttcatcaagctagtgacaatcagtttgctcgagctaattaagaaattgattagtccatttgggctactagctggcacctggcaacagcatgtgccaatcattaggctatgccaagaactcaaagctgctactagctcaaatcagtgtgctagctagctaaactccatgaccatgaccatgagagagtgagcttgtgatgggatgaggttagatgagaggaggagattccggatctccatgagtggtggggctgagcacagccaccagatagaattatttccttggggcctacagtgtcacttttggcccccaccccaccatggctagctgacatggcatctacaaatacagtacaatatatggcgccaacttcagatcagcctcaaactcaacatgtgatgaggatagattgctgatgtgctgtattgctattctagctctatcaatggcagtgctgttttgcaataatgttcatgaaccagaagatccagcagcttagctagctcaataatgctactagttctgaattgcctagctcgatctattggcggcattcactgttggtctactggctagggttgcttcttgtcatgcgagaggccacaatttcttgaagaaaaaaaaaagaacgaaccatccacgtggagtaaaaagcaacgacgacgctttcatcacacaagaggacatccttatttaatttgagaagcgaccattggaatgggtggaataaatcgtatacgttctacctgccaagatgcacgcgtgaatctcactctttaacattattattattattatactaatccacgtgtgttttgaataatgcagcaaaattttcaacaggtctgaaggtaacatatagccacgagtttggagaagatgaggggctgatgagatgtgatgtctagctgcaatcggcgacccatgagccagctgatatatcgctcatcataatcacattcatattaattaaatgactaattggcaggctactactccagttaatagaatgaatgaatcgtgttttttgatgccacgtcgagaccgaagtttgcattattgcaacacgacgtccgttagttaggcgcgtatatgtaactgtcagcacccatgccatatgccagcactttaccttcatctcatcagctttatatgcatcgaattgctgtcacaagtcacaacatcaactgctactatacatactagctagtaacatggatgtctgctaagagcatcccagcagctcattcaaatttgatcctccatatgctcatatggatgaccatctaaaaagattcctcattcatatttcttctcactccaacagatcatctatattgcatctttcatatcacacccttctatattttactaatatttttcaactaaccatacatttgtattattttttaaagactatattttaaacaactaaattttaaattttaaccgtgttatttatcctgataatttaaatgagtttattttaatgaatatatttttaatggtccggaccttttttttctcctcctctctactcgttttctttcctctttccgattcctcttcttctctcctcttctattcctcttcttcttctctccttttctccccagcgtggaggcggaggctggcggccgcggcagcgcgacgggagcgggggcgctgcggcgcgacgggccgcggcggccgacgggggctgcggcgcagcggcgctacgggctcggaggcgcggcagccgacgggcgcagaggcgcggcggcgtgacggccggcgtgtagaggcacggcgacgcaacggccggcgtgggttctccttctagatctggtatgtctctccctctccaccctcactccatagtgaaaaatgcacatccggacggcgacgacgacgacattggggaggtcgcggcggaggggaggtcaatccggactccggatgggggcgggcgacgctggcggttaggatggtgtgaggagagagaaacttcaaatttgacgtttctctctccccggatggaggatagctaaatttggatgctaggatggagtatctgctggagctcatttttcttctcccaacctctattttgtggatagaggactagatggagtatctgctggggatgctctaatatatactatatgcactaataactccaatataggaaaacacgtttctacatacatatatataggagcagtgatagtgattactacatgattacatgtatgcatgtagtactggaaaattaactgaacagagtgacccgtaacaaaactgaacgaaataggcttggtttagttcccaaaattttgttcacaaaaacatcgtatcaaatctttggacacatatatggagcattaaatatagataaaaataaaaactaattgcacagtttgcatagaaatcgtgagacgaatcttttaagcctagctaattagtccatgattagtcataaagtgctacagtaacccacatgtgctaatgacggcttaattaggctcaaaacattcatctcgcggtttccagacaagttataaaattagttttttcatttgtgttcgaaaactctttccaatatctggttaaacatccgatatgataataaaaaaattttatttcatgaactaaacagggcctatggcagattgagcgcatgttctcctacggcgaagcaccatgcatccatgttctcctgtctagctattggcctcaagatgcacgtacggattatcaaactgatccaattcaatgtactgttagcctaactgcctaacactagtccatatatatttctctgcttttccctccaatcttcattcacatgacaaattccggtaagtctttgtgtttacgcgtgcatttctaccatgcttatatgtaccatgtttcgttttatttccagcctggtttctttcatgaaaatataatgatacagatacaaacaaatcttataaaaactcggtttcaaactcttttttatataaaaaccggtgtggctgcatcttaaaaaggattatatcttgaaatagtaacaaaaagaagtataatatagtgtgtattacgggcgacgacaagatgggttgattacattggaagtttatagcgcacgtcaattagggcatcctcaatgtttgtggtgtaatgtaaccttaaggtgggccctataaatagtgagtcattattatagccatacccacaatgctatggttaaaatttagccacaagatggcccacttagaatggaaaaataattgtttcatctcttgttcatgaagtgaatgagagagaaaaaatattttctttttgtttgtggtagaacttaagcataaggtgtaccctaagctaatgctactttccacaatatatatggctcactttacaaatataatcattgccttaaggtgtcgtatcggatggcttgcctaccaatctgcctagtcagcatcgaccaaagcacaaacacgtgtcgcgttggaatcgatcgcctaattaatgtgtggctcccacgctcacgacgacgtggcagcagcccgcctgcctaaatgtccggaagcaatcacagccaccattttccacttcccccatcaatcatcaattggatgatgcatgaatgccttccttttttttaaaaaaaaagaaataaagaaaaggcaaaagctttgccttgtagtaggaggcatgaatgccttctggtatcaattcttcctcaacaattactcctacctatctgcaaataaaataacaatactacaagatatcgattgaagtcatttctcacatctctcttatataggtggtgttcttttcttctaaagataaagatgaagattaagtttttttttacgtaaaatgagatgatattaacatatggtagattaagttttaattattacaaacttaaaaaatagattaatttgatattttagagtaactttcatatagaaagttttcgtatgaaacgcaccgtttagcagtttgaaaagtgcgtcacaaaaatcttaatcttcatctaactcttgttggagaaaagaacacggccaaatgttgatgttcattaacaccatagtatataattcccatcctaggtaagcgcacacatatatatactacatcacattttgtattgttctactccaacttgcttgaactaattaatggcaatttactccctctatcatcattagctaaataaaagacgcgaaaaccaaagacaataaaatctctatggttttaaaattaattctcatcgatcaaagtgctctatcaccgtgtcccgcggattttgcatcatactttaaatattggatggagttgcaccatcagaaattaatcttggatagctgcatatatacggtggctgcatgtgtagcgcattcaacgacgtccattcactctttcacaaatagacgaagagagacccctattatatgatgattattttgagaggatcacaaaaatattaggtaaagattatacttggacgtatttgtataatccgcatcagtgaagctaacaaccaactccgcatcactaaaattttgtcacaaatttaagaacttatggttaatttgtgtttgtggtgttttcgctctttgtcgttgataggctagcaggcattccttactagtcaacatttgtcgattttgaaatttgtggccaaatcattactgcaacgaaagaaagcttttcatttttcttgcgaatacaaaaggtggtggaagaaagaaagaaataaggaagggagaaaatgtaaacgttttactaattaatttgcttgtgcggcccaattaatctgttggaaaccatcgccatcaattcagaaacaattaacaccagatactacacatgcattgtttgtgggccactgaatcatctgaacaaaagcaaattcattttcataccgagtgaaaagagggagaaagagaccgtgcagtgtggttgtgtaagagataatccgataatatagctagtgacttggcacaaatttcaggccggagaactattccaccacgtggttgatctggtctactcttaatttcaagccaccagctaatttgttttggattggccagctactagactggttgatgatttaccactactactttttataaagagaaaggcaaaggattactttattgataaataaaataaaacaataaacattcaacagataattgccgtggattatatacttgattatggggtaaattaaatattttgagaaacaaaccaaataaattgtagcttagaacaagtggtgtaaataatgcagtagaaatcttttcagaggcttggtgcaaataattcatgacaataatttgacaaattagctgaaaagaaaattaataaagggccnnnnnnctgaactttgacctagcgaagagacaacttacggacctcatcttttcacttatgcttatgcttatcagacaaaattttaatttttaaccttaaatttgaggctgattttgaggttttttcatcaaagtttatttttcagcctttgcttttagatcactaagaacacgtacataaaagttttattcacatgttacttttcgttatctcattatggttcttgtccttagttagttattacataaagagagtaaaaatggcttatacacatatggctgttgtataaatcattgtgtttcctgtggtaattatactgtggagtgaagcacagtcacgagttttcactccaccatcgtcgtggacgtacgtgtggtccatagcatatgcgttttgatggctccaatatatacattcagtagtcttctcttccaatcgtacgcgttgcattattgtacttggttgatttaatgccatttcatatccatatcacacgtccgctagctaaattaacattccaagccgccgcttcccccgtcatagaaatgaatcaaatcattctatcaactgaacttattatatttgtgccgtgtgaggcattatacatgcgaaggtaactatagatatcattactggcattgtgaccaatgcaatgaactcgatcgtaaggtgagataacgcatatataatttgtagactatgttactgatgatacatacatattcgatcagcagccagcaatacgtacagttccttttctgaatatgtttgtctgaagattgtgtgtatgaaagtcacaggttaatctactccatgctagcacagcagctagcatgcagcacctgtggtttgggttatcacaggtggacatttgatcgatgtatccagaatgtgcagattaacgaatgaaacagacatgacatctgctcgctgctgctgctagtggtagagatcgatcgctgcagctgcatcgcatctgcgatcgatcgatccagtcggctgaaggcacatgtatggcgatgcgatcaccgaacgaggattctgtctgctatcagtctcagagctagctagctaactgacgacgaaacagcaaatcaataatgctagctatatagctagtgccacttggcataacaacaacgatatgatgcagagataaatcatcatatatccatggccatggcttatacactgcccatacaggaaacggagtatatggtcatcaatcaatccatcgctttctcaagttagctgaatacgaagttggcaattactattaattactagtttctttttttcttaggtaatggatatatataaaaatagtggctggaaatagatggtagtcgttgccctttattagtctgtactattttctgttgtgttgttttcggtctctaacgtgagagcatgtaggcaggatcagggcacattttgtccaatttcaccaatgtgtgttttgcttgtagcctttcgatcatttcatttgcttgctgaaaagaacaagctagccatgcaaggcaacgaaatcaagagagactgagagaaagaaaaagaaattaagaaagaaagaaagaggaaatggagggtttgcttgactactggaccagcagcaagcgatcgacagaagagcacaagatagacttaattggcagccatcgtcgattcgcaagttaagaaaacgccgataaattatttgtgggccatggaatcattggtgcatctcgacaacaataattcactttctttctcttgtccatctcttcttcctcttctctttcagagagaggacagagacagagagtgaagagagaatccaatagctgtgacgtggtgcgaaattcaggggggagaagagctcaaaacttcaccaccattaagtgtcaccttccctccacgtggctggtctgcccttacatccatcatctacgcattggccaccgattgaattgttttggatgatttaagggattggtgagggatagaactgagttcatgatagttattatttcgaggatttaaatgaatgcagtaatgaaattgcggatctcctgcttctttgaaaaaaaaaatgaatgtgtcaaatattactccctccatttcatagtataagttattttgattttttttcttaagttaaatttttttaagtttgaccagtttatagaaaaatgtaatagttttttaagaaaaaacaaacatttcattaaaacataattcatgttagattaaataaaactaatcagtgctttaaatattgctaaatctatctataaacttaatcaaacttaacaaagtttgaccagaaaaaaataaaacgaccaatagtataaaatggaagaagtagaaagttaataggtcgattttaaaggttctttttcatagcgtataaagttctctagctaagaactgatgaggatttttttaaaaaaaacataccgtttagaagtatggaaatcatatctatgataataataaaggagtagttatatttatggcgtcatattttttactgaaaaataattgataggctagagcagtacctaaatttgatggggactgaattgagttactgctagtacgtcctgactcatcaacatctcatagctagtagctaataaggattccggccaattggttcaaggtgtgacgagcggttgatgcaaggcgtagagtaaacgtgatactccctccgtagaaaattatagagcatgtttatttggaaaaaggtatcattctttaactattcgttgtgcataagtatatttataatatttatggaaccaatgttttatgaaagctttttgaaagatgaatctgttggtataactttatgcactaaataaatatacctgtagctagtttggctaattgatcaaaatttacagagtttgactttatacatagcattgtgttccttgtgctgctaattaattaatgagtaaattcaataaaacttcatatattatagtctaaattacacaaaaccacaatggttttaacacgtggacaggaaataaatactataggtgccggttatatcatttccagcacctataatgccgacttgtacgtctttatatagtagtgcaagtatatattatggtcgtaaagttttacaaactacactatcaacaattttgactttgatttaccatgcatacattttttttctacaatcacatgttaaatttataagttttttatctatcatataagtgttgcatctgctttttaaatttggatacatggtgtatgtctaaatattaattgaaggtcaacctataatactcagagttatatgccatatgtttgtgtaacttagattataatgtgcaaggttttatgaaattgacttttaattagtcttctactaatgttgagtaagcagctagcctttttcctcttcattaagcaagccactatataggtaaccaattcgtgcttttgctggccttctgtctatgttactccaataaagtttggtagcgccgccgaccagagcagctggctaataaaattaaagaataacaatatatcatgcatatatatattagtagtagcatattagaacttgcaaattgcaatagattgaaccaggattttggaagggatcgatatataaatatcgaagctagatccggacaaagcgcatgttatataattatattacacacgcatgttgctgagttgcacaagttaaccatgcattcttgtctctgcatatacacatacctgctaactgcaatatataataagccatagtatatacatacatcacatgaccgattctctgttggagatgcaaatcaaaacatgcctgacatttgccatggtataatggtgtgcatgttataatttggcaaggcattgaaactctcattcaggtagtatgtgtacatgaacagcatgcagagaagaaatttaatatatattaattagtataattattatacagatttcacagctgagtttgatcgatgcatgaactgtgtatatctgtcacggtagtgtgatgaaatatatggtgggggcatccaaagccagcccacatgtcagccagctgtagatccatcgatgctatgatgcatatatatggactatatatactcgctcgaattaattatgcgttacttatttttctctgcgcgtttaatcaaacactattaattagtacagtattaaactagctagctagcttagacagcgtcacctccatccatggtggggtagctgcgtacatgtgctcctgctttagctagctcaaactagtgcatctatcaacacaacactaatcatagcatgccgtcgacgccgcatttaattatagaaaggactgcctaaccggccatctcttgacagaaataaataccctaaaatcatgtgaattctaaaccgttagatcactatagatctgtacagctatattcttctctctcttcaccgctaactctgtttgagtgcacgctattttcgacattgagcttctcaatcctctaagatagatccatctgtcaccgcttcgcaggcgccaaaaaagcctactagatcaacctcctctcctcctccgtgagcggggtgtcaccccgttgtcttcctcgtctccaacagctcctacatcgtcacccgcctaataactgattaggatctctcacccccactgtcagccctatctgtcaccctgccactaatccgtggcttagatggtgtggacgttgcctcgtcaccctcccgctctgcagccaccaaacattccctctaaccctagcgaactttcctagctagcccccttagaccataaaccctaactgatcgatccaccgctagttactgtagtgggagaatcgaggagccaccgctagaaatcccccctccgccttccaatacttacggaatgaattaggttagcaactatgaatcacaataagttagagcacgtacttatttttatttataataatgaagtagcgggttttcccgcgtaatttaaaattacgcgctaaattctaaaattaaaaacgatatttgacatataacaatgatttctatttctacaaatatgactagctagcgtttatatacaactataccgacaaaacatctaacattaacttgtatttctaacaaaacaagaaaaaacaccatgaaatttctatgtggcccgggcagtgaagcatgcagtgtgtgacgcgggactccggtgagataggcgaggaatctcctctcgtaagattcacctactcttctctcgtcaaattaacagcctatcgatgatcgattaacggaggctggcaactgggccaaataggcgaaacaaccaatgggcccgcgccacgtgcatccagcatcaatccaccacataataataataactaaataaaataaacaaataaattagtgatggatccgaactctaatactagtattagcaatacaagaaatagaaatagcaattggatcggaggcactataaatacatcctccgacccctcgccaatcccgcacacaacgcaaacgcaaactaatctcctcttctcctctcctccctttttctttcttgtgctaatattatatccatctcgcggcgacgcgacgatcatggagacccgggacgacgtcgccgacgcctcggcgcttccctactcctactcgccgctccccgccggggacgccgcctccgccgacctcgccgccgcccgccgttcccggaggcgcccgctctgcgtcgccctgttcctcgcctccgccgcggtgatcctcgccgtggcggtcctctccggcgtcaggctcgccgggcgccccgcgacgacgacgatggtcgtcccgggggtggtggagatggagatggcgagcagggggccggagtccggcgtgtcggagaagacgtcgggggcggaggagatggtgaggctgatgggcggcgcggcgggtggggaggcgttcccgtggagcaacgcgatgctgcaatggcagcgcaccggattccatttccagcccgagaggaactggatgaacgatcccaacggtacttaatttctttgcattttttttcttttattttccttcttcgatcgatcgattgattgttctcatctcaattcgttcattccttccgctctgttcgttcgttcttctagatctgacaacattcaaatgctattaaataaattcccattttggaggaacgttttatggttaagattcttccagccccattttcctttttttttatttatttttgagaaaagatttaaaaataaaaaaggaaaaccgagatacccttaagattccaaccgcaccaaccgaccaggcattgtagaattcgaattacaataatttttagatagataaaattcaaattacattatataatcaaattaacattggaaatgcaatgcaggtccggtgtactacaagggttggtaccacctgttctaccagtacaacccggatggggcggtgtggggcaacaagatcgcgtgggggcacgcggtgtcccgcgacctcgtccactggcgccacctccccctcgccatggttcccgaccagtggtacgacgtcaacggcgtctggaccggctccgccaccaccctccccgacggccgcctcgccatgctctacaccggctccaccaacgcctccgtccaggtccagtgcctcgccgtcccctccgaccccgacgaccccctcctcaccaactggaccaagtaccacgccaaccccgtcctctaccctccccgcaccatcggcgaccgcgacttccgcgaccccaccaccgcctggcgcgacccctccgacggcgactggcggatcgtcatcggctccaaggacgagcaccacgccggcatcgccgtcgtctaccgcaccgccgacttcgtcacctacgacctcctcccgggcctcctccaccgcgtcgaggccacggggatgtgggagtgcatcgacttctacccggtggccggcggcgagggggtggacatgacggaggcgatgtacgcgaggaacaagggggtggtgcacgtgatgaaggcgagcatggacgacgatcgccatgactactacgcgctggggaggtacgacccggcgaggaacgcgtggacgccgctggacgccgccgccgacgtcggcatcggcctccgctacgactggggcaagttctatgcctccaagaccttctacgatccggccaagcgccgccgcgtcctctggggttgggtcggcgagaccgactccgagcgcgccgacgtcgccaagggttgggcttccctccaggtacaccttcattacctctctaaactattttaagtttaactaagttcatggacaaacatatattaaattagtttcatcaaatcaataattaaatatatttttataatatatttgttttgggtgaaaattttactacttttttctataaacttagttaaatttaaagcaggaatttgactaaaattaaaaacaacttataactcgaaacggagggagggagtatatattaattaatccagctactactagtaattagctagcatgcatgattagctaggcatcattggcatgcatatgtgcacttttactgggctccattgacacgttggatcgacgaacaacacgtacatatgcatatgcctgccggagtgtagcgtagcaatcaaataatggcagccacttgtgaagagcgagagagatgacgcgaacaaacaaaaagcttgtcatgttggttgtcaaaatgtcgcttagcttcatccaggaatgaatgcggatatcctgttggggccccactgctcagctaccgaccggagcaactgttgagatacccttttttgcaataattgacataataaacagatcgtattattattggttgatggatggaattgcttgtgtccaagctatagtcctcctagcaactgttactactagtaggaatagctgtccttgcccataactcatgtgcaaccatgtgctgtagctgcattctgcttgtctttgctgatgctttgcctaactgaaatcatttgcacacacaacttaactgggattcatagattgcaaccttttcttttcaccagaaaaagggctgtcttttttgcttgcttttcaatataattccaccgctctcattttctttgctgtcacagtactgatagataatgcaaaatcgcttggttcatgtgaagcaagctatagtaataataattatgattaacatgtgtaattaaattactggagtagtagctaattagtaaaaataaaaaaattggcatgcagtcgattcctcggacggtggagctggacaccaagacggggagcaacctgctgcaatggccggtggaggaggtggagacgctgcgcaccaactccaccgacttcggcggcatcaccgtcgactacgcctccgtcttcccgctcaacctccaccgcgccacgcagctcgacatcctcgccgagttccagctcgacccgctcgccgtcgacgccgtcctcgaggccgacgtcggctacaactgcagcaccagcggcggcgcggccggccggggcgccctgggccccttcgggctgctggtgctcgccgacaagcgccaccgcggggatggggagcagaccgccgtgtacttctacgtggccaaggggagcgacggcggcgtcacgacgcacttctgccaggacgagtcgaggtcgtcgcacgccgacgacatcgtcaagagggtcgtcggcaacgtcgtcccggtgctcgacggcgagaccttctccctccgggtgctcgtcgaccactccatcgtcgagagcttcgcgcagggggggaggtccacggcgacgtcgcgggtgtaccccacggaggccatctacgccaacgccggcgtcttcctcttcaacaacgccaccagcgcgcgcgtcacggccaagaagctcgtcgtccacgagatggactcctcctacaaccaagcctacatggcctagactcctctcttcttcttcttcttcttcttctccattattacattattgctgcttacttgtaaatcatttttgacgccgccgcctgctgctagctgctggcctggccttcagaattttatctctttgcttctttttttttttgtctctgctttaattttgtatctcgatcgatctcgaccgatcgattaattactatatctccatgaagaaatgcatggatgatggatcatggatggatcgctcccttcgatccaactgtacctaggggaagaagatgccatggtcaagcaatacttctgtaaatgtttcacatgagtcaagatttatgcagagttataatatatatgtttctctctccctccctctttgcaaacaaaaagtatccaaatgaagaatcctctcttaatttgcaccaagatagagacacgcacaaaaagagtttcgcggcccgtgatagactgatgcttcttacatcttgctggcctgggttgtttgcctttttctttttccctgatttctttatatttgttttcagcccgcaaaaagaaatacagaaatgcacatgcttattattctcacatggatgcaaagcctgggacgtggcaaatgtagcacagtacatgcttatacagctacaaacaatacatgcatagatcagatttttgtcttctgctttatgttttttctacaccgtgttgagtttaatatatcatgttcttgacgagccaaaatacaaacaaactgccgctggaactgttaaatgccaaaagctgctatttgcagcatattaagggaactggggaggcagctagctagattggttagcagctcagcatgagtatcatcagtagtatctcagagaaatacatttcaatgcactgtggacacataccttcattgaacaacagctcagcctgacactgcgcatgctcacaaagggaataagggaaagtcaaattgcaacttcataaccgattttgaattaaacccattgaacacgctcatcattcgtgcatcctttctttcattttctgtaaggatcagatgatgaccaaattagatgagaaccaactgtaagattttttttttcgaggggaaggtcaggagttctgccgatttcaattaagtagggggaaaacaaagttttacaacatgcaaagtccagggtttggggatcccttggatacaactgtaactgtaagaatttccagctgcaattagtttttcttaaagaatcagatgacaaagaaatcagatgaaagcacctcatcagagacgtacaaacattatcaggtagcactttctgacaacagaacaaagcatggattaattccctgccaagactggtgccgagtaatttccagatatcatcgagccattggaaggagtcaaaccaatagtaacactgcagatgttagatcaatgatttgaatcactttgttagctgaagcacactgttctcattggcatcttcgttcaacaaactcaaggaagatctcaaattcataagtggagagcctgttcaatcggataaccacatatatcctgcgcatttttacaattcgtaaccaacctcaaatgttcatatagatatatcaatgatttgcactaagaaacgaaaaatgatcagcttatcagtactttgcatctgctgtcaagatcaatatgcaagccccacaggaactactgcaaccactgggaataaatgaaatttgaaactggtccacttgaatcgcaatcacttatctgaccatatcagagtgtggtgtgttcataactacacatggcccatttgccttttttaaaaaaatgcacgcacataatatacattctaaatgagtttttgcagttccaatttcaatcaagattgcctgaactggaatattctaaagaggcataggcagcaaaaaggtaggcagcatgttgctcacaaaaataatgatgaaacgaaaacaattcattgaatttaagtagccaacgattcttttacttctatcatggagcagccgtttagcggaacaaggccagagacagagatgtaccaagccctctggagagtcgcagctttcaaccagagaaatgctctttaccatccaccggtgatccaaagaaaagataacacatatcctgggttatcaccacttcaccataaaaatgaaggatttgggactagcaccatggtctcaaaaaaaagagagagaggctatttctgacaaggtcacttcacaagtcacaagatatcttcatctcaatggtgtatgttcttgtcctctctggcattttatgagatattgtacttattttcaattgcgtgatcttactgtcatataactgcattgtgactttgtgaggtggttcagcacaaatttccatctttatatcaagaagacatgaccgccaacacaaactgctataaagcaaaagggtagtgctgcatctgcatgtcaatgtgtccagttttctaggcagtacacgaatttttcaattatttggtttgccattctccttcgtctctctctcagcagggatttgaacatgaggcagcgaccaccatacttttcttcatgtcaaattaatgctagaaaatgtggattggcacttctgctgtgctgtcaaaacttgcctcccaaccaggcaaccaccatgtaactaatttaacaaaggctaatcagaactaccttcctgaaacacagaattatgatttcataaacacacctcttttcaaccctgcacctgcagggaacatgagaattcttactttcaggtgcagactttcaggaaagccaaagaatctgatctaaatttgaccttgattaacccttttcctttcttcaagtaggctgaaaactctggttcatatttcatactagaagaatgtgggggtgtaagctggattgacaggatgattaccagaagtctccgcaagagcacgtgccattgttaaacttgtgaaatctgacagcatccctcacaagaatatcacggcaaatctggaacgctaggaacgatttgaatttcaaatccaaaaaattgggaacctctgcaggtatgccatgcagctcaggcaatgatttatgcatatgagaaagaagcaactttggaagaaacaggtaatactgccaacaaggaacaacagcaagtagaagtcacaaacttatctcccatccctgcaggtatatttggtgctacgttgattgatttgtgtgtggataacaaaacaggaattgatctttttgtacatgatccagttatcccaggctgccatctggctaaaagctattagtgtgaattctacttccccttgcaggctgagcttacagatctctgggtagccttaaaaatctgcagtcttctcagcttggtgaatgtgatcttctcactgataacacaacaattgctactatcttcaagcaaaataattttcaggagaatctatgatattggagcttgaggccgctcctatcaaaatttcaacaaaatttgcaggatcagcaattgcaggtcaaatggattcctacaagggcaaatgaagttgctgataaacttgcaaatgaggcaagaaggataagttgttatagggctagaactttcagtttttgtcacaatagttctcatgtttgctatcaatctagatgcccaaatacaagtgcccttgtaaacctctgtcttgaagagcaaaacataatgcatgtattataatagaagtcatgaattctaaagaaagagaagacttaaggttgttggctcaaataagaattgccaagatgttaaaagaccaattgccaagatgtctatttgagaccatactcatggccacatgtagtgcgcaagttgcataagttcatcaaaacggcgtagcaataaaatttaatgacggttctagtgtcctgtggtttttcagaagataataaataacaaaaaagggcttatgcttaaaaagcagccaatttacttggaaactaaagtttctaagattcgttttttagggaaatcatccaagaaagcatattagtttattgcaaaggaaagcatattagtgacagcagtaaatagctatatctttatgtatttctgcagaaatcaatgcccaaggtcatatgaaagaaatcagcatataaatgacaaaattgatattgataggtgctggaagcctcaaattactttatcccgttggtgcttctatacaatatgatcctaccataaaagcaaaaaaataaaataaaaaataacagcttgagacctactcttttcattgagtagtaacactatttttttatctcatgggtggtgtgattaagcttatggataagaaattaataagacattgacataaatgtagcacctgagtacctaacaataatttaaaactaaaaaagaagaaatatatgcactaaccgcaattgtgtgtaccaactattttgcatccatgtacatatgcggttgagtttttctagaattcgactacctaggctgctgctgcgagtgtggtgtatcgatcataatttgcaggttttagtccttgcagcctagccaatgtctttgagtatggatagcgacctccttgaactcctccctcgaaagccttctttgaagggtgagatacacaagattaccctgagataaaaaacttgttcagtaaattagcaaatatatcatgaggcaggtgtgtgtggatagacaataaaggtacagtatatttagtactattcagatacatggaaccagtcataatgcagtccttaatatttgtcgtaaatatctgactgattctgacataaacactgtcaagcaaagaagcatatggattcaaagcctctttttttttgcaaaataattcaannnnnnnnnnnnnnnnnnnnnnnnnnnnatctgagttgagtaggatttcaaggaacatgtcctctttgagcaattttatagccaatttagtaaaaagctctcatcttatttacatttttaagaggatatttctatgacaggcattacattggatcatagaaggaatcaacgagatgctgacctttcttctcaggaggtgatacttcccttttaccagtgacattttctgctttatgaactacagagtgagctaggaaatgcagcagtagcttccctccctacttcatctactgactgcactaacggatccaagcaagaaaaaaattcttccttggagatattatgatctatatacttggattgaactgaagaaatttacagaaaaatgtcagtgcaaaaaaacaacacacagaaaaactcaattagagaatggatatcagctattgagcttgcaaagtgagaggacctggatggctcaaagccaatggctctgaccggaggagctcgcagcgatcccttctcccatttcaggaaagccaaagaatttgatctaaatttgaccttgattaacccttttcctttcttcaagtaggctgaaaactctggttcgtatttcgtactagaagaatgtgggctgtcagctggattgacaggatgactaccagaagtctccgcacgagcacgtgccatcactaaacttgtgaaatctgacagcatccctcacaagaatatcacggccagttatcttagaaatgaacttggtagcattgtgacaatccacacatacccgtagattcttgacaatccgaattggcatttcttgtggaacaaagattaagccaaaggcaattgctagcttctcgctgtgatggctaatcatgtgaaccttatcagcatctgccacatcatgcagcaccgagctgacatcaggcttgtatccttcttcagccatctttgagttgagccactctagcttttcgtatattctactggagaaggggtgggattggtcatcggctgaaaatatgtgaactttgttcttgtacttgatccaactgcagcctggttccttcttcacctgcctgtccctcattccacgtctaagatgagcgacttcagtccattgacctttagcagcatgcatgctacacaacaacacatagctggcagggttttgtgggtcagtttccaagagattctcagctgcccacttgccaatctccatgttcccacgcagcctacacgagctcagcaatgttgcccatccaaaggcatcaggactgtgtggcatctgctttatgaattcctcagcctctttgaacctccctgatctactgtacaagtcaatcatacaagtgtagtgatcatctataggaacaataccgtggtccttctgcatggaatcaaagtagtcgcaccctttctctacaagtcctgcacggctacaagcagaaaggacaccgataaatgttaccccatcaggcttcaagccatttgccaacatcttctcaaacaaatctatagtttcttttgccttcccaaattgagcataccctgtcacaagagcagtccaggagacttgatcgtggaaggacatctcatcaaataagcggtgtgcatcctcaatgctgccacacttcccatacaaggtaactagtgcattggacactgtaatgtaccgcatcaaccctgagacaagtgctaggcagtggaactgtgcaccctcttccagacttgctaaattagcacaagaacttataacactgcctagagtgaaatcatcaggcttaatgccatccatttgcatctctgagaatgcccggacagcctcctcactgcaagcattctgtccatatccaacaatcatcgcagtccacgatatgatgtttctgcatgtcatcctcctgaaaacagcctctgccaatctgatgctcctgcacttggagtacatgtcaacaagcgcactcccgacaaagacattatcttcataccaagtccgagttatgtaggcatgtatctgcttcccttcttccaaggcagcaagggcaccgcaggctgtaagaatgcttccgaaagtgtactgatcaatgccaacaccctctgccctcattctcctgaaaacatcaagagcctccaactgcaaaccgttctgagtcagtcctgtaaccatcgtagtccaagtaatggaatccctgtccaccatcagctgaaacaaaccctttgcatcctcgatcatcttgcagcggagcagccctgtgatcaaggtattgtacatgaccacagtcttggcctccatttcttgaaacacccgcctggcatccctaatgaggcccatcttggcatacatatcgaccaacgggctcccaacgaaagcatatgccccgaacccaagccgcagtacctggcaatgcaccgagtggccaagcgcgcggtcggagagagccgaagcgaccatgatcatcgccgacagagtaatccgggttggcctgacgctctcctcccggagcagcgcgcggtacagctggaccgaccgggcaggagagccggtgctggagaagccggtgatgagcgcgttgtaggagacggcgtcccgctcgggcatcgaggcgaagaggcgctccatgtccgggacgagccttgagtgggcgagcgccgagaggagggcgttgcgggtgaagaggttggggtcgggcatttcgtcgaacacgcggcgggctcgggcgaggcggccggacttggcgtaggcggtgaggaggtggttgaggaggaaggttgggggagcctggagaaacgtcttgagaatgaggcagtgcacagcgccggccacgcgaaccccggtccggccgccgtcgccggcggcggaggagaggatggcggcgtagcggttgcatagcgcgtgggcggcgtgggtcatcgcgcgtgggctttcgcttactagactagaagtgcccgcgcggttagcagataagttttcgatcgttcgttttattaaaaacttttataaaataggtaaaactacatgtatacataaaaatatatttaacaataaattaaatgatatgaaaataattaataattacttaaattattttaataagacgaacggtcaaatattttttttaaaaaaaaagtcaatagcatcgaacgttttaggatggagggagtactattaaaggccttcacatcaataaataaaagttgggattgtacttgacagtagttaacaattcgggaaagcacaagaatgcatatgcaaacaagcatcaaattgggcaaacatctttgtgacacacaaacataaaataaacaacctggccactagcaaattgacacgacactaaatcaagaggagggaaaaatttcaaaaaaacagggaaaaaggaaccgtaccgatcttggggaattttatgattcgcgagcttccccgcaagtactatggagaattttttttatttataatttttttattaaaagttttacaaaaataattttccattttgaaaatcgacggaagtagtcgcctaccgccctctgggaaaaat

SEQ ID NO: 18118 - DNA, 13444 bp, Oryza sativa
agggggagagagtcggtataattgttgatgaaatggagagggaagattcggataatgaggaagcggacgacgacgcatcatccgatgaggaaggggatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttctgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgagatcagatattgacagcaattgggtgtgatgggaacaaccaggttctacctatggcttttgcatttgtagagagtgagaacactgaaagctggtactggttcctagagagagtgcacattgcagtggtgcgtatgaggctcaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttagatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaatgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcagactaaatacttctatcgtgtaatttcaattcaatgttgttgtaatgagtacctccgactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccaccattcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactaacacccacgggcacgctgtggacttccggctggtccactacgcacggtccatcacggatgctcagccacaggacgtgccgcagtggagctggggttctgccgtgctagcagccacgtaccgtgccctctgtgaggcgtgcacgaagactgatgtcacgcccagaaattcccgaatagaattccaagcagaatgtgtattaaaacccccgtccaggaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcactttatttaaccaacaccagcaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctgggggaacctcggcgactatcttgaagtacaccggagcgtcgaaggaaccggaatctagcgacatacaaagcaatcattgcaaacaggctataagactactgaaacagagaacaaaaccatttttaatggattctacacatttttcttgatttactgagacttgaatgggcttaaacggagctcggatgaattagttatgaattttagaagattcactgtgtttaatactataaaagaaatccttaaataatttattgcgcaatattaaccagggctgacgtcagcgagggggggggtgcggcgccgacatgcgggacccaccggtcagcggcatgggagagagaggaaggggggtggcggcgcgcgggcccaccggtcagcgacccggggaaaaggaggggcggcggcgccacgtggcggccgaaccgacggccccgatctacccaagggtagatcggacggcggcgcgggacctcgcggccggggcgcgcgggcgcggcgcgagacggcggcgaccatggcgccggcggcgcggcgctcacacggcggcggcgcgcatgcggcagcggcgcaaagcgacgaccgacggcgatcgtccggcggcggagagcggcggctagcggctctaggaggagaggaaggggaaaaggagggaggggatgcctcaccgagggtggccggcgcggaggaaggcgatggcggacggcgacggcaagccacgggaggacggcgtcggctagcggacgagctccggcgtgccctaaggaaggagaagagaggaattagagagagagagatggaccatggcgatcgggatccatggccgaaggcggcggtagaggtggcgctcacccgtgcgcgtggagatgagggctccggcgacgaacctcgacggaggaggggcggacgaggtggacctcggccacgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatggggaaaccggacgtggccgggagcggcgggattcgacggccgacgtgggggagtggggaggagagagaggcgggattcggttttcgaatcccggccatctcgggcgcggcgcgagcgggagagggaggggaacgggcgcggagaaggcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgtactttagtgatttttaattggttaaaattatttctagagctctgaaaattccactaaaaatcctgttaatgaatttcgacatgtagaattcaagaaaaattccacatgtcaaatccgattattatttgcattactttcttagggttttctcctgatttcaccagcattttcttagggtcaattataaattacaattttgactagggaggaaaacttcggggtgtgacaaacctaccccccttaaacggaatctcggccccgagattcggtggagctggtgaagaggtacggatgggcggccttcaactcatcttccctttcccaggttgcttcctcttctgaatgatgactccactgaacacggcaaaacctggtgaccttgtttctggttctcctttcgctagtgtcaagtatgcgaaccggcttctccacatatgttaggtcctcttggatatcaatgtgttccgaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaaggtacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcactctgtctgaccatcagtttgcgggtgataggccgtgctgaaatttaaacgggtccccatttcttcctgcagcttctgccagaactttgaggtgaactgactacctcggtcggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttctttaaggtcttggtacattttggtgctgcctgggtgaatggagtactgggtctgatgagcttcggtgagtatcagatccttcaattccttgtcgtccggtacacacaatctttctcccatccagattgtgccatgctcatcctcgtggaaatcccgagcttttccgactctcatgttctttttcagttctgctatttccggatcatttacttgagcggctctaacttgatccacgagcgtaggccgtgcctccagagcggctacgaacccgtgttcaacaattccaacgttgagatgttcaaactcctgccgcaattcctcacacatgccctcgatgcatagagcagtgcagtaacttttccggcttaaagcgtctgccaccacattggctttacccgggtggtagtgaatactcatgtcatagtctttgattagttccaaccatcttcgttgtcgaaggtttagatctggttgggtgaagatgtatttcagacttttatggtccgtatatacttcgcagcggttgccgatcagatagtgcctccagatcttcaaagcgtggaccactgctgccaattccaagtcatgagttggataatttccttcgtgtggacgcaactgccgcgaggcatatgcaaccactctgccctcttgcattaggacacatccaagtccgtgacgggatgcatcgcaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattctggagaagttttcgatgaatcggcggtaataacctgccagtcctagaaaactccgaatctgcgacacggtctttggtggggtccattttgtaactgactccacgttcgatggatcaactgctacaccctgagctgtaatgacatgacccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaataccacaacaaacttgtccagaaattccatgaacactttgttcatcagattcatgaagaatgcgggtgcgttagtaagtccgaaagacataaccgtgcactcgtatagcccgtaccgagtggtgaaggccgtcttcggaatatcctcttcccggattctcaactggtggtaacctgatcgcaggtctatcttagaaaacactttagctcctttcagttgatcaaacaaatcgtcgatccgcggtaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgctaattcgttggccgccattctgtacggtctcttatagattggagcggttcctggtgccaaatcaatccggaattcaatctccctcttgggtggcatggtggtgaggtcttcggggaacacctctggatactcgcagactatgggtatgtcctccaattttctcaagttcttctcttcggtgtccactgggatttccgtctcaatctgattcaacgaggctcctttctttggcgagactagagatttgtacaccacggtttctcctttctcattggtcagggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgaactatttcccggggtatgaaccctcattggtgtgctaagctcttctttccttaacccatacatccccacaaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttagcccggcacgcctgggcttcgggcatttgtcagcgaagtggccaagctcgccacagttgaagcaagaccctggttttgctcccgtctccttcttggcttgcgcgggctgggctgactgtgccggtgccattggtgggcgtggagctgcaccgcggttgggctggcctccctggtggttctgactgccgctagcgccctggtggaagttgctagagtggaacgggcggtgctgtcggacgatcatggtggtaggtccaccctgctgtccgggagtgaagcgcggtcggtgctgactaccttggttggatcggaactgcgccgcctttcttttcctgtccattttgttgcgctgatcctcctgacggattgccttgtcgaccagcctttcaaagtcagcgtagtccccggatatcagttggttggtcagctcgtcatccaggcctgccataaacttttcctgtttctcggcgtcagtgcggacatcctctggtgcatatcgcgcgaggcgattgaactcgtggaggtactctgtcactgtcctgttgccctgatggagcgcccggaattccctcttcttttgcgctacaaccccgtctggcacctgtgccttcctaaagctacggcagaactctgcccacgtaacttccgtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgagggggagggggaccaaactgctggtgctgctgttcggcgtgctgcatcatcctctgatgcatctgctggtgctgctgctgcatctgctgcatcatcgcggccatcatctgagtctgatgtgccataacttgggcaagcgtcggattctcgggaagtggtggcggaccattgccagaatcaccgttggggtgcacaccatcagcgcgttcttcaccgttgctgccctcgcctgttgcgcggctaccagtcctggtgtagaccatctggagggaagaacagacggggaaaagaagaaaaacagatgctcaagaactaagctttattatataggaattaaaactgcaattgttctgatctgaattaaaacacttaaaaaggcaagcaaaaatccttattaagacagccatatcatagacacatgatatcgaccgtcaactgaccccaaacaagcaacctaaacacacaaactaacaaacaaaaactagacagtcgatgaactagtggaaaaacgagcctaatgctcggaacggctcctgcggtcggtggagtcgaaagcgtcctcctgctcgtcacccggtccctctgagcgactcctggagcctgacggatcagtctcgccgctgccactgggagtagcagacagccatcctccggtaccactggctgaacctccggcggctgatgctggagcgaaggagagagtgaacgcgggagctggagctggagctgcaggaactgcgggcggagctggagctgctgcgggggccgctggtggaggtgggttcctgggcgccagctggatgcgcacaggtgtagtcgtcctcttacggggcgtagtgcggatccggactcctcctggcgctggaagacccttcaactgagcattctccttcttcaggcgcgctacctcgtccttcagagcgacgatcctcatgagcttcccatcattcaaggccttggtcgccttgtgcaggtccgagtgcatccggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactgagcggcggaatggtcgtgtactccggcgcgtcggggtagcccactaccagtgtcatgcgtgccagctctgccacgaagtcgatcatgccttctccgcggtggttgggtgggtgaccggccatctagagaagacaaaggagtaggatcaatgtatgctcaaatccaaatttaaataaagcaataaagactcaaataaaggaatcaaataagagcaaaattttatgcatagatcattttacatgagcgcgaataaataagacagactcacataacgataaaataatgggaaattagatacataatagtagtaacaaacgaagcataaacaccttgcaacccatgataccgagctaggaccgaatgcatttcacccatcaaatcccaactgactgacgagtaaatcccaataattttactaaaaccctagactgactcgttttggaaaactcactttaaacgagcgaccaagatttttcccttgaaccacaagaacagatccccgttttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagagatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcatggatttaacaagggatagctaagcaggttcatttgcataaatactggcatttataaacaggaatttaatgcaaaaacagttgtaaaaaaaattaaacagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagtttta

SEQ ID NO: 18119 - DNA, 921 bp, Oryza sativa
attcctgcagccccccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgatacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacttatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcccccagggcggcaagggggccgcctgcaaaattccatgccccctcgccgccc

SEQ ID NO: 18120 - DNA, 352 bp, Oryza sativa
cacccccaataaggcatgccatcttggaagaagggatcatcgatcgctgctccccccaggtgtacatactcgaagggatgcaacaaaaatgcaatcaaaacacatcatccaccatcttcatccctgcgtgttttcgcatcaaaataccaaacctttcaccggtgtgtacagaaactcggccgagaaattaaccccccccccccccatgttcttctatcaaaaactcagatccatctcaccatcacagtcagatcaggctccaaagtttggccgggatgaatccgcaaccactggagccggagccactccttttgctggcatggtgcaggtgtcaaatggttggtgcgtacta

SEQ ID NO: 18121 - DNA, 809 bp, Oryza sativa
  unsure (1)..(809): unsure at all n locations
gaattagcctgttcttcaggtacccttaaacacttctttaattgggacacatggaacacgtcatggatgccgatcatagtggatggaagttctagctgataggcaacttctccccttcgttccaaaattttgtacggtcccacgaagcgtggtgccaacttgccttttgtctgaaagcggtgtactccccggagcggggtgacacgaaggtacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcaggaatt

SEQ ID NO: 18122 - DNA, 1905 bp, Oryza sativa
  unsure (1)..(1905): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaagtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgcctcgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactatcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtacgccaccagcgttgcttcccggatggtgacggcggcctcgcggtccgccagatccctctccacgacgtaggcgcgctcttccagcgccatggcgcgcgcctcaagggcctcttctcgccgccgggacgccgcttcggtctccgccgcccgctgttctcgggcagcggcagcgtcaagcaccccc

SEQ ID NO: 18123 - DNA, 2684 bp, Oryza sativa
ccagcaccttcttacgagtttcaagctccgagacgtgccggcggtgagccttatggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttctagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggcacctcgcttctcgctcccactatttcgccccctcgtttctcgcgcccacgcttccactaatcccattcgcccgcttgcggcgcatgaggtgggtatgcggttgtggcagtcgagatagatcatatcgtgcgcgcgttaattacgctcgccgaccgaagcgacgttaccatatcttcagacgaaacgaatcgccatgtccagatttgtgtgctactcaagtaatgtggcagtcttgaagagaccgctcattgttgacagccgagttaccattgccgatgtgcgtggtttgtgaccgttgagtttctgcccaattgtggagaccggtcccacctgtcaccaggtcttaggagtggcgtcatgcccgaccgtttcccttaaagagggcgatcgccctggcataacgccgggggctactgtcggtgacatgggatcaggagtatcatgactagaggtttgaggcagacacaat

SEQ ID NO: 18124 - DNA, 13175 bp, Oryza sativa
ttcctgcagccctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcaaacagccacgattccacgtcgcacctgctcccggcgaaagtggaggtagttgtgggccgtctcatcagaaggtgactcggacggcaactatacaaatctccgtccatttatgaaaagggggggggggggtaagtccccacaaaaaagagagaaatggtgcatgtggtatccccttaagatataaaaggaggaccttgcccacagagaggggggactggacttttccagattagaaacccagaacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatctccaaaactacttcgtgaataaattccaaatatcaaaaccaataatcacatataccaattgttcatcatagaataagaatcaaaacacacattgatcttacagctaagtccaagctatccttggcctccagtttctttaatggataacaatgtcatcttttggcatcgcatccttcacggaggcatcgtttttttgagtcttctctatgtggtgttgttgtagtaggctcgacgatgattggctggtttagtgcttgtgtgtgtatggttggcgtgtggttttgagatgtgcactctgatgcacatcctttctttgcactggtggagaaaccatctttggtcggtcgaccaaattccacaatagtcccgattgcaataaaaaccaagactaaagattatctttagtcccggttgaaaaggttagagctactttttgatctttagtcccggttggttgactaaagatcatttttagtgccggttcaaaaaaggataggtgatatcagacccctctaatatctttagtcccggttggtaacaccaaccgggaaaaaagatcggcatgcacggagagatcgaggcgtacgcgtgactcggatcgagataaatatctcctcctctcctcacactctatctattcttctcctctcctccgatccccttctcctcgccatcttacgcgccgaggatcctctccttctctcctctcccccactcatcctctcctcctcccctcccctcccctccggcgggtggcgacggaagcagcagcgagatgaagccgaccggtggcggcccgcgtgaggtggcgggatgagaggctggccggcaccggccgggcgcggggcggtggaatggagtccggccggtggcggcgggatgggaggccggccgggcaaggggcagtaggatggaggccggcctcgcactcccctcccgggcccagagctggggatgattttttcttttcttttttgatgatttgtggatgttgatttctgaatgttgatttgtgaatgtgtttgcgaatgtttatgtgaatggttttgtgaatgtatatgttgtgaatgaatctgtgtgaatgtatttgtgatgttgtgaatgaatatgtttactgtgaatgaatcgatatgaatgaaggaaaaaactgaaaaaaaaataaaagagaaagaaccgaaggaggaaaaaaagtctttagtcccggttggtaagatcaaccgggactaaagatgcctgcgtcagtcacgtggctcaaccatctttagtcccggttggtaacaccaactaggactaaagatagatttttagtcccagttatttcacccgggactaaagatgggtatttttagtcccgtattcgtagtcccggttgtataaccgagactatatgggggttcccaaccgggagtaaagcccctttctccaccagtgttgacatcggacttttgatgaaaaacttttttataaacattttatcttatatcttaacaacattcggattacctctctcagtcatcgtggaaaaaaaaactgtccaagaagagcaatgcatatacagacttacagtacgtgtatgtagctggctagcgagtgcatactagctagtgatatcatctcagcgtattctgtttctctgtcctatgatcgatggattaattagctcattatatattgtgcaaactgcaagtaataactggtgggaaaatgttgattcagctgcaagtcatgcaggtatataacacatggatgaattaattaatgaatattaatgtaacgctattatagttgctagatggatatatatcactgtactagatataaatacatggatagaacacgatggggcatgtactgctgcttgcgttcaatctagctagatagatctgtgtttgtttctttagtagtactatatattttctggcctgcgcagcctcgacgatatatcatgcatctatatatgcatgggtaattaatgcctctagaaattaatcaaagcacattgtcgtgcatataagtatatatatatatatcgcatgcattctgtgtgcgtgtagtacgtaagtatactgtagttggtaaccactgccttaattttgctagcttgtctcgacaatttaattaaatgcctgatgaccaatgcaggtcgatcagtcatctctatatatagagtattatatacatgcatgtacgcagcaagtacacctgatgatgcaaattgagccgaccaaatttgcatgcatgcatatatatacatgtatggacttgatgcataattgattcaatataagtattagctacgacaattagcaagtcagtttttatgcatatatatgagtatagttttctcgaacagctagcgtatagtgtgcaaataccatgtatgatgtatgtaatgtgtacaaatgcaccgtatgcagataaatgtgtacgtacacatttatatcaataatgtatatacgtgttgtatatgtatctggaaaaaaagagagggggaaatggatggaaaggaaaagaaaaggaaggagtggggggcagatggagaggacgacggcatgcacaagtgacaaaaattgctacagtgaggaggatcgatactattgtgggtggggcccagtgggcttgaaggtgagtttggcccaccccaggcccaccgacagccctgacccgttactgtcaatcccccacccgggcccactgtacgtcaccccatccctcctctgcactgcattgctagcctaattcactgttcattgtcattttgtttgctcattcctatacccccgatctcgatccattttcgatcgatgtcgatggtcatatacaaatttcgcctcgactccatttcaattattaataattactccatacgttttcaaaacaaaatggcgtagctagttcgtttcaaaacagtaattcgttcacatatgcctgtgccctcctatgtactatcacacaaaccatgcaagttaacttgcgttcaatacaatcatacgttgccccgccggcaacctggcctttttcctttggagctacgctgtcggatggattattagtttatcctaaagccgcattagtatagctatatattgaattgaagtctacccatgttgaccttgcttatttttcaattatcatttcatataacagagttaattatacaaaaaagtgttatatatggagataggttgatcctgtccttcgagactaatctacgcgacactatgggctatacagccgtctacgtataactgtatatggagcccgtctcaaattatcacactagtacattttagccatgtgatggtttcttaggcagtactcccatccccccgtctcgaaacatatattagtagaatgtgttctatttatctctattcagatttcgttcttatattataagatgatgaagggaatacgttgtttgctttaccatagtaacttgctttctgcactttcatggacgcgtctcgtgtccacatatagtttacctaatttaactttaagcgttatatttgtgaccatcaattttattattgcacttttgtaaaatatataccagcttagacaattaaaaattgatacatgatgcatacgtaacacacgtacacgacttaattataaaatggttttcactggtcttcggttgctgacggcgccgcaaattgccagctaacttaaacccatttttacctctaatgaataccgattttgtagtagtgatgtgtgtcaggatcgatacacatatatacatggatgaaagtagtagatatattaatatacccgtgatccgatatttcaggatcgatcgagcgaggaagggatcggaagaagctatggggaggaggacgctcacgcatggacctgctggaccgtccggagtccggacaataataaaatcaagtgtaggagtacatgctgctccaccccgaccattgtcctcctgcattggacagtagcaatacattgccacattgcactgctgtcccctcctcccctctatctctatgctcttgctagctgtcccagctacttctcccgttttaaaatatagatatatttaaagttttagccaactgatatggaaaaataaacactcgagataacaaagtagatgaaaagttaagagatgattgttatcgaatgtaataagaaattaaacgaagagagatttattattgtatgaatactaagaatgtttttattttaaaataggagtatgtcgcgtgcaataggcaatgttggctagctacctattgcagcttagggttactttgaatcgtacgaataggaaaaggaaggaatataaaaacacatgatttttaatagtaatgtaagtggaaaatataggaaaaacataggaatttgattggaccgcgggaaaaattgtaggaatcggatgagatagatagatcgactcaaaggaaagattctcaaaaggttgaaactattgctaaatttttttcaaaatctttatagtattgtccattccatataaaatttatataaaatttttctatatgattaaaattctctaaaatttttatgtgtttcctttaaatcaaagtacgccaaatgtctccaaacaaaaaccatagctggcccctacgcacgcatggacgcacgtacattggcagatttggatcactagctagctagtgtttttcttttctttttcgtttacactagttttgattaattccctgctacatactcgtatatgtacgccgttaattaattaattaattgccattcgtcccgacatgtacaggttaataaatccatttgcacagtattttatctactgttttttaaatcttcatcgcatagtgtatagtactagctactctacatgtgttcgaaaagtttcagtgcacacagtacctatcgaaattacgttactgtggtagttacgtcacctatcgaatatatgtacttcgtgccatttactacctctaccttcattttctaatatataattttgttaaccttttgacatatatttaacattttattttttttccacggacatgaacaaatatataagtattcattagtaaagtcgtatcaaaataagtaacaattacatatttttaataaggttaatgatcaaaaataccttaaaaatcaacatcatatttttttaataatgagaagaatttcgttagaaatgaaattacacctaacttctacatcgaccagagaaactcacaacctaggacaaaagaaaccaaagccaaacataaacatattatgttatcttataccggtagaatcctaagcatctagtaaaaaaacaacacctctaagaaggtcctaacatttgtgtgccattgccatcggaacaagacgatattttcatccaaagcccgagatgacaccttcaataaaaaaataacaaacaagcattgacattgaatatagataaactagataagagttttcatcccggagtcattgtcactactttgtgccaccgtctggatgaaatgagcatgatctacgatgtgcagccaatatggacaaagtgcaagcctcctctacccaccaccaccgagctaatggaagaagtcaagtcatcgtcaagccgaaatcttggaaaaaggaaaaactacggacgaatatatcacagtgtcttgcctgatatattatgagaatggaactcgttggctcaactagatgggagggtgccacaacgcacttcaaatctcccttgtttgatctcgcttggattgcaaaccatacctggtgtcgatctggcacgtcgtggtgttgggcagagaagaaaatcccatcacaactaccgccggcggttgcagtggcgaagacggtgcataggtccaatggtgtcgtagaagcagaagctcactgtcgaggccatccccgacacaccccatcgtcacaaccgcgtcgaagttgccccgtgcccatgcagccatggtagctagcccggcaacgacgagataccacccggacgccatggccccctggatggatggggtggcggcgctggtgaaggttgatgtttgtcgccctcaggtatcatgtggagcggattactagtttatttgtgatatagtataaaccgtataacaaagttttaaatggtgcaagatgttttaaagaaaaatgatgctgccccatgcgtccatcgaggttagttagtacaattaggcattctttaaaaaaagtacaattaggcgaatgatgtctgctattatgtgtgtacgctattactccctttgtccctaaatatttgacgccattgacttttttaaacatattagaccgttcgtcttattcaaaaaatttaagtaattattaattcttttcctatcatttgatttattgttaaatatacttttatatatacatatagttttacatatttcacaaaagtttttgaataagacgaatggtcaaacatatttaaaaaaagttaacggcgtgaaatatttagggacggagggagtattatatcagtgagcagcgaaggcatcatacaagacactgcttgagcgtttcatgtacacacaaaatgcattgttaattttatttgtctgtacgtactttgtttgtagctacaaagtatcttgcataatgttcggattaatgtggtctgaatttaattgtgaattttgaacaggggaaggaagtgccgtcccgtgtgttaaattactagatgaatccgaccacgaccatttcatagatttaatttgatttgagctatatagcactgctgcaacggtttgcacggatgtgtcccactgacgcaattaaacacacaccttgctgttagcagtagatcgattcgaccatgcatagctccaaaaccaattttgtgttgaataatataaggtcagatgaaattaatatagttagctggaaactgatcaatccaatatttcgtgtcatcccggccgtcggcggcgagtccgtgtgaaggccaccgccaccagctagcagcctctgctctgccgccgacgaccaccaacgttgtttatttcagtacgacggaattaaccaacattcatgcatgcatggtttatttaaaccgattttctggaggagattaccgcccggacgtccgatgtaactcaaaatatcgaactctacccactggtggagaaaccctttgtagtcccggttcgtaacccccctttagtcccggtttccaaaccgggagtaccaatccgggactaaagatcgctatctttagtcccggatgaaataaccgggagtaaagatcaatctttagtcccggttggtgttaccaaccgggactaaagatagagctgaccttttttttttttgcatgcccctgttgctgcatggtttatatatatatatatataccatgcatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatatgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatcaagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattccccttaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaaactctcatgatctccgcgtgcccttgttcttcgccagtacaccgtactgataggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcacccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatataaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctagcagtcgcaccagttccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatatatatatatatatatatatatatatacatgtatatatatatatacatgtatatatatatatatatacatgtatatatatatatacatgtgtatatatatatatatatatattgcattttacgttaacgttcgtcctcgttcgttcgctcgttcacgttccctagctcgttcacgttcgttcgatcgttctagttctcgttcacgttgtcctggcaacgtacgttgacgtgttcgttctctctctcgtgatgttgatcgatctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcagcggtggcattgcgcgcgcggcggcgaaggcggcggcggcgtggcgacggcggcggcggcgtggcgttggcatgcggcggcggcattgcgcggcgtcgaaggcggcggcgtcaaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctggcagtggcggcgaaggagagaggccgagagagatcgatcggccgaaaacgtttaagtgttggtgaagaagacgagggcgcaccgggaatatatatacccctggatctttactcccggttg

SEQ ID NO: 18125 - DNA, 3226 bp, Oryza sativa
ccccaaccgggagtaaatatcttttcccgctatttcgaaattctttttaaacccggttagggttaagaaccgggactaaagattatagcactgcatatgattttcgcttacatatgtgtttataaaatagaagttaatgcattatacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaaggggttgcccatccaactgatcgtaatcctcgtcagtcttgtcctcaactccgacgatttttcttttgcctgagagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaggaaacatgttgtgtaggtacataggcccgagaatacggatctctttcacaaggtgacaaagcagatgcgtcattatattgaaaaatgaaggtggcaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctatttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatct

SEQ ID NO: 18126 - DNA, 5541 bp, Oryza sativa
  unsure (1)..(5541): unsure at all n locations
atgcagtggccagaattaatagaaaattacacattctttgtacttctcgtaaaatttatgtgttctttattgattgtatattagaggcttgaaccttaactattgtcacttgtttgctgtgaaaaatgctctgtgatgtattcattcataactaaccaatcgtgatgtgcatttctgcgacactcttgcagctgcgaaggcaagtgcctcagatcttttcatgccgtcagggatgctggtgaagattgtcaaacactaggctacactaggcgtcaatttgatgtatctgttctgaatcttccactcatgaatgataccgtttttacttcacatgttttacacatattagatggtaacattcacttagctttcccatatttacaggcattgaatccttttttgtgcaagaattgtgagcttgaaaaatatcaatgttttgcatgcatgaggttgggttcagctaaaacagatactcctgaggttaatctcttttagcccttttgttatggaattccaagattagtaattgattgcactccttcaaaattattctataagtctaatatgtgatttattccttccttttaaaactgtctgaatttcttttgatcttctgacctgataaattgcttttattttttaggtatttccctgtgcatctgcgaattgtggttatttctaccatgctaaatgcgttgcacagttactctttactgaaaatgaagccaaagcattggaatatacaacaaagatagccagtggggtaaaatttgcatgcccactgcacaaatgtgatgtttgcaagtatggtgaaaacaaggatgaaaaggagctacagtttgctgtgtgccgacggtgtcccaaggcatatcatagaagatgcttgccaaggcaaggatttctctctttttcatattttgcaggaagtgggttactaatgcatattctttatgagttgatcatgaatgcattctttgtgagttgatatttatttaactttattcttaaactaatacatgcaaatctatacataggaaaatcgcctttgatgacttcgttgacaatggtgtatttcatttccaaagggcgtgggagggccttcttcccaataaccgaatattaatattttgcctgtatgatttctcagtttttttttataaaattgttgcgtttgttattcaagtacacaaatttctgactaaatcttgtaatttttgcataggaaacatgatattgatcctaaacttagaaccccgacaagagatcatattaaatttcctgataatcctgctgtcacgagaaagcccttcgatgtaaatggaatgaacaagaaggtggttaagatacggcttcttgaggattgtccacctgccccattgtccagtgacaaaaaatcatttggtacagtgaaccgtttttcctcaagtgatgtgataaccaaaaagaggaaagtgcttgtgtctggaggtacaaaacattgtgctcttagtgctgtggctagggaaaaaacatcagttccgtcatttatccccttgagctcattccctgttattgataaaagcactgagaggaggtaaatcttgcgcacttctactgttaattgttttcctctttcattcagttctcattgtttccttttgttatgcaatcaactttgactgcaaaagtgaaaaccaaatgtttgttccgcataaaaacaactctagtaaagctgttgaaactaaaaattatacagttataatttgggagtggctatggtacatgtgtagttagttttatgcaatcttgtaaacttatcacataatccactgatcatcctacgagtgggaatggtaggaagcagaagcaatatttaagaagggaaaactaatctttggtggaaaattttaccatgtaccatagctactccttttatgttttactgttcaactatgtttgaaaaaaaaatacactgcaattttttggattggtgtaccaccagtgagtgagtgccaagtttattttgcttaactgctttggggtttatttacactctgttgtaaaggtactgactactgaatcacattgagaaaagttgaagaggtaaacagaatacagaaatttattacaaatcatatggggacacctggaatttctgacaagattagcatccattgtggatgattaaatggttgtattcaaatttgttggatttctggctgctaacaaagaattcagaaatgatttgttccatggtttattcaacagacaaaatttcattgtacatgcagtttgcatgataccctttaaaatgtctgttgaagctgaacttaggtgatgttgtgtttttatttactgcaatccgcaagagctgagattatcctttaattcaggattcatgagttcgcacagaaagtgtcatctgatataaccattgaggatatacaaaaaaagctagtggttccatctacacacacaccggtttcgaagaatactgataagattacattgggaatggtgcaaagatctgttgaggtactcttctgcgcttccttaaaagaaatgccatgaatttggtcgattcttacatattgtccttgcaggctataaatgctgctctgcatatgttagaaaatggtgcatccatagaagatgtcaaatctgtatgtgcacctagtgatcttttccaacttgcaaggtggaaggtacatgaatatattgaaaacacacttccttgctgtaacaatggtttactgctgaatattatgaactcctgtgtctcattcttatatgtaataggccttatagtttgtttctctttatgcacaatgagaatggtcaacatcacaccagataatagaaaaattcctatgattctaacatgcttgtaattgcttatgattgtgtggagtgatatatgctaaaagcaagtttgtagtctgtatagaaataacaaaacctcttctatccatgatatcatgaactattgtctgcagaataaactgaatatatatcttgcaccatttcttcatggcatgcgctacacatcttatgggcgccacttcaccaaactggacaaactcgagcaggttggtatgcagatcagtaatactgtgggttggttattttgctgtactgatctatcatccttttaattttcctttggaagataacattttgatttcggaagttataaatattatttttaaatgttaacccaaaacagtcttgtcatgaaataaatattcttgcgaacgggtctgtagccagtggccacaacactctagtagcacctaccagcgtctagttcaactccccttgggagcaagttttcagggttggttttaaaaaggacactcgctggcccctcggttaaaacacgtgttagaaaacaacctgtgggcaagccctcgtgtacgggacaggggcctcaaagcacagattaaggcccgaaccatggggggcaggtcctcgtgtcaagggaccagggttcatggactttcttggctggctttggctgctgaggcttcttcgtgaaaaagccgtgggggtggtctttcccccaccgatcaagtttcttttaaatggatattcttgccaattctttgctcattatcgtcagttttaacaaagttgtacttgattttgtaattggaaaaagaaatctatatctcgtccttcaactcttgttcagtttactcttcattactcaactataaattgtttggttctgcatgaattaaattgtttcgtgatgaatacttggaaaaacaatgttccaattatcaaatagccctgcaaatattacttgtgaatccaaagttccagacaattactgtgtcaatgaggtttatgtttggacctctgcacattcatatgcagtggtacacatcacttgtcaaatattttaattaccactccctttgtctcaagatggagagatgatcatcatttcatagaaggaactgtttggcctccctctgtttagagaagaagttgccatgattaaaattaagcaagaacaaattatgctacccctctaccattccttggcatgtaccattttgctgtatttttatgtgctgagagttaaacgtggacaaaggaatcaaacacattttttttaaaatcttattcaagtgtcaatcttgtcttgtgatttgcttgcataaatatgtccactgcaccaataaacaaaagtaggaatttgtttcatttggtattaccaatggaaatttctagagatctatatccttttgctactttttaccacttgtgaattcaattgtgatgaatgaaaaccaaacttcatatttcaattttcataaccactgttgtttgatttcatgccctgtttttattagcactgaaaaatagtggttattcttacctcggggttattgttatgcttaactattatatactctagtttctaccttcttctgatgctgtttttagtactgacataacaatgtttaaattatgcagattgtagataggctacaatggtatattgaaagtggtgatacggtacatgtttgttctgctttgttatgtaaatttggtcatcatgaatgtgcataagtgatgcaacatacaggtttcaatgtgcttgctttttgtgtcatacatctgcataaattctggtgttcgattgtagcgatattgtatcgatgctttatccttgccaagcttagatatccaggttcaaatgaagtaaattagctcgggcagttgtttatttgtactgggagtctgggaagagcctgctggctctcaaaaactaacacggagatatattttcatttattcgtgctaatcttgctctatggattttgatattatgccgagtcatgacaatggataacctcaatgtcctaatttcgatactatgcaaacaattaccctagctgcttagcatagatactaaatgattgcaataatgtaatagtaggatttatgtgtcaccgtctgctcgatctgtcaagtgtttaatgccacttgctttatacccttggattaacctctcaaatcttcatactgtgtttcaagagaagtagatgatggcagattttctattttattgatgtcttgatttgactctttgtaatcgtgcttgcaatgctgttgatctaccaacttaatgctatgtttagttttccatctgatattgattgtaccaatttttttgggttcataataaaaatagaagacctttacacatgatccagatgtgccacttctaacaattcactacacattccttttcctgtctgttttaggttgttgacttttgctgtggctcaaatgattttagcttattattgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcagg

SEQ ID NO: 18127 - DNA, 4217 bp, Oryza sativa
tttgtcttcattagagttcacatgaaaaagttatgaattattttttgatataaagtttttaggccgtcctgtttagggaccagggtgacacaactaaacaagttggaggacctaaacgagtgatctgcaagtttagggaccgggatgacacagtcgaacaagtttgaggacctgaacggtcgatttgcgagtttagggaccgggatgatacagcggtacaagtttagggaccggtgatggactttactcattttctcaggttgtatactttttactcttggcatacatgtgtcaatagcttatgctttactcaaacaaaatcgtgaggatttttactgattaattgaataatataccacacttacaagcacaatagtgctatcgataagataaacatacaaattatgtttcagcgaacaaaagggtgcacaacagatcatataggtggtgacaacaaattattccaggtgagcgcaaagtagaataacctatcttactcacccattaaatcaattatttctccttattttctgtagttcattgtacaggaattaaaaaccaaggttgccagtaaagtggccaaatccatagcacaagaataactagtaagtggcaacatataggtataggaacgaaattgttggtatacatacattattgcaagatcagaattacgaagtatggtgcagttaaatccaattctgcagactaatggacaccagtgtttactattccgtaaaagaccgcaatttcgggaattccagaaaatattggtacgaaagtatctaaaatttaaacaagttttgactgaatttgaataaattttggccaaattcacaacggattgaaaaaatccagccgaaattctccaaatttcaatccctgatggacactaagttgtaaagacagaaaatccaaaatataagacctctttgaattaatgaaataaatccatagccagaattgtaaacagtttctataacttgacaagaaatgtttaatgaccagtataaatgttgggagcaaggttcaggaatttctaaatgcaggaactatatctgtttgctgtatataaaaattatccaagagcaaagaaaaggacgtgcaccttgcaatttcaccaccgttatcacataaagcacaaaccaaatcaacattagcagaactctcgccttcagcgttatcagtcatatcttcgagtttacaattgcaaattcttgcttcactcttatgccttttataaaacctgtttaagcatccaaacagtatattatttagcactgtaattgaaatttacaattatttctctttccgtagcatattctataacatatgttttgctttagtcaaattattctggctgaaacaataccaataaatcaaaagtaatgctggatgatgagaccctcattaaagtaattaactacagaatgaaactaaatgttctacattgtttgttatagaaacaggattctttttttctcatagcaaagttaacaactgccaaaaatgaagtgcatttcatccaaataagcactataaacagtacaagtggcaacatgtaagtatatcttaaattaataggctgtagctatgcctgtcaaagttaaaactacaagtatgcagaatacaagaagttcccacttggctgcaaacaggagtataaatttaaagcagagaccagttgaccactccattggttatacagacaggctcaaggcattagcagttcattgtaggatgaaatgatccaaacaatcattttctttccaaagaaatagcaaatagaaagcaacaaccttacacccatggaccccacctagtaagtacgaagaaaagctcatctagttcctccggagcgcaatatccatgaagaatatgaacaaggtaacctgccttctccaccagagcgcaatatccatgaagaatatgaacaaggtaacctgccctctccaccagagcgcaatatccatgaagaatatgaacaaggtaatctgccttctcctatcagcctctagtttctttcctttgtttttttagtgcagcctctagtttcttactatttgtcatgcaaaaattatggcatggcataaacattccatcggaaagctacagactcggtttacagatgaacttgaaacagcacatctgcaaatggacgaaccaaaatccacccgacacatcccaaaattgagggaaactaccaaactgcaggatcaggatccaaaccgcttcaaatggaaaaatatattatacttgcttttttacgccatcgaccaggaaaaaaaaaaagaaacaccgtgcatgatgtctaacagggagaaccgctcgccgaagcaatcaggcatgccacaccacatggccacatttgtgcacagaaagtggatatgcgattattaagagtctacgacatccttatttccctcagctcatctaaactgaaaaatgcaggccagtgaagtcgggagtcgaacacgagccgcggaagccggaagtggagaaacgcgtcaatggcggaagccgcggagccacaaaacatttcggtgccagtgcgcctccgccgacgcgtcgcccacctcaccgctgctccaccgccggctgattccgagcgctcctctccggtgaggaggagacgaaccgtgaaaccaaccacggaggaagccaagagatcatccgacgaagctgtgcctcctcacctcaatcgatcagaaccttcctcaaccacacccagaaaaatctcctccccgaaaaaccgcaagcattccgcccaaaaatccctcccaaaaaaccggagccaaccgatcacccccaaaattcgccacgaacaacacggaaacgatcatcgagcacgcatacctcacgattcgagcagctcgcagcaggaaaccatcgggatgcgctcgctagggtttcgatcgccgcggagagacgaatccgaatcccctcctcctgcacaaaacccacaagccaaaaacccaaccacctctctctctctctctctctctctctctctcgcacagagatgaactgaacaccacgcacgctttgaacgaagtgggagagagagagaggagagagggtcacgtccaattcatgctcgcctctctctcctcctcacttaccgacccgcccacccaccacctcactgacagatgggccccacacccgtggggcccgggtggtcatgggctaagcgtagcctcatcgacgtggggaggagtcgcgggatcctccggtggggccgacctgtcagtgagggtggaacggctccggatgcatgggggtagggccgggcgacgtaggccgtaggataggccagccttccgggggcgtagagctcgcgtgggccgtcggatcgggatgggctctgacacgtgaggcggggaggctgcgttgcgggcaggtggccgtgccggtgaaaggaacggacggtggggattgggttggacgtgtttcgtggacggcgcggatggagccgtggaggaaggtgcagcgtcgggattctttttactgtgtgacccccttttttgtcccgtggaaacgaggccgagctgaagcttttttttttttactgctcccttttgcccctttctctctcgcagtaaggggctgtttggcaggactcctctccaagaaaatagctccatctccaagtttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaaacgattcgcttctattccacagtaccgtcccgttcccgttcctcattcgtgaaaaaaatgtttccaccagagcgccgcccgagtctgcaggcaaatcgccaccgccgccaaccctagagccgccgccaccgagatggccggatccgcctctgtccaagatggatccggcctagaggaggaagtcccggccgccgagatgaccatgggcgccggactggagcatggctatgggcgcggcttccctcctcccgcaaccggccaggggcgcggctgcccgcctcctgctgccggccagtggcgcggccaggggcgcggctgcccgcctcccgctgccggagccgccctgcacccgcctcccgctgccggagcagccctggggcacggctgcccgcct

SEQ ID NO: 18128 - DNA, 21047 bp, Oryza sativa
cccagtggcacataggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtacaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccggtctactgtgtagctcgatcgtggccgttttggcgttttgctgcaacattacctctcgcagcaggattgaaataggtgcttgcatcgtcttgaaaaaagtctattttataattttttttttattttttattataaaaaaattagctattcgagctaattttgtaccgttcttaaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcatttttttgtagaggagctctcccaaacagcccctaaataactccgtcggcttccgcttgacagaaagagccaagcattttattcttcgcactcgcagtacacaatggcatattaactgaattgcaaaatatattcatttggagaataaactgttgcatttggcatgttgggaatgaacttaacaagcagaccaaattaacactaatgagtctgtcagaacatattttctaccacatctgtaaattggcacgacttacagatatcacagtttaaaactcaaatttcaaacatgctgccagaatgaaacaacattactataaatatgagcttatttgccctaacatttctcctctttactccctggatctagtattcctgtttaaaaaatacaatcaatagcaatcatatttctaagttctataacataaccattaattcatgccaatcgatctaaaattgcccctaatagaggaacaggaaggaattcatgatctcaaccaaaaacttgccattgaggatgaaaatgaactcatcgctgcccacatcttctgtatcttagacaaaatccactccttgagcagggtactcgttagtctggctccaccaagtgtcccgccgcttatcgtggcggcaagcctgcaacagcgtgcgacactgcttctcacagccccacactccaaccctgggctaagccatcgtacctcaacacgtgcatttgagccacatccctctaacgccgatatagccatctaacttgcaaggacaacaccctccaagcccgctgccaccctagaatcacttatttcgacggttgccatatggttccggagaggaaggttgaaaggaaggagatgatggatcccttcacgaggaagggtggcaggaggagcgtcgcgccgcatcagcttgggaaggggaggtggtgaggggtatagtgttcgggcaccgacaaaagggagggaagaggtatagagcaccgagaggcgttgccattggtggagaaaggcagagcgggctggagaagtcggtggcacggccactactaggagggaggaagcggatctcaagcgccgcaaccaccgctaggaaggaggaggaggctcttgaatggcacagccaccgctaggagggaggagtgaggaccggcatcggcatcgctggtgctgtggtgtatgatacacaataggataacaagtgagaggctgggattttttttcctcgtatatttttccttttcggataaggggtggtggggactctatatttctatatgtttctttccgcatactacacgtgattttctctatggttcttttttcagatggaaacgggtgactactgatttctgctgtaccattgtctcgggataatactgatctctgttgtaccattctcttgggataaccaaaatcccttataatattggacaaaccaaagggtcatttatcccctgtagttgtggacagagggagtacttacataagcattttaaatttgcaatgcactcttcgcctaatcggtgcgagtaataaccaaagttaaccaacttagcacgagaggtgacgtgtcatccgaccaaccgctttggcctctaccgctagtacttctcttaccactccattcatcactgtttcggcctttcgagcaaaggcccagcttggaaaattatggttagacaaataggccgctgaacaagaaaaatgttcactttaggtctctcttctaataattagttttaaaagataagggatgttttatatccggttttatgattaacgaacacaatttaaactcgatgcttagctgagggatctaaaataaactttatctgccaaacaaccaacggtttgctaattgatggctaatcttgtggtatctgggccgggccattggctgatccaacgttggcccactaatcacactgcgccggcctcagcctcgccgccgccggcggccaccgaagatatcagccatgctccggcggtgaactgataagtagccaggttttggctcaaagatgaaaatgtgttccttgtctgtagcgtttttaccccccctgagaatattcttgaatcgccaaacaattttcattaatattaattagcattcgcactgtcaaaacgtttcaaggggcctacgtttaaccacacaccaatagtttttttttcgcaaacgcgcaaaatagatattacacatcagtatattagaagaaaatagagttgttgttacacaatgcagccgaccagactggtcgttgccagttacaaggaaaggatttcgaacccaaaaaagagtaaaaactaaaagctgttgcttctatctagcgggagggggtggcggaggaggaggagcttcctaatctccaaataggtccccaatgaagcggatggaccccagaactatcgagaccgatgaaacggaagaatcaaaaaccctggtgaaacgaaagaatcgaaaaccctaacgttccgctctttccaaagctacagtaaaccatgaggattagagagtcgaaaccttacgaagatgcgcaggaagactagccctagccgtcggccacccgaccattagtttttgtttttgtttttactaagggaccgcgagtgtgcaccgtagttatatcatctcgatatataattaaccaactttaatagaaaatcatatatattatcttaaaacaaaacagttttcgtttttagccgccggtttgtttctacagatcatgagcatgcatatcactgccgatgcagtataaaatagggttaatttaatccatgccactacaaatgtggtaaataaaaaaatgccactactattcgtgttatcgactgggtgccactgaaaatttttaaaattaaaatcatgccactcccgtcattatttccgtcctcctctctcacgccgccaacctcaccgtggttgccgccgacgaggtcgcgcgccgaacgcccatgggacgagggggctccgtgtaggacgttgccccgacctcgcagccctttgcaccaccttccacaccccacaaccgcagcgaggaggatgggcttccggcgagcactaggttccacaccgacggcaccgcggatgatgggcttccgccgctgctcctcccaatccccgtctcctcctccagctccgtcgccgccaaccccaccgacgagggctgtcgccgctactgctcccctcgatccccatctcctcctttagctcaagcgccgccgccgctcctcccgatccctgtctcctcctccagctccggtcggcgagggccgccgctacttctcctcccgcgcctcgcgtgcaccatgccaccgccaccgctactcccgctcccgctgctacttccactgctgctgctggtgacggtgaggatgctgacgtgaggaaggaggatggtaaaagtggcgggagtggcatggatccaattttaaaaattttcagtggcacttagccaataacgcgaatagtagtggtatttttttatttgccatatttagagtggcatggatcaaattaaccctataaaataccttgtgcaattcgcaacatgcatcggataaacaagtaatcatcgactaatcatacaagcatatgacggaaatactcccataaaacttaatcctaacacaatgcccctactatgtccaaagaataaaattatccagcaaccaacaatccatgcaaaaaaaaaaaagaattagaaaagtttcttagcatcaacacaggagcaggaatccagctgaggcagatgcagcaagagccaagaagtagccggcaatgccggcgccgcggcgcgacgacggcggcgacgacgagctcttcttctcgtccgccttcgccttggcgctcgacgacttcccggggagcgggctggcggcgtcggaggccggcttggcgtccggcgccggcgccggcgacggcgccatgggcgggtcggtcctgaagatctgcatcgggaggagcaccctgtccacctcgtagacggcgacggggcgggtggagtagacgctgctgctgatcttggggttggaccacatcgacccgacatggacggtgcccatgtcgtcggtgacgttgaccgtgtactcgccgccggcgagcgtgggcaccgggctggccgcgccgcccagcctgttgaactcggcgagggagtagtacctcggcagcgcgtggtacagcgccagcgacttgagctggtcggaggtgaggttcgccgtcgccgacctcgccagcgacgcgaacgccgcgtccttggggacgaacaccgtgatcccgtccttgctgccgttcgcctggctctggaacgtcctgagcacgtccgtcttctccaggaggtcgaggaacgtgtggaacggacccgccacgctcaggaggtcggcgaggtccacgtggcgcggcgccgccggggacggcgccggcgacggcgggaggctcacggccgccgcggcgggcggacccttgtgcttctgcgcgaacgccggtgagatggaggagcagcagagcaggatggtcaccatcatggctgctttggattccatcatcctcgaagtccctgatgtcacgcaagaacagtgaagtgaagcattcagcactgaattttttttgtcatgcgtttctggagcacaagtctgtaactgctgaatagaattactcttaatcttgtgaattctacagtgtttactgaacacatttagtagagtacttaagttcaaatcaacatacaagagatctgtaatgttgttctgtattctgaaatgccagaaaaccaacttcttgtgcttcagattactacagttcgtggtaattctgaacattgagaattttaaccaggctcattattgttcagatctttctagctcctagagcagagttttcagattactgaaatttagcacaaattaatggccctttccctgtcaccaagagagacaaatgcacaagatggggcactttcaagactcgatctagtccgaattgacaactgcattatactactacttcaactgttaggtgccaccaaccaaatcaggagaccacataatctaacacaagaacaaaaacagtactcctactactacatcctgcagatctcagcaccactggaagcatccaaatctctggaatttgggagccaagaacagttaagtgctaagctttgcattagcatttcccttcaacctgaaggaacataaacgcagagcaccaagaagagacgccaagctcaagagaggcgcaaagatctgttctttcctcgggccaagaactgcgaggaacagatccaaatgcgccctaaacaaatggctgcctccaagacgaccaacccatgaaacatcatactggaactcatggaaaccaaaaaattaagagaagagattctgagcatggcattgcagctgaaacaatgctgaggagactgacctgagctgctgagctgagcagggaagtgaaggcagtgaaggaatggaggagagtaggaggggagttaaggaggagagtggctatataaaatgtggggaaagtaaaaagataatgaaatcatgggtggcagctgttgatgaggattgagtagaggacagagagggctcactactgttttcaggctttcatctggagaaaataaaaagatagtaaatccaaaagaagaacagctaaataaaagctggccagataggagctgcccctttctgtcctggctctctgttgtttgttttctgggggagtaggagtagattgcatttgcttctggtggatgattagtgatggcattagcatccataaactgctggtacttttcagtggcattgcaatgcttacaagtaaggaagtttcttgcttttccaaaaaaaaaaaactgaattgtttgcttctttgatcatcctttgctttagtgtaaataacaaaagcaggagagctggaatgtggtgatccaaaaagggtgatgttgtaaagatgaacaatgcttgcttaacttattgctttatcaagttataaagatgatcaatgcaacaaaccacccagtgactcagtgagttcatgtgatgtactgacaaaagcactaatgtgcctcttttggccttctttataaaatctagatagcaggattcctcaaacttcctcaccagctcttttgtttggtcatcgtgttgtcagccgcagctaaaatttatctaattttaaacttgattgttatgtttttattgtaatttatttataagtaaaatgcaccaacggtctttaaactttccaggaggtttcacttaggtctacgaacttgcaaagcgcacatcgaagtctctaaacttggtttattgtatcatccagtaccaaagccgcgttgaccgtggtcttgcctacatggcatgccacatggacgatgacatgtaattttttttatttttttctcactcctgtgcaaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgccgatgcctccccccgcgcccgccgccgccctcttcgccccacaactccggcgctggcccccacgtgtccgttgtcggcaacccctccccctgggcgcggtcggttcaagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtcctctacctccactccctctggttctgcgccgcccttgctcccgcatcgaccggcggaggcacgagagagaaaaaaaaggaagaagggagaaaaaaataaaattattccatgtcatcgtacacgtggcatgccatgtaggcaagaccacggtcaaacgcggctttggaccgggatgatacaataagccaagtttagagacctcgatgtgcgctttgcaagttcgtggacctaactgaaacctcctgacaagtttaagaactgttgatacattttactctttattttttatagtggcttttaaactactaaggacacatataaaagttttatacataaataattttttgatcgttaataagtgttatgacataatataatctgttgtaggcgaaacatgtgctgaacagcaaagcactactgaattcattctatttgtttagggaaaggaagagtgtgacaaacacaccatcggcaattttcctgaaacagaccggacaccaccattaaaaaaatcgagggtagaagaaacctgctgctttttcagagttattgtctggagaattttagttctgaatagaaccttcagtcttctgaaggatgctcaactgcacatgcttaatacagccatataagtaacagcttatgcattgctgtataccactagaagtcatacaagcaaaatgtagtataagattaacatgtcttatgtctcctctctttcttgccttctcttctccttttcctttttttctttttttttttctttccacacgattgacagtgcatgacagtctgaaactctaaacattcctgaatctaaattctgaagttctgaactactacctctaactctaattcgacaagctccatgtaattaagctctaaactggatgtgattacgtgaggtcgcagcagattgtgtcggtggaggaccagctgcctgccctgacggtggctcgtatccggtgtagttaagtatagtacttaatcagacaaaatttgcagagtcattagctgtttccggcggtaggtgaggaaggcttgatcatgaaaggggacttagcatgcatttcttgagctgtcatgctcagctgggctctcaattctcaagcttaaaccaagcattactcctataacttactttgcaatcgacataatcaaatggcttggaaatgaggatcacatggtgtacaaaagcagaattagtgagaatgtaaagcccagcatgccgaaattaagcacaagttttttcttcatggacacaatcacatgctgtatcattccacattgtactcctactcaactcttgttttgctttcccttcagtttgaagaaaccagagcggcatctgtgttactgcactttaagactgccattaatgacccacagcaactttcaatttctttaacctctctcttaatcttggagtaggagtactagtactagtgttccaggttttgatgctctcttggaccacttgaagagcagagaccttggtccttgttcttggcctcttggggcctttcagtatgcctcctctgcttttcaccaactaccacaagagtacaaggtttacttgatctgcaaaatgcacacttctttatcttcatctttggtgttcttttccagattaagttttttacgtgggtgatattaacgtatgattgattgagttttaattattataaacttgaaaaatagattaatatgatattttagagcaattttcatatataaagttttcgcacgaaacacatcgtttagcagtttgaaaagcgtgccataaaaatctcaatcttcatccaacttttgttggagaagagaataggattggttgaatctcctgaagatatagatgaaggtaaagattaagtgttttacgtaaaacgatgtggtaatagcgtgtgattaattgagttttaatattacaaacttaaaaatggattaatctaaattttagaacacctttcacatataaagttttcgcacaaaacataccgtttagtagtttgaaaagtgtgccacgaatatgcaaaactttatcttactggaaatgaacaggacagtcctatcaaaattatcggtttgtgtgctacgaaaattatcggttctcctatcaaaatcacacagtttcggatgcattgcaactctatcaaaacttccagcaaattgaacaaattgtgaagcactgactgctcctaccacttcaggcttgtcgtaatagttgtagctcccatccatgtgatgcctgaagagcattcaaatgcgggtttgagacgtcccaagcataattaccggttcaattatttggccgctaatgaactagtagctctgtcccaaaatattgctgcatactaattggactattggttcatattcagattcattatactgtgatgtgtcacatccaatactatgtaacaacattttaaatcaggttagtactatttctgattttttttctctctctgtgtttttgctctcttccaagccatgccaaatcggcaatcagcggcgtccgtttcgtttgttgatcgcaacgtagtagtactacaactctagtacgtgtgggtacgacgagctaatcctgtgttgcttttggtactggactggacgccgtcatactggattggatgcgccgtagatgaggtaatgtgttgttcctcacggaccaagcaagagcaaccaactgagcaagagtgtgttctagacttggattggcccatttattggacaaagtttgcctatgggcctacgtcaatctggcccatctggatcaaagcaaaacctccacaaattcaggatgcgtctgccattataaagtccaaaattgtggtactgatggaaacttagagcaaagtataggacgtatgtggtaacttcaattttaagataaaaataagggtacgtttaaaataaagttaagttataacttttcctgacactactatagaaaacctaatagatgttgggaatctcacatagatatcggactctccaaccggtaacacgaagacggtacgatgaggggactcatcgcagccggattgggaatcggcatctatggggagttcatgactaaaaaagcatcgggcccgactcgattcatcaagacgagttgattgcttcgaaccaagatcaatattcagaaattgagcctcaaaatcatcgcaaatccaactgcaatgaatcagaatcatcccaaacattacaaacccataccattcatacaaaacaaaataacaaatcaatacatggaagcctaattgtcgtagcccaccaaaggccaaggccaccgccgccgccgcatctcactggaggctgaggtcgttaccgccgcccaccatcatcactgctcaaaaatccaataggccatgaccaaatctagtgggtggtgggagagatccgggagggggattttgggggataggacgaggtgtatctgtcgttgttgctcgaccgcaattaccaccattagatcgggtcggggaactatcgttgtcgagctcaccgtatcgcttcgatctcactgacctcgagcttgtggcaattagatctagcaaccctgaccttgtggggacgcagggccaaggggagggcaccgtgttgtggataggttgccacaaccatcgtgatgagggtgccactgatgaggcgcattcgtggtgagaccatgagagtggcgttgcccgagaggagggtgccaccaccgtggagaggtctccatcgccttgaggatggcgccgccgccgaggcgccgttgtggggaaggtgcctgccgctgaggagagaatcacgcgttgctgatgactcggtagagaaaagcgaggagaagctgaggagaaaagagcgaagagctgagagagagtgtggagagaaaagcgaggagatgccaaaaccggaaatgaggtgggtgatagataagtcagggcgaacggaccatggcttagctcagcttggtgatttaatgtttcgggctttttttttaaaaaaaacccaacacatataatatgacaaccttatatatacaggtttttaatacgaaccggcacatatagatacttatatgtgctggttttaaattttagccttatgtgagatgtcggatagacgggaaaagcttcatatgtgtcggttttaaatgaaccgatacatataagggtgtccctattaggggttttgtagttgtgcgatctttctttcttttttttaataaggaacaagggcatcttttctttcagaatttcccgtaattatttggttaatgtatatattttcatttagaaaagaaatccaaccatatgggccgaatcaaatggcggaatgcacaagcaagcaaccatgtacatacgcacattacagctgacagcgtacagcatgctcaatcgcgaacccctggtggttttctttcggcctaacataaaacgcagcggcagcccatcgttctcgttgcctcgtcggccgaaagttccatgcttgtcgccgggggcaacccggcaaagccaccgcatttcgctcccacgcggtcacactgccaaatgcaccgtgccgaccttgacacctctgccccgcttttttttgattcccaaccgccgtccaccacctccaaactccaaagccctttgctctagctatttctttttgtaataatgaaatataatctaggtcgttactcaaatagttacgatcaattattacaccaattcaatcgaacacaaacatatcttaacaagttataaaaaatacactcattattcttgcataatgacactcaaaaataaataaattatccatattttcttattattttaaactctcgagttaagctgttatgtgtttataactcgacatgatatcagagttcaatgtctcgagttcaaatcctgattgttttttaataaaagttacaacctatttatattcactaaaacctcgacatgatatcaggcttaaggattctcgcgtgagaaagaatgttggaatataagtgaattgcatgtcttttcacatccgcttaaatttctattcatggtagaggttttagtgacccacgcgtgaacaaaggcagtgtttgtcaaatgggaaagggaaataatttcccacccatttttaaatcctaaccattcattctcccttttccatttaacccaaacccttcattcattttcctatcttaatcccacccctcatttcccattatctaaacacacccaaaagtgttagaaaccatgacacccccaactgacactaactccgtgtctccgcacatccttcattcgcccacaaatctcacgccaaaaaaaaaaaagaaaaagaaaaacacggcgaatcccgtgaaatcttcgcttcaattcgctcccaagcacacacgccccggcggcggcgcccgtagcatctctgatctctctcagcctttcaaaaaccatacgcgcgcacaaacgcgccatctctccatctcgccggcgtcgctataaaacgcggcgatcacgcttgcatctcactcacacaacaaaccacccccaagatcaagaacaacaacaacaacaacaacatttgtcaagatgagcgtggagatcgtggacgggagcacggtgcggagcttcgtggacgacgaggccgccttcaacgcgtcggtggacgggcgcttcgcggcgctggacgccgaccgcgacggcgtcctctcctacgccgacatgtccggggagctcatggcgctccgcgtgctggacacccacttcggcgtcgacgacggccacggcggcgccgacgacgggctctaccgcggcctcttcgcccgcttcgaccgcgacggcgacggcaaggtcggcctccacgagttccgcgccgagatgaaggaggtcatgctcgtcgtcgccaatggcctcggcttcctccccgtccagatggtcgtcgaggatggcagcttcctcaaggtggccgtcgacagggagctcgccaaggccgcctaattcaataacctagctagctaattaaccacattgaactagcccacgacgattaatttgagtactttgtttggtaaattttattgaatttggtgttaatttggatttgaactactgcattgttacaatcttacggagcactgctccctctgtttcatattataagtcgttgacttttttctgagtcaaatttatttaggtttaaccaaatttataaaaaaaatatattagcagtatctataacaccaagttaatttcactaaatacaacataaaatatatttcgataatatgtttgttttgtattagaaatattattatatttttctataaatttgattaaatttaaaaggtttgattctgaaaaaaatcgaagcaactacagtataaaatggagtaagtacttttgttatgaagaagaagaagaaagaaacagatcagtcgatcgatctatatatagttaaaattaagaggcattagggaatgatgattaatttaactgttcactgttgtatacatcgaggttcaagattaattaagtaaaagctgcagtaccttcacaaaattatactccttactccttagcatagagctgatcgatggagcgtataaaaatttaactttacatacagagaccaaattatatgcaataggattaatttgccgctgttccgttctgccaaactgcaggcagaaccatcgctgctgagaattgctttccttccttcgttcgttgtgcttcagatcctggacgggatgagcggcgtcgaattcgacaggtacgccgccgccgccgccacgccggagccgagcttcaccgggtagccgatgtccttgagcaccatctccactccactcagggcacccatcaattgcagctgcagagttatggagatcaatgagatgagtcagatgttgctgcaataattttcatctgcaaatcgatctgcagagttgtgtgtgtactgacctcgttgaggtggccgaggtggccgatcctgaacaccttgccggcgaccttgttgaggccgaggccgaggctgaggttgtaccgcttccaggcgtgcttcacgatctcggcgctgtcgatgtacggcggcacgacgacggcggtgacggtgtcgctgaaccactcctccttctgcgtgcagttcttgagcccccacgcctccacggccagcctatatatgcacatcacgccgtcagaatctcacgttcaaaagtttgaccgaatcttgttctaaacgtcaaaatgttcttcctcggtgaccgacctggtggcggtgccgaggcggttgtgcctcttgatgacgttctcgaggccttcctcgaagatgaggtcgagggcggtgcggaggccgtagaggagctggatggatggggtgtagggccagtaggtgcccatcttgtagaacttgaggtagtccttccagtcgaagaagacccgcaccgacttggccgtcttgctcgcctccagcgccttggggctcgcgcacacgatgcccagacccgtcggcagcgagagcgccttctgcgaacccgtcagcgccacgtccactccccactcatccatgcggaagtccaacgcacatatcgatgacaccccgtccaccagtagtagcgccgggtgcctgtgcttgtctgcgcgtatcgtcgtccatcgttgccatggatgagcatgagtaattcatcaagagaaagaagacaagaaagtgataaaaagctcaagatgttaccgaggattttgcggacggcggaaaggtcgttggtgactccagtggcggtctcgttgtggacgatgcagatggccttgatggagtgggaggggtcctggcggagcttgtagtcgagggcggcgaggtcggcgccgtagccccagtcgctctccaccacgtccacgttgaagttgaggcgttgctgctggtcgatccacagcaggctgaactgcccgatcaggaacgacacgatcttgtcccccggcgacagcgtgttcgtcagcgcgctctcccacgcccccgtccctgcaagcaagcaatcaatcaatcttcgggcgccaccatagataaaaggtgtaaatggttaacctacgatcccacttatagattaaaataaaccgtaaacccatttattgacctgtaagcgggtttgcgggttagccagttaaaacccttagctatggacgtggtcgatcgatgaagctaggtaggtaggttggttgggttaccggtggtggggaagaggaagggggtgccggtggtggtcttgaagatctgcttgacgtcctcgaggagggtcttggtgagggcgggcaccgccggcgagcggtagtcctcgttctgacggctcatggcgcggatcacctggtccgggatgttcaccggcccaggcacgaacaggtggttccgccccggcccatacacgtagtccgccatctccctgcccacacacacacacacaaaggcccatcaggcccaaacaaaaaataattattcgtcccacagcaataaaaactcctgcctaatataaccttctgaaagtgttctttgaaaaatgactagtgataatctcatcttactatcttagttgtactatatacggtttgttaattgttttgctctaattatccgactatataacatagcaaacatataattaatacatggctttagttagacataacagtacactactatctcgaaagaaaaacaaaggcaggagtacttgctagtactagttgtcactaataacgcagaagacgttatcaatttggacagtttcacttatccaaggaaaccattagtcctttcttccttttttttaattaaagaaacgactattagtgcgtgctctgatcctacttggcagattaactcgtgcttatccagaagaaatcaattcatgcggctactggctctctgttttgaaaattcaagttgctagctctagacaataacaaagcaaaatttctctgaacttagtctaagtttcaatttcttcttgcacatacaaaatccaaccatatggctaaactgaatttactcatacacctacgatcattgaagatctaatagaagacgctaatggagatggatgtgtgtaccttgttcagataaagcctcctcgatcttgtgctgatgattttttttttcgcacgtaatacgtgcgaaggaggaggcagggaggatggatagggtgctgaagaaggctatatagggagccatggtgtcctttcgtggggcccacacccgtccgacgtggcagataaggggccttgccggtgccttctgttcgtgaggccctcgtagctcgcctcatggagtggtgcttagctgctacttagctctgctctagctctagctgcagccatcactggcatagcatgctaacaaagcgcacggattttgacagtgtgtaacgactactcatacacagtaatctggcttcgtcaatcccatgtatatgtcctgtttatcgtcccaattttatcagatgtctgcttaatttccctgtatctgataaggtgttagctgcaccagaaattatttttcttttttcttttttgttgaaagctttgcatcagagataattagttaagcaagctgcagaggtgatcctactgtttgagtagaaattggagctagaaaggggagagaaataataataatccggtttcgctttgcttgctggctggctgaggcgatagagctgtatggcctgtgagttagtgagtgagtgagaaaaatgacaggtttggttgagtccaagcagagccaatctgcaagccaagggcgcaggagcgtccacgtcggatgttatcccctaccatctcgctttgcggtgtccgtggaaacccagcaattttttttccttctcccttcgtttttattttcagaggtgaggtcaagacaaaagatgatgttaaattgtatcgccatatgcttggagaaggttgagagggagaggatgacggcgaggccacaaacgaacagatgggaggaaggtgatagctagtgtaggtggaaatggaatcgagctgtaccaacgagattttatcgtgagaaaaatcgggtaattcactttttactttgatatttatcgctttcgtatgaactttctcctttaaaacctgaaaaaaaatcaggcgattcacttatacgctttgatgtttttcgcctttgtatgaactatgttgtgtctaggttggctttagcatgtccgttgatgcagtgacttgagtgaggctgtagctgtagctgaagccgagaaaagattgaattctgaaatatgaaccttttgctcgttattctgatgagttcacggtatctgttccatatgttacagaacctgggctgtgtatatccattgtggatgtagaggccgcattttaatctattttctaaagaaaatgttacataacctgaaaagtgggctactgggctttttttcttaattagacgcatagcgcatgttcagacatacgaagtctgaatactgatcatatgtactctcaaggaagaaccacatgcaagtgatacccaattgggtattaaagttgtgtttacagctaaaaggcttaaagaaagaaaagttcaatttttatgccagaacgaaaaaatggagactttcaaactgtagccttcaaaaataagccctcccaaccgggcatgaagtttctttcggttctatcggtcattcggttggctaagagttattaggggaagaaaaaaaaatttgtgtgtaaagacaatgttaaaaaagaaacacgttgacaatatcgtaaaaataattctaaagttaacttttcaaattcaaattttgggctgattcgttgtagagaaaaaaacaatgaggccctttctgtcttaaaactagtcctttctttcctcagcctctccatttggtaaccaagaaagctactacaacggtcggccagggagcaattcatagtctctgaattttgaacatggactaaaaaccttgctccccatgaacaaattcttcaccttcaaatcccaaccagcttccaagtttgtttcgttggaccccaaaaaggcagaaacaaatttcgtctccgacgggtccattttcgcaggaggaaacatctgcatttctttgtggctcaatgattgcgtcgacaaatcctacgcccaaattccagaactggtcaccttggaacatgcaaaaaaagagcaagggagagagaaagaaagaaagaaagaacgagaaagcaaaagggtggtatagtgcagagtgcagaggagaccgtggaccaagaagattctgcatgccatgcggatatacggatgttctccttttcctacatatagacaacgtattagcagcactatcactgcacatgaacaaatccatcaagaattgaaacaggatcaagaactgaatcaggatcatgccttgatcatgcaggattcaccggactgaaaaagatggatttttttttgaatgcgacttaacgaaaaactctctaacttttctttcaatgatggaaatggtttatatttctggtctctgctaacggtcacgcgtcgaagaaaacctctcaacatgactatgtttacatacttctattaggcttccttgcaaacacatgattgaaaaaaaaatcatatgaagaaatgtaggattttggtaagaacacaagtgcaaaacagatgattgcaaaacatacatggaaaaaaatagaatgatcatttgaatagaccacgggaaaaatataagaatcagatgagacatatagacttgaatggaaattttccaaagagattagagctcttgctaaccctcttttaaaatctctatggaattgttcatttcatatgaatttcaaataagagatgtgattcaatcatttatttcaaaagcttccttagcattttgcctttgaaatccctgaaatttcgtatgtttttaccgggagtactgcaaatgaaaggggccgatttcagcagcaatgctgctggcctgctgcgcgcgcgcagcactgaaccgagcacacgcatcattatgatctcttctactacagatcaggagcacaacatcacaaatatattcagaactgataatccagcttctgctgctactatgatcaaaaggtgtttgtgctgttgttctactatgctcgcttggcatcggatgcctgccctgcggcccctgcctgcctctcgtcgcgagacagacaggcatgatggcgctgcaagctgcaagcttagggctggtttagtccccaaaaatttttcttaaaaaatatcacatcaaatcttttaacacatacataaaacattaaatatagattaaaaatactaattgcgcaattaggaggaaatcgcgagatgaatcttttaagcctaattagtactccctccattccaaattgatctacatatagtttttttaggttattcctaaatgatctacatatttgtgttcatttattaagtctactcgttatttgtgcattggagtaaatggacattgatgcatgcatccatgcacacaagtatttataacccacatgcaatatcttgatttgctattggctggaaaatattagggatggtgcatgtatcgagtttgttgctagagtaaatatagtatgagagagttattagcctttcttggtcttggtgtatctataaaatatgtagatcaatttagaattgagggagtacatgattagccataagtgctacaataacccacatgtgctaatgacggattaattaggcttaaaggattcgtctcgcattttccaagcgagttatgaaattagttttttcattcgtgtctgaaaactccttccgacatccggtcaaacatccgatataatacctaaaaaattttcttttcgcgaactaaacaggccctgactgatactaccatactactcctacacaaaaatatggattttttctttttattttgtgaaattttttatttttaattttaaaaataaaatcttcaaaaacttattttgagattctaaacttatttcgagatcacattagtccgtctgacgtgaaaaaaaaatattgacactgcacacaattcagctgacgtggcctaaagattcatgtcttgaaaataagttttaaaagagtttattcttaaaatttaaaa

SEQ ID NO: 18129 - DNA, 7019 bp, Oryza sativa
ttctcgatccaatgatagtttccaagtttgcactacatacgtggtctggactacatattttcgtagcagtagaaaccagaaacggtaaacactgcagctgcctgcgagcagcgtgaggcactgttcggttaaccttaaagaaagtggaaataattaaagggagtttatttcgtacatatgatcgatgatgtaaaattctgcgttcgtccaactcctctctttcgttttccgcacgcacgtttttttaactactcaactgtgtgttttcgtaaaaagattgctatacgaaagttatttaaaaaaatcatattgatctatttttgaaaagaataattaatacttaattaattatgcgctaatagatcgctccatttttcgtgcggagggaatggttttccatagggccgggggtggtgcacggtggactgggtgcagggggggttgtgtacggcgaggaggtctgggactctaggagactggggtggtggtgcgcttctgccaactcggggccggggtggttgcgtttgcgtcttgcggtgccaacgcccttgcgccttttgcggtttggaccctctccggcactgtggcttctgatggggttttacccattttctttttctcctctttctaaaagtttctcttctgtgttgtgtatgtttggtaggttgacctgtgtgagtagcaaggtgtgatagctgaccttttcttcttttttttgagaactctgacctgggtttttcggctcattttctaaggctttgtgaaagtttggaacatgccagcgtttttcacgtgtttttcaaaattaatttggcccaaattcgtattaaaaacacgcaggtatatatatatatatatatatatatatatatatatatatatatatatatatatatatatatatatatttgaaatggagggaggaagtgatatctccttgagatggttggcgatgtgtacatgtaagttttgattgtcagatgtatatcggtttttatgtatgggtcgataaaaatattatgaaatatcggttagctcgattagttatgtacaaaatctttctcggtggttaaatttctagcaaatagggaatcaaaggtggtttttctgttagcaggactaattaggcttcaaaaaagccaggtcctcaaattattggtgttcatattcatttttgtatggatttttttttgccaaagtgagaaatttaattaacaagaccaccgtatcaacgagtatccactttctacgctaggtaaggtaacatgctattgtgatgaatttagctgcttcaaggaattaatgctaaacggcattatctttgatattaacttatcaatgcaatcggtactggaagagaggatatcctaggatttgtttagtgaatcaatttgagatgttgagtcttcaattgaagttattaactatagtacgaagcagcacattgtatatagaacaaccaggtgaagatccagaaaggaaaggttgaataaactatacaaaattatataacctttttaatagatgtatgacagaaaattttagcgggacttaaatagagacttccatggttaaaacgttggtagtgaggggtcggaggctcgagaccctgccgccccatggtagattcgccactgagcacaactactatctccaaatataggacatgataattttcgatcatttccagtaaaaccatggatcaagatccaatgaataggctgttaaagcaggagatactaccaatataaacgactcattcctcattatttctatattccctcacactatttattgtatgcttcaccactttacatggcttctttatcatgcgtaaaacataacctcataactagcaaccaactaattgtgtagttctcattttaccttagttcaatttaataaacaactgtaactaacccccttgtaacaatagctaggtgggcagagaataacctacaaaatccaacactttgaaaccaccaacactgaaggtcaaaactattgtttgtctaaccatcccataggttacccgaaaagaataagccaaaatcaaaatttgaattttagaacattaaaatagttttaaaactttaagttgaaagtaaatactttcaacttattttttttatattagcttttatgataaaaaatatataaattttttacatataattttttttattcattactaaaccgttacgacttataaatacttttgggtaattgatgagtccataacttttcccccctactccatcagagccattgtttggctgattttaagtataagcgaaacggtatatatgcaaataaaaactaatttgtaaataaaacttttatatacgtgttcttagcgatctaaaaggctaaaaaataaacttcgatgaaaaaccttaaaatcagcttcaaatttaaggttaaaaatttaaattttacctgataagtataagtataagcgaaaatataagcccgcataaaccggtaagcagggagtacttggaaagtcaggggtacagacgtaagaccacaataaaacgaggggctaaccatcaaaacaacccttcccccctctctctctctcacacggcctcatccatccatccccacctgagctcccaccggagaaaaccacaaaaccacccacccaaaaaaaccaaccccctccgcgatccccatttcaaaataaccccgccgcctccgccgccgccgccgacgaggaggggtcaccgatgttgtccgaccaggagctggcccggtacgtggagtcgttcgtgcgccaggcggcggccgtcccgggcgccgtggcggcggcggggggcatatcggcggagtccgtggcgcgccagctcggcccccagctcggcctcgacctcacccccaaggcccccctcatccgcgacatcctcctcgccctcttctcccccccgccgcagggggcccccttcacctcctccgctccctccccctccgcctccgcctccgcctccgcctccgccgccgctgctggccacttcttctcccagcagcagcagcagcagcagctgcagacgttcctgacggcgtcgcagcagtaccagcaccgcggcggcgcgggggccgcggcggcgccaccgtcggcgtacggcgtcgcggcggcggcggcggggtacaggtacgggcagccgttcccgcaggacgaaggggcgcatctgcagaggctcgtccagatgcatcatcaccagcagcagcagcagcagcagcagcagcagcagatggcggcggcggcggcgggggtggccgctgcgccgcccacggctgtggagagcccgcgccccgcggcggcatcgaagaaagagaggtggtgcctcccacgctttgtttttcctcttcgatttcccataccttcgcttcgagttagggcttggattagatgttcttttaggttctcgctccgatttttcagatttggttggcgcattgaggttaggtcaagactaaaaacgctactactagttttttttttctctttaacgctcacaaagttcttgatgagtttaatctttattactactgtggatcgagatatttatcacgatgatttagtgggggtggggtaatctggaaggaactggtttccgagcgattcaattggtttgcctgcttgtactacatctttaatgtccacggacgcttgtggaatcacttctagtgtacttgagaaaatctttgaatactgccgtagggatgtcaaccataccagcataattaatgcctctgaacttgttggggggcaataatggatcccgtcattctcctcaaaatgattgccatgcaagcaacctcctttggcctagaaactaagaatcgtaacgataaagttcattgtgctaaacaaatggattttccatattatttcatctggaaactggaatttaacctccagatcatatttatcatgtttgtttactccacttgattaacttccaaatcatattatttgtgtttacttcatttagattgactttcaaaaaaggaacttctcttagatttgctatttggcatgtgcttgttcagacataatgtccaagaagcatcagtgtgtctttatggaagaatgttcctgatatgaaatccggtgtacagactatgagagagataaatgtgcccttatcttgctaaatgctagcatattttactgctcggtctattcattgaaccttttttttttccttggtcgtgtttacgaaccagtgcaagtactggagtaaagagaagaggtggtccaggtgggctaaacaaagtctgtggtgtttctcctgagctgcaagctattgttggtgaaccaaccatggctagaactgaggtttgttctgctggctcacctctctagtgaattatcttgtattaactattacatcatgtatgaaaccctgacgttgtgactcaactgcagatcgttaagcagctttgggcatacattcgcaggaacaacttgcaggacccaaacaataagagaaagattatctgcaatgatgagctgcgtctagtctttgagacagatagcactgatatgttcaagatgaacaagcttttagctaagcatattagaccacttgaggcaaaaagtaggtcttcttcactctccagctatgttctgcaaaataatcaagcttttgtttgtggaataagtgctcaaaattcttgcagaagattcaaatcgagattcaaagaagttgaagcctgtcgacagcgaacccatttctcctgctgaaactgatgttaaccagcttccaattatcttgtctgatgctcttgcgagcttttttgggactggagagaaagagatgccctcgtctgaggctgttaagcgtgtttgggaccacatcaaaagcaataatttagaggttagtgattattaccaaacttttgtgtattacatagttctcatcatctcatttgaatttgttgtgctataataaacttgtggtcatttcaaatgtccaagcatggagaactacaacaggcaatgcatatttcagttataaacgagtacctaaattgtgttttaggatcaaagcatatcaagttgatgtgaggtagttagaactaagaactacttactagggaacaaatgtaagtgctaagataaggataatagtgctctttaatttcgtatcaatgctgttatatgcctgtagatttttctgatctgtttcatgaactgaattttgtatactggatgcccttcttggtctattttgattttcttggcagatctctcactttctattctctcttttagtttttcttttgtttgttggttggtagaatggttgttggtggttgaacaactagatgcatatggtggttgtatcggatataagttgttgggtgtatattcccatgtgcttttcatttttgaactcagaactggtacatggtggtcaatataattttgtatagattatcataccttatataaaatccagtgtagccatttgcgaggatttcgcaagttgcttctgtgtgcaagttggtttattatatcttttgacctttgacaggagtgaagcataagcaaagcatgtcccatttaagtcactttcctccttactttagtgtcccattcatagctaaatactagtggtttgccacctaagaaggtaatgaatgataaatcatagcataagcaaaatctgagtatacgtattggctgctcttagtttgtggtctattttatccatcatgcaaaagaattcgccacttctagtttctccatattagtttgttttgctgttcatggagatggcccagtatggtagttattgaaaatctgcctgttggcatagctagatgaagacaagaggttgctgctaggcatttataggttggatttttcagtcatctggttagcaagagattttatattatccatccaggatttcattaacataaactataatgtataaattgcttttgcttatatttgtgacttctcttcctcactgaagccattttcaatgttctctgtaaagcacacaagagatccttgtatcttgctgttctagttcaattaaactactgcggattcagtcttatatctatcttgcttgattttgttgcaggatccagcaaatcccaccatgatattgtgcgactcaaaacttaaacaactctttggatgtgaaagtctaactgccgtgagtgtttcggagttgctgtcacaacaccttttcaagcaacctaacaagctctaactggttagttatttcctttcagaacaacatcatgtattgagacttgcactggttagtgtttgctagatgacatccatccctgcttgcaactcctagttagtataggaagatgttgaacaatatcagaattttttaaagtaactggatctgctccttccctgtttgttccttgcaccgagttcgcaccttaattttattataatggctcttaggtgctggaaactactcaatctatttcatctatagcaaggtgttatcttgcatatcttatatgttaaggcagaagttgatggtgttttgttttgttttgcagatgaatcgtcttactggactctagttggtctaacaccctggtagtaggcgctgatgaaacaacagaaaatgctgaaagtgtttattctatgctttgtatccatcaaactgatttacttatgagaaaaaggctgtaggctaatctcttcacagtagcaaggaaaaagaatgatagttgttgcatattatgtagtcttgagtcttcttggaagagtcacatgtggtaggctatcttgaatttctagcttgttaaatactgagtagaaagcagcaccgaagcaaagttaaagctgatgaactttgcttgatgtaaaaatcagcaagcataggtgcgttctatggtaagtagttgctttcacctttgttgcttgaaagcctcttacattgttagtgctcttgttaaaaggacacctgtgctctccctgtattatgttgtcggtgatgcttaatttaaatttacagttttag

SEQ ID NO: 18130 - DNA, 15822 bp, Oryza sativa
ttcctgcagcccagcctttgcttatacgcatcagttgaagtgttcttgcatagtgctgtggtgtttcagaatctgttgtcgcttcacctgccaccagttctacatctgctgctgattatttacaacatgttcttgtagctctacacagtagaccatgcttatgatttatgaagtgttattgctgtcccaatagacctacaagttcttgaacatattgtagaaaactaccatgaccaccagaccaatgatggcacatgcgactattgtcctcctgttactctcatcaagagtaccttctggcagaagcttattcgccaatgtcaaaattaccgcatccaaattctgcagcggttaaaaaaaggttaaaattttaaggtgtttggattttggtcaagaaagttttattgaatgctagcatgtttctgcactgtaaatgcttgcctggtgaattatctcaagaatcctctgaagtagtggcacataaaccttgttcacttcactgcaacaacaaaacaagaatacaatcctatcagtttcttcacctcttttttttttctgccgtaaatccaacattgttaactaatgtaaaaatgttcacatgtatattgctaaattgctaatcatggtttatactactgggtaagccaaatagtaacaagttgacccaaggttcaatttaatcagactgaaaaataataatctgaaattagtttacttaatgagcagcatgcccctgtagacgtgattggtggtgatgttgcagtctaggtcccaaggcagcttcttgcccttccattctgcaaggcaaaacgcagttaaatgcagtaattttttctttctgaaactaatttgtaatgcagtaacaaaagccaattcaggtgaggttatttctgaacaaacctagagaccatttgacgcctaggtcgaagccttcgttttcagtcggcttgagcacgaacgatacgtggtgcctaagcatcattgcgtggaggagcagaaacatgttctgttaaaagcaggaaatgtgtaaaaaaatgctgccctttacttgctccaaactcgttggatgctacctcatatcttctataaatctaaccatattgttctttattaaactgattaattgagaacttttgaaaattttggttaaaatttgaacaatagagacagctaaatcaatttcttgacagtgtgattttacggtcctaaaggagatagagggagatatcatagttttaaactgttaaatttggtactccctccgtttcacaatgtaatttattttagcattttccacattcatattgatgttatcattaacatcaatatgaatgtggaaaatgctaaaatgacttacattgtgaaacggagggagtacttcttagatataaaaaagtactaaagttcattctaaaataattggtatactacctcttaagaaccacatttatttttctaatttcgaaacagagcaatcactcacgtaaaaagaaccccatttttttttctagagttgaatattgattccttttgttttgaagaaaaaaaaatatagcattggttccatatatatgtataaaaaccaatttagtactagatgtgacatattttaatacaacgaatatggacatatctctgtcctaggatgtgtcacgtccagttctgattcggtttttacgggacggagggagtagttaatttgtaccttgctcacttgtgaaacgtcaatggaggagattctaccgaagaagtagaggcactcgtcgccggcgagctcgagcaactccctgacgctcctgttctgcacggcggagttgagcttcaccagcctcctcaccgcccggaacccgtcatctccgccgccgccgtcgccgaacagggaattcacgcgcactcgccccctcacccccgccgccgccgcgctcttgctgctccgtgtcccggcacgcggcggcgccgccgatgggagaagaagaagacgaagatgacgacatggcgctgtcgtcgaagccgagagaagagctgcatccatggcgtctcggatgtttggattttcttggggatcgcgaggttgatcggttcgaggggtagctagctagatatatgatcgaattcctcgcgggtttggaattcgatccgtggactattccggcgaagaaagcaaaggatcggatggaatggaatggaatggaatgcgattgaaggagatgcccgcagtagaagaggttgcgaggttggcaaggcagggatgctcttccaaacttggcttgaggtccattgccctacaaatgctacatgccatttcatggctatagctgaaaatatgcttcagaaagcttcatctccaggtttaacatggcacatgacaatgtttattgtcatcactggttagtgcatagtgctattcagatggcttcgttcttttctttgattcccaactcgctcacctcgttttccgtgtgtacgcttttcaaactgctaaacaatgtgtttttttgccaaaatttttttctatacgaaatttgcttttagaaaattatatttatccacttttcaaaaatattagctaatactgaattaatcacggactaatgaactgttccattttcggtacgatgaggtacacaaccttaatgtgaattattttaccctattatggagcctgaattgtttttaccatttatcttttttatatcactaaaaggcactgatgagatatagttattccccgatgacctaaatatacttttccttctttatactccatccgttttatattataagatttttttttgtcttacttagattcatccattgattaatgtatatgtgtctagattcattaacatttttatgaatttgggtaatgctagaaaaacttacattgtggaatggaggaagtagtactttacaatgcctcaacacaacatatagagtgaaatagtttagtttttttttttttacaatacctcaacacaacatatagagtgaaatagtatttttttttaattgtcactggaggggagaggttcccacctgaatcttccattgaaaaagcattgtttagattacatggggggtacatgcattagccctagggctagctattatggatgtagagaagacagactatttgaaaaaaatactacaccaagcatcagcctctaatctgtcgttaactttaagatgctctgcccagagtgataattcttctttgcagcgcaggatcagccgttggactgacggctgaaggtcgcggaagacgacatcgtgtcggtgattccagagacgccataaccataagcagagtagatagaaggtcttgtagtgttttgaaggtatgtttggtggccgggctaaaagatgaatgttactcacttcggccacattgggtataactccgattgtcgtccaaaaagctgatgcgaaggggcacatgaagaagagatgattcgacgtttcgtcccctgtctagtagatggcacatactccctccgtccaaaaaaaaaaagtcaaaccctatgttttcgtgtccaactttgactgtccgtcttatatgaaatttttttataattcgtattttcattgttgttagatgataaaacatgattaatattttatgcgtgacttgtctttttaatatttttcataattttcaaataagacgaacggtcaaacgttgagcacggaaaccagggtttgtcttttttttttgggacggaggaagtagaggtgactgcaggattgtttttgtaaaaaggtttttggcagttggcaatcgatcctttgagagcaaccatgcaaagaattgaacctttggcggtgaagcattcttccagatgaaggtgtgaactggatccatttctgacggaggcaatagggcatggtatatccccctggcagtgagatcaccttgctgtgaaagcgtcgagaatctgaggtcctcctcctcagagagggaaatactccctccgtttcgaaaggtttgacgccgttgactttttaccacatgtttgaccattcgtcttattctaaaaatttaagtaattattaattcttttcctatcatttaattcattgctaaatatatttttatgtaggcatataattttacatatttcacaaaagtttttgaataagacgaatggtcaaacatgtgataaaaagtcaagggtgtcaaacatttcgaaacggagggagtaccttgcaatgtcattgtaagctgggatagctcctgtgaagcggctgtggaaagtcttggcgccagagtagaacagatggatcttcaggaaaccgacgccgcttggaacagatagtgcgagaagagagcagggtactgtagacggaagcatttgtctgggagccagcagtcattccaaaaggatgtgcgaagtccattgttgtcctgcgccctcgttaggatttccagctggggaatgagcttagatatctggctgtgtttagttcagcgcaaagtttaaattttagttgaaattagagatgatgtgactgaaaagttatgtgtgtatgacaggttgatgtgatggaaaaggactgaaatttggatccaaactttggatctaaacacagcctagatatagaatgccagtgaggtccaagcttgccgagttcgacgagagattttgaattcgaatttgcttctgaccagagccaattggaccaggagtttacccggtagaggctgaaaaggcgcttgagtagtaatgcatcattttgcatctgaagatttttgatccccaggccaccgaattcctttgattgacagtgtacaaacgataatggaaattatctgagccatcaatcgctttaagcgactccaagagcttatagaattttatgaaagtaatatatatcgttctaatttgaaacaatcctcttcagattaatagcctgggtaaatcttccatgagaaggtcgtccttcttctgttttctttttttggcggtggctgggtcacactgcaagaatcaagatgctgtaaattattggtgagtgaagctgtagggacaaaagggcgcatctttttttttcttattttctaggtgtgagtgcagtagctttagcgttgtactccctccccgaaaaacaaacctacaactgaatacgatatattttagtacaatgaatctgaataaatattatctaaatttatagtattaggatgtgtcatatccagtaataaattgattttctatgagatggagggactacacacttgcactgctggccaatagcccactactgaacttgccaaaaattttccaaaatactgaaataggtctcagaaaatagagaaaaagaaaagggaaaaaaatgtttcgagtttaaaaacaatgaagatttagcactgtacaacaagaacggtgtcgacatgcacaagtagcgggtgcaattcaaactcggcgccgcctcgtacattattattgccagtctaaaaatttcgaaatgcctgaaacttctgtagaagtttattggaatttgatgtgctcttcagcttctcgggatgactattgcctcgttttttcatgagcacacttcctaaactattaaactatattaagctgtatatgtatttttttattgaatagtttcttgaaaaatcaaataaactatgtttattgaatagccactaaaaagctggtctcaacccctgattcgaaccaacacccagtaccgtaagttgcagcccagtaccgcactattggtgcttggacaggatagcaaaggaatatgcctattttgccttcctcatcttttactctagattgagttgtgtcacttgccacaaaaccgggtataatgtatcccccatctttaaaaaccagtgcaaatagactctggtggtttggaagtagtttttgcaggtggggctcacatgtcagtgagatatggataaacatatgtggtgggccctatcggtttcatctccgcccatgtgatgtctacccccacccccatgctactacactgtgcgcgcatcgttccccttctcctcttgcctacatggcaccctcggcgtccctgaccaccaccactctttccgacatgcttaaccaggactgccgccgtgacgcccaaggccacggcaccttcctgccgtggaggttgtcgttgcaactcgtgctcgatctccaccgcttgggtgccgcttgtgtccctaggagcgccttcctgcaccccaatcgtcggtcctaggtccgtgccccagaaaccgccacacccagaggtgccccaattggtaaatatcgtcgtcgttgagaggcctttgagggagagagaggaagccgccgccaaacacatccacaaccaccacacactggctgagtttactcatgcagaagcgacgatggtcgtcttggcgagttgactcgcacgaggaggcgacgctcggtggcaacgaggcctcgacactgaagggagttagcggacacagtggtggtgccgcggattggttttttgaccgcccccgttaaggtggtggaggacacaacgagcttccccccatccgcgcacggccggccgacgtctcctcccctcacatgctgccagccagcaagtcctccctcctagcgcgaccggccaacaagctcctccctgcgcaagttgcggctagtgaaacctcccctgtgcgtgcccgacaggccaggtcctccccgcttgtgtacttggtcgatgagctcctccttccgcgcgcagccgactggcaagctactcccctacgagctacaaagattggtaccgtcgctgccgcccagcctttgttactaatggaaggtgggagaggagtaagaaaggaaagaaagagagatggagaggtgaggaagaagatgggataaggtggaagtcactgacatgtgggacccacttgctgattcagcgagttaaccatgggtaacctaccacgtcaggagaaactgctttccaaatcgtcgaaggagtctatttgcactggtttttaaagatgggatatgtgttatacaatttgtttttgagggatgcgacttaatcaggatcaagatagagggaggtaaaatagacttatccggtaggaaattgaagtctcgtccagactgtcccgaagcctggaacaattacacacctctattgagaaatatttgattcaaacttttgaagctttattcgtcgatattctatcaaatgctagctaggcttaaaaagaaagaaatgacacgggggagatttgtcttaaaaatactatcatactctcttgttttaagttatttgttactccagtttccttttaagttaaatatttctatctttgatatcatttatagaaatttatagagtttaataacatgcaaattatatattatgaagtttagttcacgccaagctacttcaaaatctttctatatagaagtttttcaaagtgattttatttaaattaaatcacttttcaaaatatttaataattaattgttaattagttatgagttaatgattcatctcgtattactagcaaaaaaatcaaaacctttacgctcaaacgaacgcccagttggattatgttacaacttactccctccgtctcataatataagggattttgagtttttacttgtattgtttgaccactcgttttatttaaaaaattttagaatttttttgatttactttattatcccaagtattttaagcacaacttttattttttttatatttgcacagattttttaaataagacgagtggttaaacagtataaataaaaacttaaaatttcttatattatgggacggaaacttaaaatttcttatattatgggacggatagaatacaactcaagctagcttgacagataaaacattcgaaagtagattttcatgttaggaacgtgacttgactaccgatactaaagtggtttatggtttatctagcatacaaaatgagctggatacacgcctactgcgacatgccatgttggcaccatagtactccgtgcaaaggactgttcattgtgaggacgcatgtggggcccttccaccgccctagctctgttgccacgtcagagttgggttgccgtttggctccaataatctgcctcctttgatctctgtggcctgccattccatggccacatgtgttgccctaccaaaataaaacgatgcttcaaaatgattttaaaaaatgcttgttttgtgctgttttgaagatgaaaaattcaattatttgtagcataatatctagctaaggccgaaggcttccaatctgatatgaagctggagttgtggagttagaaaaaatagcttcaccctttcttaaacactacatgctcttacgttataataggatagaaccataaataaaaatagactgtaagtgtgattgtaaaataaaacagtggatccggtggttacgtacatatgttacttcacgcgtgcaagctcgctgcgcatggtgggggaggggatggagggagaatgactatgcttttaaaataatagagatattcatgcatggatgaactagttatcactaggcaaatatagctgacgcattaaacatgtagctgctacaattggttgatcgcgtaactggtaggctgaaacatcatagccaacctcatcagggccggccttgacttttgtggcccggtgcaaaaaaaaagaaggcccccattcaccataaaaatacaagataatatttaaaatctaatttgtcattaacgaatttcacactaacaagtttaaagtacaatcaagcagtcacgatatgctcgatcaccgattagtcttgtctttcctctaagtctatcagacctgatatcgtaatatacatattttggaggtctctaatttttgaaggcccagtgtggtcgcaccgtccgcactgcctcagggccggccctgaacctcatccattgctacttgtataataaatttaagcccttgaggatttgtttattttgttttctatttcctgtttcttttttgaaaatgatagacaaggcaaattttaaataaacgttaacccaatttaaactaaaatcaccagcattctaactcaaactacaacatgaatgttttcagctccaacaacacgattgctcacagaacaattgatacaacagagtacttgccacggtagatcaagcgaggcagtaggcgtgtacgtggccgtggggccaacgctgatcaccggccatatccatcaccagcgaatttgtaccaattctgtcaacctatcctactctgcacgttggacgtttggtttaatttggactctcccaaacaacgcttttttctcattttctctatttcgctatcgtcctttggcctctcctcatacgtactagtctatgcttttagagcttacaaattcattacaaaaagttgtccaaccacgttcatcttcaagatcgatgatgtagatagatactatagctctataattctcctgactttcttctccaaccaaaaattaaaattcgattccaaactgcatttgtagttataatgaatgaaaatcaaaccaaaatgcatcgtcagaatttcgcttaaaacaattcagctcttttctaccatggttttgtttgaagagctcgaaattccgagaagaaactaatgagaaatcagctcgtaaaaatataaaaaacctacaatttttttctactttttagcttcttatttattttctaaattctacaattacaaattcttaaaatcttaacatttagaccgtatgggaaaaccgaagacttagaaaaaaaaagggtgtagttatgaaaagctcctccagcatggttcgatcaatctgatgaactggcggcgatcaatatcattcatacaatgtgtcaatgttgtatgataaaatttccccatcttttacaaaggcacccggatccatccatccatgcagctgcttttgggaaaaggtgcaagaaagtttcagtgccgtagtagtatattcaaagcagaggaatgaagaagatctcagctccatatgccgtaattattattgttgccaacggagcctcccacatgacacatgcgaccacttcaccccccaaccctcgctgtaaaacgctctacctgtagtatttcatattttcatggcaaattagggctaatcatcccaaattaatgaacttccatccaatgacatgaaaaacaactcatcaatcgatcaatattgaataaatcacaagaatatataattagtgtgattgatacagtccaaatggccaataatctcatctaattaagctagtcgcgagaaaggccctggtcttccggctagctagcaccgtagtataaattgtgggctagccgactcgagttcaagcctcaaccttctcttaattaataaattttaatatcagagttttttctcttatatccaacattttaatttacagtcaaccaattcttcagccgtattacggagtagttatatgttgctagctgcaacgtataacactcctatcctaagctactttacatatcattattgcatcctggaacaattcttggcctctgatgtcaacttctcgatcatcagtataatccactcaacaaaatctgtccatggattatttctttgtttctaactcaaatcccaaccattatattgctgtaaatcagtaatatgacactagataattaagaagaagaagctggggcacatgcatccaaaagctagctagggaataataagctcagtagattagcacatacactaacctcatcattttggggatgaaaaagatgagctaatttccaaacacatcacaagctcgaataaactagctatggctgatgcgtagctctaggcgtttgcacccgtttcaattcaaatcacagatctgaattcgagcgcacattcttcgatcggctcaagttgcaatgtcttcacgctagtgtcgatcgagtgatgaagatcgatctccctgatctctcgatcgtgcgcacaaaagaaaatgatttgagtaatgccataattaaagatcaattggtagatgttggatatacttcaacacacacacacacatgaagtaaatttacaaagttacatgaaaaaattattcaaactgataacaacaaagtaaagtcatatgtaataacaaaactacagttagaaagaaataaaattacaccctgcatacattagaaatatatactaaacaacatagaattacaattattttgggacggaggtagtacagctttagatgattgaaaacttccaaattttcagacgtttgaaatcccagagataccctaaatttcataaataatgtaccatgtatgtcaggatatagacggttacttttttttgtgtagtgctggagaaatcgaaaaccaaagtgtagctggcaaattaagaggctaggatacaagggctggcactatagaacgtgcatgcagatgcaggaacaaacaagtggtcaggtcagggcggtgcgtggctgcatgcattgcactgtcatgagcacgatgacccaatccttacaactcaaaagctctgcttcccctcatggccatgtccagcttgatcttggctttttcttcaccccatttatgcctctttgttctttaactatgcaaataaatcaatttccataggaaaaaaataaacaagactaatcaatttttggatccaatgtaaaatagtagtgcatcatgtaatcaatgtgagcttgtaggagtgtatgtacagctttgttctccaagattcccagcatagattagagactcgtttaatcatgctctaactcgtaaatttaacttcaaaagttagatatagagctttacttctctagatcattttataagagcatgccagcttattccgctttctttttatgtggagctgaaacgttttaatcgtactttagcttcagaagaaatgaagcttaagttggcctgagctgtgtcaaacaggcctagctagcaaaaaggccgatcagtttttgattagtgaatgggagcagtatttttgatccggtcacgcagggccacaaattaaagctggattaattgcttttaattaatcgcagtagttcatctcgaaaataattgaattagttgggaccattttggcctcgaaacccctctataaatagcccctccacctcaacacatcgcttcacacacgagatctcatcgatcagtcacagtgacgcagtgagcactagcttccactgctcgcatcgcttgtcatcatcatcagttcatcaccaatggccaccgtcgaggcaagtagctagctactgatcattcattcatattcattcatcctgtgacaagacgaggtttgcatttcgattcgatcgaaatcgatctcgtgattttgttgtgctgatgatgagatgaatgcatgcatggttgctttgcttaagagcaagtttaatagtaaaaccaactaccgactccaaatcatttgagtcaatttagtaaccaatttatgtactccatccgtcccataatgttgcaacctaagattggatgagacccatcctaagactacgaatctggacatgccatcctacgactatgaggcatgtccagattcatagtcctgagacccatcctaggttgtaacattataggacggagggagtaatagttacctataaacatatactactacacaattcatatttggctatacatatcacaacacacatgtatcttggagtttgtgctacagctggctataaatctatagtccactatagtccactgatcttctatcttctcgaaatgtgtttatagctggcttatacctgctcaaatgctgcaggtccaagcagtcgccgccgcgcctagtctggcggcggaggaggctccggccgtggtggaggctgtccaggaccaggagccggtcgtcgccgccgttgaggaagaagaagccaccgccgccgccgctgcggctgcggctgcgcaggtcgaagagacaaagccggcagatgatcaggctgcggctgctccggcggagactgtggctgaggccgaggcagaggccaaagaggcagagcctgcagccgccgaggaggccgagccggaggcggagacggcgccgccggcggcgatcgccgaggccgaggcaggtgaggcgaaagaaccggagccagaggcagaggcagaggcggcggccgctcccgtcgaagaagctgctgcggcgcccgtcgaggtggcggaggaggctgaggcggcgccaccggccgcacccgaggtggctgccgtcgaggccaccgagtgagctggcgagagatggcgagccggagatgaagctgatggctgccggcggcggcggcggcggcggcggcgtacgtgtgtgttgtgtaatgaattgggctccaataaaaatgtgtcaggttggctaccgggcccagtgtcagtaggtgctgacgtggcaggtcatcactggccctggagctcgtgcccgtgtatgttctcggtctgtgttgtggtttcatcgttaaaaatgctagtaataattttccgtatctttttttttgttaagattttctcttttttttttcatttttgatgtcacgaactcatgatacgagacatataagacacggtattgagggagctaaaatagacttattctaaaaaaggagcacggtgtgtctgctgtgccggcccgactgatctcaggccatgcctgatcatgcctgggccgggttgggccggcggcccatttggctatctatatggggatgagcttttaataatcacaatgcttgatgcagtacagataaacacatataagtagtcactactatgactgcaccggatccttatccatagaagtatgtgtgagtgaactacttggtggagagcttttgtttttctcatgtataattggcccgcagatggtactgccattgcaaattttaagcagtgcaaatctaattcgagtggaatttatgtagcaggcatataattaattgaacacattacgagtttgtttggaggatgtagtagtaatgtgcaaagcatttttcagttgactgttttttctatgtatgtacaacaataaatagattgttgcaaacagatcctaatattaacttcagtacttcatgtcatgttcaacatgtttaagaatactgaaagttgacaacatatttatcctagtgatgtgaacatattcaaacttaacaaaaagttggctggagtgctactgtgaagaacggaggttaacttttgatgctattaaagtgaattagaatctttcggtgcatatatctgatgtcgggaactttcagtgttatagaaccaatttcccctataataaatattcattctggtgatgtgaatataatatttttctcagtaaattattttcttgtcttaagtgttattgtgaatatatattaatcatgcatgatggagaatgatcatttacaactaacttatatgctatttttagaagaaaaaaaaacagtttttgtttgtggcattgcaaaaggctatttgtttagttgcataagttcctcaaagtactgtagattaaagttaatggcattttgtgtatactaatgtcaccatataaatgcatgggggaataggagcatgattgcttaatttcggaaagattgttttgaccatggttaaacttcagaaaattgctgcaagtagtttgtatggtcttccatgcaaactatattagataatgcttaatttcagttgttatagtttacctctctttggcgttatccacaagcagttgtcaattgctaaaatttcgaattgccacattacatgatgtgctatttctatattatggtcttacacaatttttttttaaattctcctgtgatggcagttggagaagatgaagataatggtgtaaatcatgtaatggaaggctgtaggatctttttgtaggggtgctgaaggatcaattatgcgtctgcaatgcatggcctatttacgaaaattttggtagtatttcttatgtatttactaaattcagcaataaactacacgtagacacctttttttataactttaccaaaaaaaaaattgtatggttgaaaatggcaacaatctgaatagccccgcagttctttcacagtgtctaaagtagtaagcatagactcctaggactgttgatattctaactatattaaataatgctatgtttcaactaatatggcaaaagtgatatttgatcttaattggaaattacagttattactccactaaatgtattttgtttgtacgataagatattaattggaaattaccgttattactccacggatctactaggttttattggaggcctacgtaagcccatagcatttttagatcaagaccaccattagctatactcctttaaaaataatccaatggtgttgacagtgaatatgtcaccccacctaccccgttgtaatttttacatattacgctttaaacctcttaatattacatacaactagatttaaatggatagccacattttcctatagggaaaaagtgggctacatatttcatggtaaatatgatttattgtagtaaatattgtgatattttttttcttttatatgtagcaaagcacatggatttagctagtatggtgaaactttgctagacctaatgggcttcgtttcctggccttgggccatgcatctcatagaaaatcaatttattactggatatgacacatcctaatactataaatttagataatatttattcagattcattgtactaaaatatatcgtattcagttgtaggtttgtttttcggggagggagtacaacgctaaagctactgcactcacacctagaaaataagaaaaaaaaagatgcgcccttt

SEQ ID NO: 18131 - DNA, 4428 bp, Oryza sativa
tacttctgtcctctcgttctctctcctctccatcttcttccccatcctcctccgacggccggttgtggtggtggcagcggcgtctacgtcggcggcggcaggcggtgtcggcagccgtgggcggtggcgcggcggccgcaacgggcggctcacgggtgacggcgtcgacaggcggcggcgcgtgcgcggtagcatgggaggcggcacgcgagctacggcggcagtggctcgcaagctgaccgatgccgacggctcgcaggctgcccggcggcggcaacggcagggtgacacctacaagatgttcgacaaaatggtgacgagggatatggtaacatggagctgagtaatctagtcaaacactttctatacatacctcagctcctaaaggagccaacttttactggagttgaagtttagagtttggagctctaccaaccgagaccttataagagggatggtcttataatctacaaggccttcaccagatcctatttagcttgtagatcgattataactcaaaaacctgggtcctaagctaaaacacacacacacaaaaaaaacactaaattggactttgactaggggttgaaggtctgaccgtttggacactggtctgaccacatattattgtccagtctgattgctcaaagattagcggtcaggccggcctggcagtaaagtttacaatcctttttctaaatttagactaaaattgatctagtgctaaatttagctgtcaacagaaacattaaaaatttgagaatgttatgttgtcggctcctgagattgtaatctatttggagttgataattgagatacggacaattacataatcaaccactcaacacatatcatactcgctcaacctcgatatagaacacacgggtctttccatgcgtctaggagacgacaataccgtttgtttgtcttccattcaaccgacgcttcgagagaagagggttggggtacccaagtccctagatagctagggcagacatcatagaatgccatattggtgtccttggtagtaggagtcgtatctacgagacgaaaaccaatggtgagtatcttaggtggacgtattgaactaaaataagatttaaaattgacaaggaggtctcactttccacgtaagtgtatcgtgagggtgttcacaatacgggctacgcactcaagaggcccaagagaccaactatgctcaagatcgttgtaagtaacaagcttcacactacatcgctcgtgtacgcctggcaaaaccacgccacgctaggatccgccctccacaacacggcggtgtgcccatctctttacgtcgcatgctctccatgtagacagagaacgcgtgtctatctttaattccgtgttcttcgtttgactccgcatatggacgacatagcgttgaatatttttttttccttttttgcgccatgggtacggaacaacacgtcgattgcattgctaacgccctgaatgtcgtaaacgctcacgctactgtcgctgctactgctgctcgtaaacgccggaggcattttgcatggaacggcttggacatatctctggtcctggacttggtcagtgactgaggtgagacctgtatattttggcgttgaattagaaaggctatcgcacactgtatttgtcatggactcgttcagaaaacatgggcaccaaaatagtagtgccagcgctcacacggcaatactaataagtacccataataagcacagttgtagctttcagtgtcaaattttgatcaaccgtcttatttaaaatatttttatgattagtatttttattattattagatgataaaatataaataatactttatgcgtgacttaacttttaaaaatttttcataaattttttaaataagacgaacggtcaaaagttaggcacagaaacttatgattgtacttataatgggacggagggagtaataactagtgaactggcgcacacatataagttacgtcgcatcatgcgtccaacgaaaggtacaaacctatttagcacagctctagctttaactttaacttttctagagctgaagttcactaaaaaaagtttcagtttcacctaaaacgaaagcgaagttaggtaaaagcagtctcataaaataatttatactgttttacaaccatattctagacccaatttctataccaaaattttaaagttgaaaccctaccgagcatacctcgatcgatcatgggaccgtcacacggcttcggcgtcgaaatccgggagcaacagccggtgtttctgcaaattgcaactgttagctagagggaaattaatgattgcgacctgttggccaaactaataattccatgaggatcatgacaaggcctgcaactactgatagtaatagtaaatagcaatccctttcgtcatggacctacactactacacaaaatccttggacaaaaacacatttagattgcatacggagtattactggtcgtgtttagaaaaaataagcccattttcacgtacggtcgcattgaaaaatacccacccctctttccctcctacccactttaaatttttccccctttctcacctcccctctttttctcctctccttccctcctatccactttctccacttccttccgtcccgtcctctcctcccctcccctccccttccctctcctcccctccccttccttccctccccgatggtggcaatgggcgtaggctgcggctgcggcagcggtggcgcggcgatcaatgacgcgcgggatccggcaggcggtggccgtccccgcatggatccgtcggccgggcgccctcccctacaggatcccgctctcctcccctcaccttcctttcctccctagatccggcagaggggaggggcgtcagcggcggtgcggccgaagggaagcgcggaggccgccgccgggagcagcgtcctcggccgccgcggggaggccggatccgtcgctggccgctgtggggaggccagatccgtcaccggcaactgcagggaagacggcagcgggtctcgggcaaagtggcgacgacgatagtggtgacggcgacgacggtggtgacggcgtttttgatttttttttgattttttattttcccatgcaggcagtttaagcgcccgcgtgcgggtgtgtcacccgcacgtgaaaatcgtgattttcacagacacctcgttccagacgggtggaagatccacacgcaaaaaccgattccgaccacacgaaaaaaatcgttagtctactagtgttattccatttttagtctctcttgtttaccacaaaataaatttaatttaaattttagcaatcattataccaaattttataaaagtaagagataaatgcattgactgggagtagataaagtgagagataaggattcgatagagcagaagtagtgtatgtggaagtgtgaaatataaatttatttagaacagagtagtgtgtatatctctttataaagaaatactactagaagtatactagtatatctctttagagaagaactgctagtataatacttcctcattttttaatagatgacgccgttgactttttctaacatatttgaccattcgttttattcaaaaattttatgcaaatgtataatatataaatcacatttaaagtattataagtgataaaacaactcataacaaaataaattataattacgtaatatttttaataagatgaatgatcaaacatgtgagaaaaagtcaacagcgtcatctattaaaaaaccgaagatagtattgtttttctcatgctagaagccgaaacggtcgaccttgaccggcgacttgcacacgtacatactagagactgaccagatccaaagctcaaaacagagcccaagtcgaaggccaagtctgcatttcttggtgtaaaaaaaaagtctacatttcttctccacaacactaattttcttttgttcttttagataatatcttggagttttatataccctttgggtgtttggaggcatgcacgctgtgacacggacagatcgctgtcatctttttccctctcttgtttggaatctgccgtgcggacctggtcacattcgtggttcgttttgcccaatacaaacttgcaatgtcgcaatccgtcttgaccgctgaagaaaccgtttccttctttttatctcccttttttatcttttcgttgttgccatgatcattgtggagactgttttattgtgggcggtcaacattcggtccattttacaatattaaatacccatgcattgcaatcagcttatattaaaccctacaaaataaaataaaattattccctatctaatcatcctaatatatgtggtaaaattttgtacgtgcatgtcgagttacacggttgctgaacaattgatataaatatacatgttgtatgaaattcatatagtgaacgctcaaatataaacccacat

SEQ ID NO: 18132 - DNA, 20334 bp, Oryza sativa
aaatttagaaaataacaacccgaagcgtagtttaggacgcgcacttcgtctgatcaaacatttattcattccaaagagatcaaacattcatgtattgtcataggtttcattttgccccttcaatgtatcttgacttattgtgctttaaggttaatgttgtaccacagtattttgtttttgcagtactgtaaggaagtgatagcaagcatttctctattaggtgtgatatattattatcgtacctcatattatttcccaaaaaagtatggtgtaacatattacttttccgtatgctgaatatattttaaatagagtgtcgctagctagatttcaatgatctaaatcctcaaaaatttgcttatcctaggatccatgtcaagatttgtgtccaacgacagcgtgatgatggtggtggcgactgcgacactatgtttagggtctatgtttggaggtgtgtattgcgtgaccgtgtccgcccactaggcaaagtccaattcttctttttaacaattcggcagtgcgatgttcatattgatagagcagaaaaatgtaaagttcagttccaatttctaattccaagacgttggcatgccctcctccctctcaagatagcctctaccttcggttcaaaaataatttcactttaatttgctcccttctaatatgaatgttattcattcaatatgttttatttatatcttacctactcacgtaaaattgatgttgctagatttatcgttaaacaaactatcataatatgcaactctttttatttattttttttatttttatagatattgttggtcaaagtagcatattaaaaattgtgtcgaagtcaaaagtacttatattttgggacgaatggagtatcatagtacaataaacttatattattatattatatctaatttattttttttaaaggacggatggagtattctggtttgctgccgtatctgccatggcgattgaggtgatcgatcagttcagacttcagagcctccgtatgattgactggatcactggatccactcctccacttttgcccgaatccgtcgcagctgattgcgaaacagaagcgcacatcgctttacaagtttacagctgcttggcactatctcagcttcgttcttcatctataaatgatcagctttaggctgtgtttagttcagtgcaaagtttaaattttggttgaaattagagatgatgtgactgaaaagttaaaatgttgtgtgtatgacaggttgatgtgatgaaaaaagactgaaatttgaatccaaactttaaatctaaatacagcctagttagttggttaatacaaagtcagaggtatatacgcgtgttttcacctgcccagatgcatggtttcttctcctgaaaaaaaattatattctagctctatctgcaggtcgaactagcatgaagcaatcaagagtaagttaaatcccgtttgtttaaaagtttgaatgatcatttgcagtactaaatgagcagaggaatggaagcatgtactactatataagtaaaggccaaaagacaagcgggaaattaaagaacaatagtactttataaacaaacaagcacctctctatcccaagacttgacaccatttaccaataaaaattatcatgacaatctaagttggggttatcaaattcttcgttatacatttaacaagcgcaagcaaatcctgccattttcttttcaacgttgatatgtgagcgctatgttggaagcgaatcatactacaactatgatttaattattttcggccattcccacaactctacgagacataaaacgaggcaaattaattgattattaattattacaaacatgaacacgggcggtctacttatgttttaatgaaacctctatagaaaagtttttgaaaaagaaaaggaacattcagtaatttaggaagcccgctaacgaaaaacggaaaagttgccactgctaatagcccaaacaaacggtgctagctgcaacataacagcttataagttgatcataagttggtcaaatactatttaaaggccagttcttttcgtttatgtttatgcttataaactaaaatttgaattttcaacctacaatttaaatgtgatcgtgaggtttttctcattatagtttatttttcaacctttactttcaaatcgctaataacatgtatataaaagttttatttacgaattatttttcgtttgttaatatgccgtttggacgatggagttcttaaaaatgaactgcatctcatatttaaaaataacagaggtagcacgcggtaaacgataaaataaataaagtactctctccgtcttaaaaagactgaatttttaggtttacatgtccaacgtttgaccgtccatcttatatgaaatttttttatgattagtattttcattattgttagatgataaaacatgaataatactttatgcatagcttatctttttaaattttttcataatttttttaaataagatgaacgggtcaaatgttagacacggaaatcgtttttttttttacgggggagtatactgatagctaggagtaacaaccaaacagttggagacaagcacgcggttcgagcgagcgtcgtctttgtggtgcaatttctcgggggacgccaagccccgctcggttcacgggcgtctcactgtgcggtgggcccatccccagccgtcccctcgcgggccaccactctctgatgctgacaggtgggtcccaccctctcgccctcttctcccctatatatacatatagtacaaaatccccgtgtgccaaactgccaatattctctctgccaaacaaaaaaaaaggaaaaaaaaccaccgcttttcgcagtgcgcttcttctctctccctctctgctctgctcttcctgagctccgcggcaaggaagcttctggaaggttctgcgggatgacgacgagcagctggggtggtggtggtggtggtggcggtggccccgtgcggctgtggtgctgcggcctcctcctgatgctcctttcaggcggaggcgggggcggaggcgccgccgcgcagaggcccccggcctacaagaccctctccggtaagctctgctgcctccttccccggtggcgtgcggggagaggaggagggggaaggggagggggaggaaggttctggcaatcggcctttgaacctttcctcttgtttttgttctgtttcccttttctccacggcattcaacgactctggtttgaatgggttggggttggggtttttgcttttgagttgattcgtattatataggatttctaaggagcaattcctttttccatggctggaaatcatgtgagcagagcagcaactgagcatatgacctggaaattgttaggagtttcataataagttgagaaatcgctgcaccgcgccgggttaattaattgtttcttgtcctttttatctgcttaattaccgatcattacttacagctctgtaactgataattattaccaattaaaattatagttcttggtgtgtttatgggttcttgctattgatgtgtatagcctgaattgagcaaaccattgggcatttgctattgcaggtaacgcgcccatcgtcatagctgaaggtggcttttcaggagtgtttcctgattccagcaaaaatgcctacgtttttgccttgtcttctacctcgggtgacaccgttttgtggtgcaatgtgcaactaaccaaggatggtgtcggaatttgcctccgggatttacttatggacaactgcaccagtataagccaagcttaccgagcgggaaagaaggcataccttgtcaacggcgaagaaaaaaaaggatggtttcctattgactataccatgtcttcgctgcaaagtgttatctgtaagtgtcaacctattattttttcaactcttctccagggttcaccgtttaggaccgaaatttcgggtttacccctgggtcctggtagtatgtgcctctgatgttcaagtttttttaaaaagaaattccctttgatcaccaaaacacatgatggttttgcctcttagctcttcacatagacataggcactatatgctttgaccgaactatcacaccattatgatattaaaacagtattcatgaagcaatgcactatttggcgtacctatcataaaactgcatgtgtgatgatcttctgttaactaatgactctgatcaaccaagaaaacctgtaaatgacgcatggtaatattttttttagggtgacatatggtaatttctgatcattgtgtcaattaagaaatctccctggtctcttcattataacagcatggcacaaaagataccgaagtcatttagctcctccagccaccttagcagcatcagctttcacgtcatacactgatgtgtccaggccacactgtgcagaaattaccatttgtagttaggtgggatcagttggttagattgtgttaatgacgagaacttttaaaatgtatttccgcaataggtattccacacaatgtgtattttggctaaagcacgtgtagaatttactctgattttgattggatgatgaaattcctctcttgaaaggtgtgatgtgttgatgtgatttgttgctaacctggtatacttctgtactctttttatgccattgaacagtaacacaggcaatttggtctcgcaccgacaagtttgattttgcattccttcccattcttcctgttaccaatgtgatagatttggccaagccatcttctgtttggctgaatattgaggttgacctactgctcttgcaacttgaacttgcaaaagttgttgttgctacttgctagctgttcatgactttgagttccatagaagctaatttatctttcattcgtgcagcacgatattttctacagacagcatggtttgaatatgacaaaatacatcctttcaattccgaagggtggttctgtgcagtatatctcatcacctgaattgggttttctccaaagtatatcaggaagagttaatcgcaaaacgaagctagtgtttcgttttcttgatgcaaccagttctgatccttcttcaaaccaaacatatggttctctgttgagtaatttgacatttattaagactgttgcctctggtataatggttcccaaggagtacatttggccagtgacaactaataactatattcagcctgccaaatcaattgtcagagatgcccacagtgcaggtttagaaatatatgcttctgactttgcaaatgatagaattattccgtataattacagctatgatccgttggaagaatatttgcattttgttggtagtgataacttctctgttgatggagtattatctgagttcccactcactgcagcagcggctattggtaagattctatcattattactctaattacttatcaaagttggaaagttcatcagtactcctctctgtaaaaagttagtgaatctgcaagcaaaaaaaattactaagaacaaaatttgtcaatggatgcttgatatttgtttgataaggaacaacactactttcatagctttatacctaataattggtcaccaccaaaatactgtggttcgtttgctctactgaaaactacataagccgattggtcaaaaaatgatcattcaatcctttttcttttggaaaggagatgatcatctgatttagttctttcttttgtagttagatactttacataagatcttgactgcaagtagaagaagaatctaggattgttgactcaagtgcttgcacatgggaaatttctttttatccaggggttgggtcattgttagcccaatataaccaccacagttactgattttccccttatccttaatgaccaacttttctttattttttttaaacattcttacagaggagcacaaagtacgtcatattgaagtttcatctacagcatgtcagttttaccattataaaattagattctatcctcgatatgttttaattttgtgctttttggaggagcactgaagcatttccctgatttgtaatatagaggaataaattgtaaagttgaatgggtgatcatagataacgatgatcattgcatcaccagcatatttggcactgtctatcatgtaataatatccataaagcatgtttggtttggattctataataataaaaggctatacaaacttacgtcctaactgattgaagattggataatttatgccttttctgcccatatactaactgattgccttgtacttccaccaatcacaattatgatgctttctttaattgtttggtgaagtagagtaataattaatgcattttaatctctatgtctgcaggttgtttcactaatttgaatgtaagcagtaagacagatcatggtatgtttcatttgggtgccaaacctactgtacagtaagacccatgttgcttgatacccagaagttctacttgatctaattgctgtagtgtttctatacagggagcccattaattatctcgcacaatggtgctagtggagactacccagactgtacggatttggcttatcagaaagcggttgatgatggcgccgatgtcattgattgttccattcagatgaccagtgatggagttcctgtatgcatgagttcaattaatctgtttgagaccacgaatgttcagagaacccctttcagcaatcgtgcttctatctttaaagatattcagcctactccaggaatcttcacattcaatctcacttgggctgatattagcagtagcgatttgagacgttagtttctttacctcacacttgctattttttttctattagaatttatctactctatcttggcaattaatgtggatggcacaataaatgaagaaaaataatcatgcatttgatcgttgtctacagccaagatatcttccccagagagtatatattatcttgtaaggaacccagtgcacaaaaatgcgggaaatttcttcaggttatctgactttctaacatttgctaaggataaagatttgtctggcatcatgatcatcataaaggtgatgcttcgtcttgaagtacttcatattcttgttaatctgatcctttagcttcaaattttctaccgcttgaattacatatgcactatcatcttccttctgtgggcaaaagttcttctgaaagttagctttcaatatttgtaagacaaacatgagttattaacacagcctgttttcggaagtctgtggtgcctagtaataatatattttacattactaccatatatatctatatatgtatatgtaaaattatattttcctcattcttgtcacatatttggaccaatttaaaatatttccgtatcagtggagccttttacattgatcaaaccttttgtactgcagaatgctgtatttatggcaaattcattaggatttgatgttgttgattctgtaaccaaagccttaagtgatgctggctataataatcaaactaccaaagccaaggaggttatgatccagtcagaagatagtgctgttcttgtcaacctgaagcagctggaaaccaaatacaagcttgtctacactctcccatcaactatcggggatgcttctgcttcctcactggtagatgtgaagaaatttgctgatgctgtcattgttgacagggaatctattttccccgagagccagggctttatcatgaaggaaacaaatcttgtgaaagatctccgttctgctgggctagctatctatgcacaggtgttccggaatgagtttgtatcaccaccttgggatttcttttcagatgtaacagtggaaatcaatagctatgtccagtcagttaatattgatggcatcataactgattttccgaaaacagtcagaagatacaaaagtaagtgtcattttctgtatccaattatccataaggttctattatttcaactcttgcatgtcttagatatgatgaaaatgaaatgttcgttcagctgatcacgcctagtatacattaactctaatggaggaaacaagtacaaaagaataaggaaatatcaactttgcagctccatttaaccaccagcaaattgtgtactgacatcttgctaatctaacatggtttttatcacctagacacaattatcctgtgtactgccatctcgctaatctaacatattttagataaagcaaatatttgtcttgttacttgaattgtgttatgttttgcacagtaatttatcctggccatattatggtgtcactcactgttgctgcttgcacgcatgctgtcctgttggcagtgaactcctgtaccggtctgggagttaacatgccttcatacatgaatcctgcggaaattggcggcctagcgcagctactcaacggcagccaagcccagccaccagctctggcaccaatgccggtactgaactcatcagacgtcactgaaccgccgttcccttctgccgcgccgaagaatgcacctggcggcgctgccaatgggagcacccctgcacccggtgcgtcgccgtcaggctctcaggccgctgctgtcatgagagccggcattctaccgatggtgacggcgctcttcgcgtctctgctcatctgagctgacatcctcagttgaagctgtgtaattggttgttcagagttcagttatcacactttccattggattgggaaagctatttattgtctgtcaatgctgtgctgctaggaatccagtagctgttttggtagggaaacatctgaatatccgtttcttcctgctgtataaatctgtttataggacaaaggctacaaatatattctagcaagcactgaactactgaatgaatgaagccgtaagtgtaactagtagtgtacattgctgactgagctggaagcttcagtgtaatgttgtaattaatctcatctcctgtctgaagagatgcattttgtatgtgttcagaggtgcaggatttcctttgaacttactagacgtggccctaattttgttttaactgaataaatgtgggtgaaatctgtagcatgagatcacaatcttgtctctctcaaattctctctgaaattatctcaggattattggttctgagccagatggtgggggaaataaaggagaaaacgtcctcacctcatcagggtcgtttcgacgagcatcaacagcgagcctctcgccggagacgacgacggcgccgccgccgccgccgccacaggagaatctggtcgagaaggccaagcggggcggaagcatctggaacattctagaaggccggcctcctcctgcttcacgctctaatagtctataaccccgtgattccgtggtttgggccttcgcgcccctggcttccgagagcgccgcgggggaggaagtttaataccataccagaaaccgagcgagggtttcttcagcttatataagcacaggctgtggcgcttcggccgtacccgacgggtttttacttattagaagctaataatgttcttactcatccttagctcttgcagatatgcctctggaggcttttttttagtgcccttgcaccttctgaaatcttacgtttaggtccttatatctagagatggcaatgggaacccataacccgatacccgacgggtttttactctattaggagctaatcgtgttctaactcttatactaatgggtttactgatgggcgaaaactcttaaccattgggtacgtggatatgggtccgttctttaccacccgtacccaccaacccgtgggtgaaaaaaactcgttgattgagcctaaaactatgaggaatataagtctcaatgactactaaatcatagcataaaactcatttcacatcttaaatattgttctagtctagttatatgacattgttattagatttcttgattatgtaatatggttgtataattttttttactcgcctttgaacggtaatgttaatagcattgctgctagagaaaatattgatggtttacaactctaatatggctaattacagtacaaaactataaatgctacaagtcaattatatgggtatggatacccgttacccgcatgggtgtgagtgtggatatggggacgattttgtacccgtgacgggtgtgggtatttaagtggggatatttagacattacgagtgtgggtatggggcaagggaacccgatgggtatgcacccgttaccatctctacttatatctcttggtccctggaggtatttttttactaatttacgtgctggtccttagctcttgcagatatgcccttggaggcatttttttgtgcccttgcaccttctgaaatcttacgtttaggtccttctatctcttccattcttttaacatataccatctagttacctttttaatcttttacttgtaagctttggcccctcgcaacattttgttcttcacatatatccttctggcatctaacaatctttcaaataaaccctttcatcttttatatctcagggtcgtagctacaaccggtttaacttgtatgaattagtccagttatttggcgatggtttgtgaactagccacgaggagcatacagcctgtacgtatggccttgatgaccaaaatatatctgtagaaaatgtaaaattatagtacagttgcacgccattcttccagccaagcatttaataaaatatcaccgttaattgtccttcaatggaagctggggatatctcaatttatcacaaaaataatcaaatgcgaaaatatccatatcaaatagtatgaggtaggtgttgacgcgaaaaacacgcactggcctgagagatctgcttaactctgcttaactctgcaggtccaaagaattgcctttgggttctgagcgtgccagctggtttgatcctgcaaccaacaagatagaaaaaagggcaaagagttaaatccatcaacgataggggattgacaggattgccaatgacgtatcgtcagaggccatgccgatgtaacttgcgtcagatcgacagaggcagatgaaaacttggagattgtttggtgtactcgatcggctgtagatgttagcgatacgtaatccatacaatgggatacgcttagatcgagtgattgggatagatcggtagctgcactgagacagtataaatcactccatatctaaatgtgccccaaagcaaggattatgcatgctcatagcatagccgataggacaaacctaacttgcatcggctaatactccaatactgccttataccaagatatcagcacagatgaaatatgtaaaactgaaaccaatctagcaagcaggatgaacctagcagattaataggaagcttaatatactttaaatagatgagatcttgatataagaggcatatttagactatccagaaccagataaggaagcaagacgactaaatcaggtaaggtcggctaaaactccgatgctatctctattagcaatcaaagaaggaactagataaaacgtttcaagacagtacttaacagatcgaacctaaccgatgtagcattaagcgtggaaagaaacataacgatgtagcattaagcgtggaaagaaacataagatctaatcaaatcgatgaaaacccattcaagattttagatacaccgcatagtctagcttgatatcgaagcctaagcttatcggccgttttcgatgatagaggctagccgatgaagcttaaatgacgagatcaatctagattatgcggtatatatgataactcggtggtttacgtaggcaggattagagtgtcatgaatatgtaagcactaatcccgagaacgcaagccgccataacaagctttacctcttcgtcggagatcgaacccgatgcagcccaactcgaaagcaaaaactcgaaacaataaaaatagaaaagggtggtgatgcgctgaagtatattgaactgtcgtcctttgattatttggtgtcgggtcatatttatacccaaagtacataatatgtccttactggacacagctctttatatctaacacaatttaaaatacgaatgagtccttcaggtggacccttaccaaaatatctctaaggaaactagaaaatgtcctaattaatagatacaattgccctttctaagactccaatccttgcgtggcaatagctatgaagtgcttcaaccaatccgatgacggacgtgggaccatctttcccgagactggttgcattggcttaccttcgtcggatctggcgctttgctgatatgtggcagtcgataccgcctatagccgatgctgctcgtaacctatacgtattctgctttctcgaacaggatttctccaaatgggcttcgtttctaacttcgaatccagctcatggtattaccaaatttggtcgttaacagtaggttaactggaaacgtatcttatgcatagaagcctttgcgcgtacacactgtgcacaccaactaccaattttcataaaaaaattctaataaaaattggacatgtactttcaatagtattatatctatgtgtaaagttttatcttcaaatttactatatataaagggtaaaaaaagaaaaaaaattctaacacatttatactcttaaatctatcagaatttttatattttgtattttagctgtaacaagaaaaataaaaattctgacatataagagaagatcatggagacaccaagaattctacggaattcctatggaatgactggccgaagaaaagaagatattggaggaaaattaacacgccgtaggtttaacccgacggaaactttctttgagtcctccatgtctctgtacgtaaatttatactatgtctttcacgtggctaaaatatcctttcattcaatttttcttatatttttcaacccctgttttatattctcgtgttttctcaaccctgtaattcagagagagcctaagggcatctacaatataagccatatcaagggtgtcattactaactgaagccactcttagagacacccatctctcaatgagggatactcgcagctgggctttcaaaatatcaagtaaccgagaggtactccagcttacgagataccccaacccacgtaaccacgattatgtatttccttctctattcctagcccaccgagcacccaccagcttctccctttctcttctcttttcttcgccgctttgatcccatcgccgtgatcgccgcttcttgatcctctgcctcctcgccctccgcagtagtcgcaaccaccgcctccctcctcaccctccgcagaagtagccgtcgtcgctgcctccctcctcgccctcccgggcaccactgcttcctccctcctcgtcctccctagtggctgactccatctctctatcccactgtcgccgctctcgccctctctcccggcagccgccgccgttcttactctctctctctcgttggcgctctgcccctctctatcccgtcggtcattatcgcctctttctcctgccctttccctctctctcccaccgccaccgctcgcctctctctcgctctctatccccttggccgttgccgctttctcccgctgctcgttgctgtccacctagctagctagcagccggatccactctctcacgtccttcctctcccgccgcctctctccctctttgcacggcgagcggcacgcggggcgtggtggcgacggcgcgatggttgctgcatcccctctccctccgccagtcaccgcctcactctccctccgtggctggtcaggaggccagatccggtcggccgtgctgtccctaggtcgtcgtcgtcgcgaatccgtctttgcggggctgccaacggctcctccaccacctcgctgcctcgcaccatcgctgatgagcaggggagacggagagaagacgagcgcgatgacaccaaggaggagggagcagcagtggagatgagggtggaactgaaaaaacggggggaggggagagcggtgtccacaggctctttacccggccatggccgacccagcgtagctcctcgcctggtcccctagccgaggagctcgtagagccgcgtcccttgtagagcagacacgcgtctctgccgagggacggtgcggcaagcttgaaattagacgagagccgaacgccgtgagccagagccccgcgccgagctacccatggtacatggcctatcggttgctagctagcttgatcacctcaaactcaaacccgtcttaattggccctccgatcctcagggctccaccacctcaacaatatccccatggacggccttgcgttgcgcaggtacgggcctaccgatcggctgggagattgtctgcgcctgtctccgggtccgaggtcgtcgcgcgcggtcgttttcgaggtggccgaggtttctctcgcggcgcgcggggtgcattgcacaaacacgcgtacccaaatacgcaatggtgctaggtaagctgcattattggtggttggcgtggtagtggtggccactgctggtgaggccgaccggcctccttgtcatgagccaaagggaggcacgaacgaacagttggaacgttctggaagaacgtcggcgtacgtggacacgtcacacgtacaagtgagattgagcagacgtacggtagtgtgtatacttctccgtttcatattactagatgttttggcttctctactcttagctagggccctatttagttatcgtataaaaactttacacactgtcacgtcgaacgtttgaatacctttgtgaagtattaaatatatgctaaaaaaataactaattacacagattgcgattaatttgtgtcacgaatattttaaatctaattgctccatgatttgataatgtggtactatagtaaacatttactaatgatgaattaattaggcttaataaatttgtcttgttgtttatcgatggattctgtaattagtttttctattagtgcccgaataccgcatgcgacaccctatataatactgatgtgacacgccaaaattttacatccctgaatctaaacacaccctaggttaactaacaaaaattttcacaatttgaccctttgcaaaaactatttttacaaatgaaccgtcaccaaaacttatttcaaaaataacccttggcgctgaacttagacacctcagcaccaaatagcgtggcgctgaatatgcgttggcacgctgacttagtctcccatccacggtggcacggcattcagcgctagttaacatggcgctgagatgtctaagttcagcgccaggtgatttgacgctgaccaaaagagtcatttttaaaataagttttggcagcggttcatttgtaaaaaaaaagtttttgcaaagggtcaaattgtgaaaatttcaggttaactaatatccatgagtttgtacccatatatataacacattcattgatttttgcatggatccattcaaaatcagaacgtcttatagcgtgaaatagagaaagtaacttggtagaggttgtttggttgacatacccatattgtcaaagcttgccatacttcatttagctaacatgtgtaatatgttgataataaaattgaagccatacttcagccataggaaagcaagcttaccatacttttattagccaataacatatgggattcacatcatggtgaaggaatcttgtcataagtatgacacgaacctggctaagttaagctgtggcatggtaaggtaaattgtggtagtgaaccaaacaattcctacatattcagagaagattggtgatagcttcagtatcaataatgcatgccaatgtttaagtgaaaagatcttttatttccgctgcgttcgttgtgtggtgtatacccctacatgatagtgggggagtactactagtactagctttttggtttgctatcatactgagaaatatgggcaagttataattggcaatgctaatattttagtaatacatgtgtctaatagataaaatattgatagtaaactaaatattaccgatttattattttaaaatgccaatattctcgtaggttacgatatttcagcttcaaaccggttctgaatatccttgtacgtgatatttacttcttccattccaaaaaggcaaaatttgctacaggacacttaaaaaacgtgtaattagccgtgggacaccgcaaaaatatgaattggctgtaagacgtcgcaaaagagtgataattagcaactagacactagagacattattttattatttttagtggaaacgaagagagaaacaattaaaaaagaccagattgccctacgtgcgcccaggatgtcagtctctcctctattttctttcctcttcctcccgacgattgttcttcccgtccgacgacgcatccccggcgcagctcgcgcagctcggcgttcccggagcagtcgggcgtcgccgcggcagccagcggcgtcggcagcggcgtcgttggtggcgagccgtgccggccggccgctccccacggctctcaggcagagcggcggtgacccccgccacacgccctgcatcgccagcgtggacaccggctgcgtgtatgcccacgcatctgtgtcctcgcaccagcccagctccagcgtccccgctgccgttgccgccgccgcgtcatctgccgcccgcctcaccacgcagcgccccgtcagcgggtggaacagcacggtgtacggtctcgcgtcgtcgtagccaggccctgcatgcatcgcatcgccggcgaccccatcggttagaaacgcgacgttcgtgcacgacattgagccggtcaccgaagaagacattgccgtcatcgtcggcgcagcaccacccgggctagctcacgctgttctccccgaggctgtctggccctgaacgactcgatcagcatgaggtcaaggaaccccgggttgttcgcctcgacgccggcgaccgcgtcggcgaggccgtgggcgagtagcgagcgccgccgcgaacgtcgcaggtgggggcgaacaggacaacagcagcgtgcgacatgccattctggttctgccgggtgaggcggagggggccggcgtacgcagcgccgacggagagagtgcgcagcacaacgaggaggctggagagggagtgctcgcggccaggggcattttagtacttttaacgctctttctctctccattttcaccggaaataataaaataatgtctccagtgtccagtagccaattaccactcttttgcgatatcctacagccaattcacgtttttgcggtgtcccacggctaattacatgttttttgagtgtcctgtagcaaattttgccttccaaaaaaaactcaattcttaggtttctatgtctaacgtttgaccgtccgtcttatttgaaaaaaaatatgaaaaaatttaaaaaaataagtcatgcataaaatattatttatgctttatcatctagcaataataaatatactaatcataaaaaaaattttatataaaataaacggtcaaacattggacacggaaatctaagaattaattctttttgatcggagggagtaaggttgtggtaggctacacacgtacggcaaattaatgaatgattttcttttcttttcagggaacagtgctacatttaacatggccgtcgtcgtcgatggtcgatcaaccgatggactgaaagagataattattgacacaccaacaaatgtacgttcatactttctaaaaaaaatgtacgtatacgttcattaattcgctactcctagctggttagctgttgatcatatcgaataagcggtaatctgccaaccatatttttaatcctgttacgacctgaggcaggcacatgtacatactatagttttcttccgttccaaaatattccacataacacattctaataatactataaagttaaaaatatcttttaaaataaataaacctcctgttcatcggcctaccatgtaaaaactcaaaatattaacatgtttacgtaattttgtaactggtgatcgaaagcggctagctagcagcctagctatctaaacgaatccaacctcttaattaccatcttagtattaattagcttagcttgcacgcctccttgaacacagtggcattgcattacattatagtacagtgttattgtgttaacagttcaatactactccaattaacagaggtgtcaggttaattagttcgtcaactacggcatggggtgatatatttctctttggatatgacagcattcagtctcgattggctgaatctgaacgaattaatgtccatccaattgtcagcttgatctagatcgacatgaggcaggggtcccagccaagcgtacatgattgcgcccagtcaccctcatagtcacctctggccataagcgggagaagaattagtggtgtatattaaagcatcaatcaaataacagttaagcaatcaaggttcagaggagacaatggcgacagatacccatcattcttccctgatctttgggattcttattagggaattgctgaatggcacgctacaaaagatcaacggagatttgaaccacatgatttacgtaaagattcgtgtgcccaagttcttctcctccagctcccatgaagcaccggctactggtgacgacccgatgaacactagtggagttagggtttagatggggggggggggggaggtggggatcaagggggaaagagggaagagatcaccgggcttagagagatgatcgtaggagatggttgtctggcgatgagcggtggacacgacaggcaatgaggcaccaaagccatggggatggtggagggcagtcggccggggttggtggcaaggacaaagtgagcttatggttaggaggagatggtcggttgtggacgaatacaacggtggggagatagggaagaggtggtgtaggggcatctcttagccgccgcctcgggaaggaggaggagagagatgaaagggaaatgataccgactggggccttgcgcggcgttgtagatgccctctgtccaacccgtgaggttgagtgacggcacagtcgggtggcagcggggagaatgcacatgcacaaggaagaggtgggggaggacgggggaagggaaacgaacttgtgggctactgtggttagagatgggaatgagcatagaaggaagagggattaaggttaggtgttgttgaacgaatctcaaaacaatccaatagtgcaaattttgcgagatttcggaggcggtttttctatcaaacgacatatagatagtctctatttattatcattgtacaattttatggtagaagctatagatgtttaattctttgaacgaaaattgcaaaaatctgaggttgtccgaactctcaactttgctagtagtttttagactctagctttgcgcttaccacttggcaaatatcatcgtcacggtgtctgatcttatctgttttgtgctgtggttctgatcaaggtacagttagctttgtctttgctgaaaaataaatatctccacgtgtgcacgaactcatccgccgcacaaattaggccacaaattaatctcaagtagctcagctcacggccggcatcttaaagacctaaacacatcggaaattatctgtagaagctctaagcatatatatatatctatcatctctagaacctcttttctgctatatcctatctgaaaaggattcagaagcaagtcagtaggtagaaagtcattaacaagtaatacaggtttttaattttaataacaaaccttaaaaagtgaatttcaaaaaaacaaactttagttttaatatatgtattcttcgcgctttaaaaaaccaatactaatcgataagaaaacatcaaaatgaattctaaaactatgtttttatatgtgcctaataagacgaagagtaaacgattgagctatttgaatagattttctttcgtagagtttgaacaactcttcactgaattcaaacaaattctactccatggcaagaccggaggaagcattatattgcatctgaactctgaagggaagacaccgcctccaaaaatatcagggaagcttagctaaaaatgccaccatgcgacgtggcgacaactcatcacgcccctcgtttccctggcacgagccttccacgtggcaacgattcgccatcattttaaatgtttttatcgtctatttttgaaatttttgcgtatttttccggtgaatttaaacttggccagatcacttctccatccattttaagtgtcgccctagctgctataaaaccagccgagacgaggcgagctgaggccaaccacggcggcggcggcgaacgatccatcagttcatcggcatggacaagaacggcagcagctacggcgagagctcgtcggacgacgtggaggcgccgctgctgctgccggcggcgaggggcgggacgatggcgaagggtgatcgtcgacgtccggcgtcgtccgcggcggcggcgtgggtgcgc

SEQ ID NO: 18133 - DNA, 9300 bp, Oryza sativa
cggcacgaccgcgctcgtcagcatgtggatccacaacacggcgtgcacggtcatgatgatgccggtggcgacggggatcctgcagaggttcccccgcggcgacatcgacgacggcggcgggcaggaggtgcggcgattctccaaagcggtggtgctcggcgtggtgtacgcgtcggcgatcggcggcatggcgacgctgaccggcaccggcgtgaacatcatcctggtggggatgtggtcgtcctacttcccggagcagaggcccatcaccttcagctcatggatgtccttcggcctccccatggcgatcatcctcttcctcgcgctctggctcaccctctgcctcatgtactgctccaacaacaccgccaaggccctctccgcctacctcgacagaagccatttgagacgagagctcagcttgttaggtatacgtgacatcccgtttcttgatactatctactccctccgtccctaaatatttgacgccgttgacttttttaaacatgtttgaccgttcgtcttattcaaaaaatttaagtaattattaattttttctctatcatttgattaattgttaaatatatacttttatgtatacatatagttttacatatttcacaaaagtttttaataagacgaatggtcaaacacgtttaaaaaagtcaacagcgtcaaatatttaggcacagagggagtatatccgttccaaaatattgctacctagaacataaaaaatgtgtttacctttggttgtatatcactgctaaaaagttgacaattgacctgtggtcatcacttggataattctgattgggctaagtatttttctgcctcaacagttgattaataacagccacaaattcagtatctaattctaagtccatgattgtctgatgaggtgtcatgatctatgacaggtccaatggcttttgcagagaagatggtcttggctgtgtttggggtaaaattctatttctattttttttttctaatccaacactagctatgttctgattttatgaccataaatttcaatatgaagaatatgcagggtttggtttctgtcatacaaattgaaactgattatttgtgctatcttggtaaaactaactgaaatggacccttttttttttcttttttttcttttttttttttgcagggcctagttgtgctgtggatgagtaggaacataacagacaacatccctggatggggagttcttttccacaataaagttggggatggcacagttactgtaagtgctaaaataatcacaaagacaaaaattactgggctagcgagccagttgcatttacctgatcttatacagaagcaaatcactttgcaatgcagatcatgatggccacccttctgttcataatccccagcgggaagagggagggtgagaagctgatggactggaacaagtgcaagaagatccagtggaacatcatccttctcctcggcgcaggattcgccattgccgatggcttcaagacgagcggcctcaccgacatcctctccaacggcctcaggttcctgaaaggggcgccgacgctggtgatcgtgcctgtcgcctgcgttttcagcgggatcatgacagagttcacttctgacgactcaaccacgacgctggtgctgccattgttcgctgaacttgccaaatccattgaggtgcaccctgccttgctcatggtttccggcgcaatcggggcccagttgtcatacttgttgcccaccggatcgccgtcaaacgttgtcggcttcagcaccggctacattaccatcaaggatctggtggccactgggttgcccctgaaaattgttgccattgcagctctgacagtcttactgccaacattaggtaacattcctgcacagatcaacattaaggattagtcagtagttagtaacttactgttgttttctgacttaatctaatgcttttttttgttaatttgatcgttcaggatcaacgatttttggcatggacatcaagtcataggaacataaatatgaagtttttgagaatgtacagtagtttctgtttctgtatctcatgcctgaactattgttgaggggtcagatggcatggtttgtataagagtaaccatagggatttctcagccgttctgtattactgtatctgagacgtgccccgggagatcagatttcttgtcaagacagaagcaaggaagacaagcagacaatagaagaatgatcaaaatgaaacgtattcaaacaatccatatccttcagatgagcgtacaatatgcaggtcttatcctctagaggtgctatagcttattgttcttcacaaaatatgtaaagttaaaagagtgtcggcatatatattaaattgaacagaatatgtggtacaagaaagctgaaagcctgatattgtcaaactactggttgattgcttataagatggagtacatctcaaaaagttactagtgataagtactctcaattattagtagtttgttcatatgtagctgtccatctcagagagtgcgagtgacacacgttctagggaagtgtagtacactagaaaacaatcaaacatcaaaatttgaataagttgcaaaaacaagtaaatgatttagttatggctatgaattgttgaatgagaaaaatcgcaatcctatattaactgtatgaacatcagcatcattgttacagtaccatacctgagtacattctaatggaacagttcacttgcataacgtgagttagcataatatttaactaactttctagagttcagatgactgtattttgtacaaacagattgcttgcactcaatcctgagattgaaataacaatactatgatgtaaaatgcatctagagttccaaagaaacactctgacccttagatcctgatatcttactctgaaaatcattcagaagactgtgacacagaagattaaaaaacaaacaattaacctaattgcttctggagaagccataggacaataattaattcaacatattagttgtcagaccatcctgtattcctgttactgcaaactacaagcatgtgtaacttgttaggtaatcgtatcccaaaaattcagacttcatcctgaagaaaaaagaaagttagatagtcaggtagttactttgtgctgacgattacgtacctgtgatcctgaaatacgctaatgtatcagaagggaacatctgaaatatcagaagtgagctgatcccctttaatctgatcgagcttgatcacttctcaaatcctgttcaattattcattgttaagaacacctcaaactagccgtgcgatcccgcaccttttctgttcgtcacaccgtgcaagcaaaccgataatcttttctctctttatcgaagcaaggaaatggaaatttctaggcaagattcaccaagaacaaaaataaaaaaaaaagattctggataaagtagttcttcacctttgctctcgctagtcatggcatacacctgcgccgcaactgatctccgccaaagctgggttggtcaaggtagcttgcagtggcggctcgccggtgatctgagccccatcggaggcggcgatgcacgattccggccaccgcacaccgccacgcgccgccgtcctcgcgagatcgacgatacttcatcaccagaaaaagggaaaaaaaaagtagaaaaggcgaaatggatcgcagccgtccaaaaaacaccaaaagctctcaccaaacaccatcgcgatgaatctcagccgtccgatctggtgggcccacacttcccccgactttgttcagtttggagttgcgacactgacatgtgggccccacttttactatggcccacacgtcagtgacacaacggcaagctgcacaagggtcaggcgatctcgtctccgcgagttcgctcgcgaccgcttccgagatccgttcaaccccgatctacgccgccgagaacctcgccggcggcgacgacgacgagcacctcgccggcggcggaaggcgatgatgcctgtacgcacgtaccaccaccaccaccaccacaacaacagcaacaaccatcggctacgccgcatcatcccccgagtcctcctcgccgtcttcgccatctacgccgtctcgttcgcggcgtacctcctccgccaccagtcgccgcacccgcacccgcaccctgccgctgaccccgagcgcgacgccgtggacgcagccggaggaggcggaggaggaggagccgtggaccgtgtgcgggtagaagcgccgtcctcgcagaagccatggcctcgcctcccctccttcctcccgtggacgtccgcctccgttcggccgccgccgaagcactcctgtgaggggtacttcgggaacgggttctcccgcctcgtggacgtgctccccgcgcggggcggcggcggcggcgggtggttccggtgccaccacagcgagacgctgcgcagctcgatctgcgagggcgggagggtgcggctcgacccggggctcatcgcgatgtcgcgcggcggcgagccgctcgaccaggtgatgggccgcgccgaggaggaggagctgcccaagtacgagcccggcgcgctgcaggtggaggcggcggcgaagaggacggggccgttggtggaagcggggttcctcgacgcctacgtgcccaccggcgggatcgggatgcacacgatgaggtcgctgctcgactcggggcgcgtcgtgccgcccggcgagctacactgctcgcaggtacacacactctttgcctcagtaaccagtagtagtagctaaaattggaagtgtaaatttgggagaatttattgttgtatgttggatccggttcacatgaacactgacttgcttaaacatttcatatatctatgaagattgcaacaatgatttgaactgtaggagtaataatgagtagagtccatggcaaaaggtgggaagatgtttatagcatgtttcctgtagtaattgcgactaaatttaattaattaatcgattgcgaggaaatttcaagaaggccagggtgtaaaagaatttgattgagtttgggtcctcagtccttgctcttctgctcctgcaacagaggactgaggactagcggcgagcaattgagtttgagttagtttggttcagcaagataacatctgctctgggtggcacccactattggatctggcaaattggcaaatagcaaggcagcaatgttagtgctggccacaggtttattgggctagtatgggaactcctaacaatgagtcaatgagctcctttctttttgtttggtgagggagatgggtgtgggcaagaaatcttacaggctataatttcagtcttcaaagtggttatagttgtttcattccctccctttcttttttgttctactgttgacttggcagtttgatggaattttctttttctcttgttaatgagaaccccatgagaaccaactggctatataatgaataaatattttgattcggttatttggtttagggagaaaaaaaaagctttcggttatttgattagtcaagttaatcgtgccgacgccttgtgcaactgtattgctgtaacatatttgatgccttgattgatgcactgtactcatgcttttggttatttgatttagttctgattggttgcaaatttaccatatcaatacagatgtagttgactatttagcgaattgcttaaaattttgcttggatatgggtagtctgttttgagctttgaagatgtatctttgtagcctttataacactagattttttatgaagaaacacatgaacctctcaagaagcagagcattgaattcattccatgactcctattgttatattgcaggattcatttcttcaccaatgtatacatatcacagtaatattttcgtaaagctcccctaggataaattcctttctaatgttattatatttgttgcagtgggttgaagaaccaacacttctagtaactcgttttgaatatgcaaaccttttccacacaattacggactggtacagtgcatatgtcagttccagagtcacggatttacctaaccgccctaatgtggtctttgtggatggacattgcaaggtacgttacacgtgatgcattttgagttgctacattctttgattgttgatgcactgcagtttagttggtctatttcatgaactatatagcctgagttatggactttatggtaattagtctgtttcccttcctcatttccctgccagccaggctgccacatttccatttcccttcgctcctttataatgtgattctcctctttccgggttattacaatagcttaatttgtagtacattggaatacacttcaggagagtatcaacgtcatcttagagaagtacagttacagacagttgtattgaaatactagaaagtgaaacaagaagcagaactttgactttattggtcataaaatcagtcaactggggttaaccattttgccattttagagcatgcctcttcacccatcatctcaaaacctgctcataaatagcagaacagtttcatcacttcatgactgcactgcatgcgattctttcgacttgttactgtgaagtcaggccaggaccaagtagaataatgataattatattcctcttctatttaatgatgcaacggaaatatctgagtagggtttcttgtgcaatgatttccttcatattgcaaatcaggagcatggtggttcaattttgccattcatataggttttattcaacgaaacctgaaaacatgcatgcagatactgtttgatgagtgcggcagcatattgtgtgattaatgctagttaacaagacggctcattttttactcaataacagtgtatatgcttttgtcttttaacagtatgatctgacattcacaggcacaactggagcaaacatgggaagcacttttctcaaatgtgacatatgttaagaatttctctggccctgtttgttttcgacatgcaattctttcaccattgggctatgagactgcgctatttaagggccttagtgagagctttagctgcgaaggtgcttctgcggagtccctcagagaaaagcctgatcaccagaaaacggcaaggttgtctgaatttggtgagatgattttagcttcttttgatcttctgagggatgacatactgtcatccaaaacatcaaatgggctcaatgttctctttgttcggcgagaggactacttggcccatccacgccacagtggaaaggttgaatctagactaagcaatgagaaggaggtatatgatgcaattgagggctgggcaaaaggtcagaaatgcaaaataaatgtcatcaatggtctttttgcccacatgaacatgaaggagcaactgcgtgctatacaggaagcttcagtagtaataggggcacatggggctggtctaactcacttggtttcagctaccccagatacaaaagtccttgaaatcatcagcagcatgtatcgacgcccacattttgcattgatctcacactggaagagcttagagtatcatgccataaatctccctggatcatatgcaagggtaacagatgttatcaatgagttgagtaatatactgaaaggttttggatgctgagacagagctaggtattcatcaggaaagtcaccatactaacaacacaaatgcttacaatttcaatggatgggaaggaggttatttgcatctgtgatctgtgaactgatgcattaccagggctcatcacttcatcggaggaatttttatgctgccaaatgcagagagagattgtgctgacaagtgacaatctttaatctgcatatcgtgtggaacaagaaggcaatccttccccccttcctgacatcagccgacgacatgaaaaccaatccatgctgcgcacacttttctaccatgaattcatggtcttgaggaccgatcctcaaactgtaattgtaattcatcatttgggacattcggcgacaattcttgtatgttaatgcataatgttgagtgcttctcccccactgttcatatatgttgaaaaacttgcccaatggggcatggcaattgaccaagtgtcatgcccttcctactcccgtgtgcatgatgcatgaccagcctggttttctgccatggtggcctggtgattactctggaagatgaaatggagccgtcaggctcataacaccggtgtacttgcttcactttgttccttttgcctgccattactgtacccctgttttattgatgtgggggaagaagatatattattgatctgttgttgtggacttgtggggggttcgacatgttttgagtcgaagctttgctgctgttatttgtgagtatcatttaatgtttcacctactgtttgtgctgcatcttgatcgatctttgttgattcttgcaggaggaggacaacacaagctaaggggaaggaaaagggagaggaagaagaaggaatggggaggatggctgtgggcacggtggtttgcctgcctgcatgcatcccggaggagcacatgccttgttgctgctgcctggggcgtgaaatgggcgtggctgatgatggacgctagctcgctgggaatcatgcctgtttccttcagcatttatgtgggtcggaggatggagttggaattggctccggtttctgcttggttgggtggcctggatgctgtggcctggtctggactctggacagcgccgaggccttcggatgcggcggtgctgccggtggttacaggggtactgccacagtacatgtacagccttgggctcatgccactaccaattggcaaaggtatggtttattctagctagcaacgaataaatttggcaggtggtctattttttgaacagttctacgaaagaattattattcactttgtttcaaattacttagcattcgctttattatcctaagttaaaaattttctatctttaaacatcaatttctaaaatcaacatgcgaattagttaaatattataaaaatgtttctcatggtggatctaaaaacaaaacgatgttaaaccatataaatttttagaaacccggtagtcaaagatacaaatatttatctcttcatttaagccttcaatgcataaagactacaaataggaacaacttatttgaaaaaactcaaatgtgaaataggtgtaacttttatcgatggagggagtaatttagaaaagagagtactggtatctgacacttgctcaaatttagaatatgtaggactacttagggcatgttcatatgtagagctcataaaaacttttagataatgtatgtttatttagagactatccttacaatagtggagataacaaagattcta

SEQ ID NO: 18134 - DNA, 2055 bp, Oryza sativa
tattgtcattcgaataacatttgtactaatttagtgtattactccctccgtttcaaaatgtttgacaccgttcactttttagtacgtgtttgaccattcgtcttattcaaaaaatttaactaattatttattcttttcatatcatttgattcattgttaaatatactttcatttacacatatagttttacatatttcataatttttttaataagacgaacggttaaacatgtgttaaaaagtcaacggtgtcaaacattttgaaacggagggagtatcattttagataattagtatccttcgataacttaattacaatgaactctgaccggtcagagtattaatgcgtcggaaacttttctaagtatccagaatcgtatatgcgcttgaacaaaatagattagcaatatacaggagatcaattttgtagaaacggaagcttgaaaggtatgtatatgtactacgccttgtttaaataaggcagtgtaatgctccaatattgcttgttcacacttgtacttcatccgtttcataacgtaagactttgtagcattgctcacattcatgtaatgttaatgaatctagatacacatatatgtctagattcattaacattctatatgaatgtgggcaatgctaaaaaatcttacattataaaacggagggaattagccagattaaggccctgtttgggggagcttgtcccagctgcagcttttcccaaaagctgcttctactagaagctgcccaaacagtccacagcttctgagaatatgtagttacaaattctgaaaaatgaactaagaagctggagaagctgggtttcagagcttttccagattctcagaagctggctaccaaatagctacttctcagaatctaaagctcccccaaacagaccctaaaccaagataaatagagttggctagctttgggaaataaaattatggaggcaatccgatccatacaaatcaaagccgttactgaactttgatcgaacaacttcttgagagacatgaacatgtggacgagtgatgattacagtactagtaaacaccatgcttaaaaacactactaagtcccaaaataagtgcaaccattacacagctgtacttattttagtacggatagagtgtgcatatatggattgaaacatcgagaatcaggactgctaggttgaaatttatgtgacctgatgacgacctagctagacaaggacatactgatagtcatatttccaaatctgaaaaatttatttttaataggcatatttcaatccaacaacttatcatcttaatgactttcttggatttaatgcatgactcttcattcttccatacatgattggctacatgggcattgagaaatgtaaatattaatgaatcgcttgtttacgaggaatgactagtagcatatttaaatggataataagtagaattaattatccttggtctgtgtgccaagatgaaatatgactatcaaaagtagatggagggagtacacatgcatgtacatcccactagtccgacaagtagctagctactccatttccatttagaccgacctttggatagttatattttaaaatggagggattacttacactattgacaagcgttactttaatccgatagtcgatataatattttgatgaacaaatattgtgtaatcatatttaacatacaacatacttcaataatattttcatgaacaaatattgtataatcatatttaacattacaacatagtacttcaataataccatggtatatcttcaaacattttacagatttattactcaaataagagtaatcagagtttgattgtaaacagtgtctggtgagtatttgggaacggagataataactaccaactgatcgatcgacaggttcatcaagtgacaacctttaattttctgcactagaaatcagcagaagctcacctcagaacagacttatgtggtacaccggaccgtgaggtgagacaacgtacgagccccaccaagcttgaaatacggagatatgtttgctgttccttttaaagcttctattcagat

SEQ ID NO: 18135 - DNA, 3338 bp, Oryza sativa
ccatcgatatgatccagtccgcctcttgtcccgccgtgcaaccacaacactatgtatgcatcacaccagcagtcccttgttctctggctactatttccaattaaatggcctcactgtttggagtttatggtttataccttgaacccactctgtctgcccgtctgcccggatcatatatatcatgacatctcgtacgtatcctcttctactacctcattgtctccaccccccccccccccactgtcctctcttgccctccaaacattgcatggatatatacatcacttaattgatcgtcaagacgtcaatggtgaatgtttttctattagtacataattccactattccataaaaaaaaactcaatctaaaaggggatgtggtttctcctagtacaatgaatttccaaaaaaaattaatccaggaggaatgtgacccctcctaatacaatgaatttggatagagagttgagtttttttctggaacgaagggagtatatatctatgtgcttgttaattgctctacacttccgtggcactgataggcgagccactccgtattctacgggtaaatttgatttctttttttttctacatagggttagcggaggtcaactagtggtcaaccgatgacgatagatggcaaagaaagaaagaaaaaaacgcttcatggcatttcgtataactcacgtttctcaattcgtacaactgatcatttgtcaattgcaaaacatagaactaatctctaggccatgtgatcaagttttgcatatacataatttagaaacttttatactactatgtaacttgtatttttcacacaggactaatggatcgatctcccttggtgcattcgggtgaggccggattatatatgtacaggggatcgcaccgatggctaatcaattggaacagtagccggcggttggacagggccactacctagctgactgctcgctctgcacgcagagagagagaggatacactgtgatgcacagctctcacacttaatctgacgcctcccctccatcacccatatgcatcgatcggagatggaatggaccgcgacactacgctacacgacgacgccaatgtacaagcacagtgtacgtattcaatgccaatctaactactacaaacacctgcaactcctctttcttttttctcactatatccttcaggtggtgtcgatccatggatgaaatcaatgcatcatatgcatggatagatactactatatatcgatcgaagacgacgacactgaatggcttgctctctgtctctctccatatgatgatgatgaccaatgccgaggtcgagacatgtaagaccaaacgctgcactggagagcatttgcatcccatgtcgctgcatctgcgaggcaagtttaatttgctactagtagctatagccttcagtttggttttggctctgcatgcatggatggattccattgattgacagagagagtgtggtggtggtagtagtatatagtacttgctagcgacaatgatcgtgcatgatgcattcatgcgatatcgaccggcaatatcgcatgcatgcagtagttttcataggcatgagcacagtgcgatggcttaggtaatcacagtgtcaagctgcaggggagagagaggtgtgtgcatcttgcgtttgctatagtgttgcatcaatgagctagctagctgtatgcatgagatgtatatcatgtggtgcctttgatcattgctgctgctgctgctagctgctaagcaattgaatctttcgatttggattctcagaagaatcgatcgatcgagaccgagaatatatacacgctagctactgtgtggttgtgcatacatatgcatgcatgcaccctagattacaaaaaacctggccggcttaatttcatttgccaggaggcactagtacgtatcatgattcatgactgatgatgcaatcgtcgtcctcgaataatgttatggtatagtagaagctagcagtgtgtgcagcggcgtgcatgcagcaaaatcggtggttaatcattaatgcatttctcttctatttcaagggtaggaaaggttgatgcgtgaggaggtaccaccttttctattataaatttggtactttttgatacctactccctcagtcataaaaaaaggcaaaccctaggtttccgtgtgaacgtttgactgtccgtcttatatgaaatttttttataattagtattttcattgttgttagatgataaaacatgattaatactttgtgcgtgacttatctttttaattttgtttcataatttttttaaataagatggacggtcaaatgttggacacggaaaccagggtttatcttttttttgggacggaggaagtaggtactatgaggtatcaaattttaccctaaatttttaataccccatgatatcttcgtaaagaccgtaaaattgctcgtatttttaaaggcagctaaaatgcatttgcaaaggtggttcggacgacagcctctaacaaaaggcgtggaaaatgatgcattttcacacatggaaaatgtaggtgctcgtgttagacaaccatatgtgtaaatgatttttcattggtgacgtcaacccattatggtagcttctttagaaaaagaaggtacggcttgatgcacatgcagttgctctctgcagtctgcacttgcgttgcccccattgtcaatttcaaaagtcaaatgaattggcatatctttacatactcctccataaaaaaaaactcaatctggacaacgaatcagggcaagaggttgcctagattcgttgtaggtcacaccctatctagattggatttttttttttgaagagagggagcacataggaagaaaatcattgcccccaaccctatcggttcgaaattcacatatagaatatcataaattgaatagcaaaaagggtttcaaatataaaatctcacaaaattggacagctaaaaggggaagaacatgggtaaaaaaaacaacaaacgagctcagcctcggtcttcccaccatctcgagacctcggctacgcagatgttccagcagctctcaaatctgtgagaaaagaggagaattgtgggacaacaaaaagaatagagaaaggatgaatcgagattcattcagagtctcagtcatgacagcgaggcaatgagcaggtgcgtatctgtggttgtggttcggcaacaaataggtattgcatcaactacatgactgacgagtgctaatgcaggtgatggtgccaacagaggagttgcaggggtccatcgtctagtttaggatgatggtgccaacaaaggagtcagcgatcttcgcgcgtgcgcgtgtgagggagagagaga

SEQ ID NO: 18136 - DNA, 2679 bp, Oryza sativa
ggttaccaatttgtagtccgctactactcttcgatatatcttcttttttatcttctcgatatgtgtttatagatggcttatagtccactattgtgtaccgtacctgctcttagagcaagtttaatatatagtccactactagctccaaatcatttatagtcaatgtaatagccaattcatacaatagttacttactatactattaatatctggttccacctgtcttacactcattgcgtcttggagtccgtgctgcagctggctacagatccgtagcccgctacttttctctctcttcctttatctttttaaaatatatttataggtagtttatagcctgctattgtacctgctgtaattagcaagatttactataggagtaatttgcatgcatgggattagcacgtcgcacactccgaggcggaatgggggtaggcggcagatcgatcgatcacacaacatgcggatcgatgtgtgtgatcgatcggaagctagggcgcgcgcgcggcacgcgatgcgagggtgcgcgtgcgcgtacgacgtcgtcggctcgacggcgtacgtcgcgttccccggcagcgcggccgcgccacggcccgaccgcgcgccgcggcgtccgaggcgggtgccggtggagggcgcggccgacgcgccacgccccgaagcggattacgccgcggctgtcgcttgcagcccgcaggcaggggcagggcagggcagacgagcggcacgcacggtgcaggtgcaggtgcaggtgcgtaaatcgatcgatcatgcaaaccatgtaatgtctggaagtgaaaagcttagttagtctcgttgtttgcggaattgtttattcatatgcctgcgtttcttttgcatgctttgtttggctttgtccatttccgttgaaccgtttcttggttggttcctagctagctaatactacacggctggctggacaaaccgctagtaggagtaatataatatagtacaggtgttactctaactatggactaaaactaaattaaattagttcgaatttaatttgatttaatttcccacacaagcttcatagcaacatactgaaacaaattgttgtttgaaataactattatgcatgttctgggaaaacatttgaaaagccagtcgggaccagggtttcccaaaccgtcggggctggggttaccgcaccccgacggtaagcacggttaccgcgcggtaaccataaaaaaccgtgcaaaatttatcaaaaattcaaataatttttttaaatttatttgtatttaaggatattaccgtggtatttatattaccgtaccccgcggtatgccggtaactgtgcggttaccggcggtaacataaaccctggtcgggacatcttgaattcgttcatgctataaacaaaatggtgatggaagccatacatttataaaacagagaaagtagtttattgccaaatcatttttcggtgcttgaaataatttgttaaatacacaatgaaaataattttttgcagacctggaaggaaattacaggtacaagtatctctagagtgttaattttccatgttccatcaatacatatatgcactcggaaaaggctcaaaaaaatattctctgccataaatggcgggaaacaatgaaaaaacaacatttcatcacaaatacatgtttttagagaatattattgatgtcctcatcagcatttgatcaatattttaaaacatggagtacacgaatgtcttcttaaatattagagcaatttcaattatatgatttggctaaactatcacaaaaaagatatagttagccttgagcttatcacaaaactaccagcgcaaaatttaaggcacggtatcacaaaactacaaatttagtgttaattttaattcaaaactacaatatttatatttatatatatagctctaaattatgttttttttctgataactttattactaaatctgtacatttgtaataaatcgacttgaatataagtttttttaacagtttaatgaaagcaaatatacatagttttgttaaattactctagatattagttctcagaaaggatacatgaaattacttatatatggctaggttcatctctaaaatattcccataatattagacatataattgtgttatttataacttacaatagaaaaatggatatattgaagctgtatttatttggaacataactagcgccgatgccaaaataaaacgacgtgtattttttaattgtatcagataaagtaactttacttataggataattttaatattcttgagaaagtaaagtaaagtatacttttaccgtccttgagaatatagtaaaatattatatttttatataaaacttagtaaatatatacttcgtacctccaaacactttctcaattgccgtaaaatttcagtaaagtgtaaggtttgcattgcatgtactgtatgatatatctggtctcatgatgaagatggagccccatatggtgtggtcatcagcctgcacataatactctccatacaacatctcatctggtaaagcttaggattccccttagcagagtgcaaccgtcagaagaacaatactaccactcttccggagacggattctaatagctcaagtggacgtccacccatttattgcatgtcaactaaatggttaaaaaaaattttcaaaaaaaaattgaca

SEQ ID NO: 18137 - DNA, 5890 bp, Oryza sativa
agaagcagcagtagaaactgtagaagaagcagcagcagcagcagcagtagagatcagcttgagaagtgaagtgaagcagccaagcttcctcatggaagacccctacactagcttcttcaagaacccttactactactactgcacctcggctagctccttccccaccgcgcccgccgccgccgccgccgccgctcacctccctccgccgctgccgccgccttacgctgccctgtatcctaccgccggtggcgtcggcgtcggcgtcggcgcgcatcatcatcatcagtacccgccggccgcattcttccacccgccgccggtgcaccagcagcatcaggcgccgccgtcgccgccgctgcgggaagcgctgccgctgctgtccctgtcgcccacgccggcgcgccgcggcggcgtcgtcgacgcagcggctgactcggactccgacgacgacgacgacggcgactgctgctaccaccacctgcaggatcaggagggggcggcggccgggtcgacggccacccccgccgccgccgccgcgcgcgcgccgctcttcgccgacctcaactgcatccccacctgctgcggcgacgacaacgacggcggcgacccgatggacgtggaggtcgccgggacaacggcggacatcgacgccgcggtcgccctgcgcatcggcctgcctgccggcggcacggaggccgatctcctctccgggctcaccggcgccggcgtcgaacacgaggaggaggaggaggactgcaaggtggacggcggcggcagcggcggcgacgacgaggtggtgccgctagggttctcgtcgacgccgatcgggaagctgaacaaagggcagtactggattccgacgccatcgcagatcctcatcggcccaacccagttctcctgccctgtctgcttcaaaaccttcaacagatacaataacatgcaggtcagagctaataatcatcttaattacattcttattagctactcatttgaatatatgattgatcttatattgctgtttaattcttgttcttggacacacaatatgattgtgataactttgcaggtcagagctaataatcatcttaatcacattcttattatagctagtactactagctagaaacatctcatctgaataattgatcttaattcttgttcttggacacacaatatgattgtgataactttgcaaggattggttggtcatgattttgttgattgcaattaaagtagagaggaggtgggtagcaagctgctagctttggagagcagatgcatgccatgaaatagacttgagctcacaggagcatgcaacagtagtggtgtctgccttttgtgtgattgaactagactggcatgccaggagcagctatagctagaggtagagctagagcttaccatgcatgcaatctttatgcttttctctccttgagttgtttggcttttggagatgcatatgagtggccaagctgcagtggagatcccagtgaagattttatctttgcttctctcactgtcttagtacacttccactgatctcatcagattacatatactcctttctggaggtgtagtttctacttgtactagtactagtactacacttgctatcatgcacctagtagtcctgaatcctgatcactcaggactcagggctcaaataagatttgggtagatatatgcatgggggttgtttcaggacaggctttcatggtttggaaagcataagattatggagctgctgctgctgctgaacacatctcccaagaacagcaagagagatctgcagtgtgcttcctgtaggcatgcagccaacacagtgccactctggctgcactctttaaaggaacaacaccaacacattgaacacaacaaacacacaagccaagctagcaaagggggcatagctgcctggagtagtagagccctcactttcaaaagatcacacactagctagcagcagctgcactaattgacatatgcatgcagcagcttcagttcgagtagttctctcaggtttgccgcagctgaatattgctagcaatgcaactatagctgcagtggtgcattaaatacctgcaatatacttactcgaatcatatgctgatgaacattcatttgaaatacatcacctcctttttgttccttttgtttatactagtaggagtaaatgtgaaataatggtgctaaatttcctgaaacaaaacgaacataaacaaaaaggtgatgcatttgaaatgaatgctcatcagcatatgattttagataaagtaagaaacattgagcatgcaatgatacgatcgctagggatctaattaagtgtgttctcatacctggagaggacgatcgacatcccatatatatacatgaagctttataaaaaaaaacttctgaatttgtttttattacattgtatatactactccctctgtcccataatataagggattttggatagatgtgacacattataatgaatctggatagacggaccgcctagatttattttactagatcaatatgtcaaatccacccaaaaatcccttatattatgggacatagggagtattgatttggtgaatatatacattttgatgtcgatcagaaaaaaaaacgagatggaaattaatgaaacttgttgaaaaaaaatgcatggatgcagatgcatatgtgggggcatgggtcgcagtacaggaaggggccggagtcgctgcgcggggtgcagccgacggcgatgctgcggctgccgtgctactgctgcgcggcggggtgccggaacaacatcgaccacccgcgggcgcggccgctcaaggacttccgcacgctgcagacgcactacaagcgcaagcacggcctcaagcccttcctctgccgcaagtgcggcaaggccttcgccgtcaagggcgactggcgcacccacgagaagaactgcggcaagctctggtactgcctctgcggctccgagttcaagcacaagcgctccctcaaggaccacgcccgcgccttcggccacgcccacaccgccctcgacgccgacgacgacgacggcgccgtctccgacgccgacgccgtcgtcagaccttcgtcctccatggctgcctcctccctgcagccgccgccgcgctagctagctactagcatacatatacacccctccatccaaaaaaagttcaatcctgtccaggttcatagctagagtttatgatcaccctatcgatctattagtgatactactatcacttattagttgatgttgctgtttttgtttttgtttgctacgttaattagggttatgggaaaatgtaaggtgtgatctcgtgctcttagtttttcttgatcaatatagcagctagcagctggctggttgtttattagcatgattatatagcaccgatcgatcatatgtatgatgatcaacttattaattacgtgttggtgatgattttgatgtaatcatgccgttctgctatgttaacccatggtggaacaagatcaaccaatgttttcttcagtttcaggtcatgaagcagtacgtaaattaaatctagctccagcccttgttaattactccagttaggactaccgatcgattatcaattgtgtctgtgttcgcaactgtacatgtataacgacgatcgatctagcgctgcatatatacagtgttgacatttattggtaattcggaggatgacgatcgattgccgccaccattggcatgcatgcatgcggtacatcattaatgtcagttctgcatgttgaaaaactttcacccgttttgttgtatgcgagctccagtcaagtttctaccactatttatcgacgtacgtatccccttatgtgcaagcatacactgcacatatacgggccgacctaaacgcttcccaagctaagctagtaataattcgtcgacacgatattgctccaactttaacggccactttaaaactcacgattaagaaaacagatgaatagaaaaaaaatacatgactttgttggcaatgcaaatccaaaaaagagaattacaaaacacggagaatacagcaatggaatgatcatttgattaaactatagaaaaaacgcatgaattgaataagagatgaactcaggaaaatttgcaagaggtgctagagctcctgttaaattttttttccaaaataagctatttcttagtaatttcataggatatgggaagctccaatcctttgttttaaaggacaatataggaaaattttctattggattatttgaatcctacaaaattattccacaaatccaatggcggagccaacgacatcatcaagcccgaacgacactaatagcgtttttcaatgattgactaatttttataggggttgacaactatagataggagacggcgacggagccctggcaactgctcgacctatccaggagatggctccgccacatcacaaatcatttgtttgaagggggcctaagatgaatcctgatatgcataacatacgtatacacatactcgcatacactttattttagcatgcaaaattttagtgagatcatatatttatcaataatctccatatatcgtctaaatgcatgttaaaagtgacgctcatggatctatatatatgcatgtgaatcgtctagggtaaaaacaaccaaaatatactcttgttggcactactataaaacaatttttgcagacaccagtgttttattttttttcagatggggcaataaaaatccttttgtaataatagtgagaaagctcttgtggtatatgttcgtctgcaaaaatcgattttcgtaagtggtcgcttaacacgtctacatgtgaaaataaaactattttcacatacgaatgtcttaagcgactacttacggaaatcaattttcgcagacgactgctaaagagcactagccgtgaaaaacttatccagcaagctagtctggatatgtatcctcctctactaaccatagagtggataagtctcaaccacatcctctcccagtgctcctccctcactccctcacaagggttggtagtggtagggcttgaccgctcggtgcccgctgcggcggtggggctcaacgcaacagatccagtgtcatatcccccaccatcgcgcgccgatctggtgggagctgcgacaacgaatgcggcgatgggcctcggcaggtgtgaatccgacggttgggaggtcagtgacggtgggtccagcgacagcagacggccgctctcgagcttgggcttttacgatttttctgtttttgatttttttttattgtgcaagaattctttttgaagtcaggcagcataacatgccgcatgcgaaaatccatttttttgcgtgcaattgtgttgcctgcctagaaaaatccctatttttacatacacctggggctatacgattgctataccagcatgtgaaaatgcattttagccgtttgggaaaattgttttttagtagtaagggacaggtccagcacaaaagcatagagcagttgcatgcatcttcttctaacactactacagaaatgatttttctatacgaggacccctatagtttgtagacggataataactggtcacaccagcaaaaatcgaccagtattttcgcatacagctccttaagaggctcacatgcaaaaattcgcacgcgaacctcttaacacatccgcatgcaaaaatgagtctatttttacatgcgaaaacagcatgcgaaagtagattttcgtatgcgggctacttacagagcacatggaccctcacactttttaccacaacattttttgaactccccttctttctctacaccacaccattttctcctctcccactcctccaggctaactcctctccctctaccctctccacatctcttctccttccctcccccctctcccc

SEQ ID NO: 18138 - DNA, 2703 bp, Oryza sativa
gggagtggcggcgatagaaggagtgaacggccggcgtcagtggtgggagcgagcggatccaccgtccccgcccgcgtgagtggcggtggcgcacggatccgtcgtccccatcctcaggagcgacgggcgacaagcgatgggaatggatggatccactgtccccaccctaggaagcgatggtggcgcgtggatccgccgtccccgctctagccaggggcggagctagaacgaaacggaggtatagctgattcggttttaacgcttaatttactctattttagatcgagtttaagctgattcgggtgtctatgtttgtattgaggggggtgcacacatgataaaaataggtgaggtatagctaaatttttttcttggccggtttcctagacactcctctaatatactatgcctccgcccctagctctcgggagcgattgcggtgggtagtggcagcgcaacgatgacgactagtgttgacggctgctctgacgacgatggcagtggcagctgctctgacgacgacggcggtagcggctagggtttcgggtgattttgattttctggatttcttttaactgaaactattttcgtgtgcggtcggtaaatgtgaccgcatgcgaaaatcacgtttacgcatgcggttgcactaaccgcatggaaatttagcgattttaattcacagaaacctaggtgtagatgggccagaggcctgtttgtgaaaatttgttttggccgtctggagaaattatttatgtactagtgtaggcctactttggaacaaaggacttttagagaatttgtacagaaattaaattgattcctataaatttcgtgtggtcaattggaaaggagccggccttaagctaagttgatttgtttttttttaataaaaaaactaagttgattggatatgtgcagcactggagcattgacctagctcctgcaggtagaaacaaagaaaacaaaacaaggatggatcgatgctagccatctttccccttctctttttacgaggaaatctactttttgggcgcacttgagagatcggagggatggccgaccaaagtgtgtactgcagccaaagtttgatggatggaacaccatacataccatgagatgtacgtatcaaataatgcactttttctcacgtttggatagaaagaaaagggtgggtatggacagtgtgctgatgggtacgataagtgctcttttgtttttgtcagaaaaaaaaatccaccgaacgtcgagagttttttgagaagttaataaattaaaggttatgtgtgtggtgtatatatatatgtgtgtagtcatatatagtgacggctgcatgcatttgcaaagcgcggaaggagtagcttttcagtcaggtgaggttccaaaagaagatagatatacggttctttttacaatcttgcatgagagttaccgttacctcagcgtcgtactatctccggtcactaatatttgattatttaatttgatgtcaaccggattttattcctactagttacttcctccctcccagaaacagtccattcctagcatccctaggtgaaactagtggagagtgaaaatgactaaaatacccttaatcattaaaaaaatagtaagagtgatatgtaggtaaagagtattgaagcaataaaatttctcgttttacgtgctgagagtaggtagaagggtaaaagttggtttttttggaacaaaattcaaactctagaagttgagtttttttggacggagggaataggtgttacccgatcgacatcaaatattaatgactagaggaagtatacaatatatctttgagttatgtcttaattataagccgtggccatattaattcttaacttttcaaattaatttacttatttttatattgtttttgccacaatatggattttggaccatcatactttaagatcatttttcattgtatcgtgtgtcttcagcatataaagcgcaaaatggaatgccttcgaaagtaggcccatcatcacctgcttagtaccttctaaattctaataaagaacaatagaaatggagaacagggaattgtggattttgtccatcaatagctactacaaatgttcggccataaaattcacggatgttatgtagcaaccggatgaccggcgatggttgccaattgagagatctcctattcggtcttttttttatttcatccttcggtcaagattcaatggttcaaaccaactcctatagacatatataaaaagagataactattacagtcgtcagtcgcatcacaccaatctcattgtctgactcctcctatgtgccggtcactacttaaaaaatggtttttccaagcggccaaaactgatctttgcatgcggttgaccactcccagcaatttctccttctcccacaactcactatgctgaatccgtcattgcagcctaaccactctgtgccttcttccccatcttcaacgatgttcctcttaataccgatctctccgtcccctgtaattcctattactggatccacggcccccgctatcgtcgctcatcatcctcctccatcactttggctttggaaatgcctcacttctatctgtatcagcttatcgtcgagccatagctgcctcgatcttcctctaaacccgagggagtcccctcttccctcttccccaaccctgattcctactccctccgtcccataatataagggatt

SEQ ID NO: 18139 - DNA, 3758 bp, Oryza sativa
tattgtaggacggagggagtaactattaggggccaccgccacattatgggcctattcactttaatgtcattttcaaccttaccaaattttggtaaagttaccaaaaaaaatagttacatttagtttgttaccaaattttgataactatataagaaagactgctaaaattttagcatagttaccaagcaacttgccaaaattttagcaatgacaaaatttgataaggtttttttttatcaaagtgaacaggccctatattctcgtggtagaagggttgccactatacgagtcgctagagctggatcgaggagcctgacgcacaaatcttcaagccaatcaaacggtccgaaattctccttcgttgaaaccatgccacgctctactctcgactgctttccgtgtggaactcctaggttgtcagtcataactccagtactgcaaattttggctgtttgaagggtcatatcaaaggaacaatccatccattcagtcaatcgatccatggcctgtgtgtaccagtaggcgtgaagcagctggatagctaggtggccatgtgtgtgagtatcagacaacccagcaacgtgactccacacttgccgatcctgcaccgtccttttctccatctccaacgccttcccccttctgtccatgtcgctgcctctctctagatctctgaccgaggctagagtagctactatctccgtcccaaaataagtatagctgtggatatctgtacctaacgtttgaccgtccgtcttatttgaaaaatttgtgaaaaaattaaaaatatttagtcacacataaagtactattcatattttatcatctaatagcaatgaaaatactaatcataaaaaaattttaaataagacgacgggtcaatcgttgaacacgtgaatagtcaaaactgcacttatttgggacagagggagtacctagctagccacctgcacacatatttcatgcaggtcggccatagatcgaacaggagagagagagagatcgggcggggaagttgtgatccggttatgacatgtctaatcgccagcttccaggtcttgttgtgaaatgttcggcgaggaaagctacgtgtatttataaaagatcaattttagtcagggtgtgtttagttcacgttaaaataaaagtttagttaaaattgaaacgatgacggaaaagttgaaagtttgtgtgtagaaaagttttaatgtgatggaaaagttgaaagtttgaagaaaaaatctacaactaaacacggccaaaggtgtaaagcataaaaagatttcttgtacagtatatatgtcctaaaattttagccgatcacttctatatggccctactattttctcacttcctttatattactactgaatttcggtttaatcccttacatgccaattccgttacttgacagttgatcatttaatgcttatgatttatgaaaatgtctattttacccttagacatagaagaaacataaaatttgtgtataacattattggaagtgtagaaaacttactacatgaaactattatattgatgagtttgtgtgaggtacgagtattattcatgccaatttatttttagataatgataaaatttagtaatatttatttttattaattaaaagagtatattagcgtatttcggtgatggtagtataacaaatttgccacctgttgtatgtattatctaaaaaaagttaaactaaactaattattatgtttactgtctaaagatacactacacttactatttttaatatatattaaattttgtatgtataatacttcctcaaacaactactttttggtagactcacaaatttctatgttccttccatatccgagggtaaaactaaattttttacggtcaactaaatggtcaattaacaaaaaaaagtatgtgtgtgtgtgtgtctctctctctctctctctctctctatatatatatatatatatatatatatatatatatatatatgcttcggacaaaaaacactgttcaaaaacactatttagtttactgtttaaattactgttcaatactgttcacttcgagagatattttaactttaggatctttgcagggtggcgaatcctatttagacagcctcagaagcttgtttcagatgatgtaaagtcctactcggtactcaccgtatgcctcacctatctatctttttagaagcaacttaaaaagatattccaagtcacacttgttctagctaagagtttatcgtctccccaggcagttccacccgaagggaacacttctctacggataccgattctccagacgcctatgcaagatgcaggctaaaaacgagaacaaaccgaagaggtttctcctatagggtccttagcataaacacttgtctagaacaaacgtgtaggaatacttaaggaaaattacttcatattaaacagataagcttacatacggttttccctttcgggaaacccgaaggtaggtacaagcaagctgttcttaccttacacagcgttataacacaactcattgcttcaatatactatgcaaggtaggctaaagtcactactactaagaatggtggaatggagggtgagagcgcgcttggaagctttgctctgaatggtgtcttcgttgttcttctcagctgagcaaacccctccttttataggagctcgggaggctcgactgtgcttcaagcttatcttctagatactgtattttcacgagctggctcgcaccatggagatgcttatcttctttttggctttactttgtccttgaattggccaaggtggagacacctctgtacctgcgcctttcttttccgccgaaagcaatattctccacagtatttttaacagtcaaatgtcattcactgtccttgcattttggattgattcaaattcaattcatactttggtcattcgcccaaagaatggatatttattatcaatttatattatattgctttattggtcaggctgcccatgaccacctaaatccatagtatctacatcagaaaaggagacttcaaatttttcatcatatgcttttttcatttcttcaaatttgtcattcatttctttctttaattctttaagtatttcttctttcaattcttttttaatttggggggatgcttcttcaaatttttcaattattttccaatcgatatattcgccatccaaaggatctactcccttagtcaagcattccttatacgtaggtttttgggatgatccttcattcttaatatttgaacaatatgggttctctggagctttcttatttttggcttttttgcatttttgtatatattcttttgctgctggttccaagtagtagtttattcctaatatttttctggcctgagttaaagcttcatcaaaatctatatattttttccatgacaatccacccattaattttgcatctattttttgggctactatctcttcaaaagatatgtacactccaggaagctttccgtcaaaaacaacatatatgggtttttgtggtattacttcattattttctgatgttggcattatatcattcattagatggaaatattcagcaagactgtttaatattgatagcatatagcctttttcttccctcttattattgtattgataccagaaattatctaaaatgcattcttggacttcatctaatattatgtgggtttttggcttaaacttataggtattcggtgggaatactttgagcttattgtcttctccaaacgtgaagaactcaac

SEQ ID NO: 18140 - DNA, 3584 bp, Oryza sativa
  unsure (1)..(3584): unsure at all n locations
cacaagcttgttttagacatatactacaagtcactctattttcttgactagggtaatatatgcaaaaagcacatttgatattatagtcaccctttcctctaatccaatcatgttcacaatttaattgatccatcatttcaacctttagacctgctaattcgtcaattaaatctaactcttcatcggatgattcatattcttcgttgatagtttcaacttcgtctgtttctatgatagaatatattgattcgtcatcttttatttcatcatcacaaactaatatgttttcgtttacgctatctataattagaaccctctcttgttcttcatatttactagaatatctcttttgatctttatttgggcatgttctacttaaatgatctggcgagttgcatataaaacacctgcatgttttgtcataggttttctttggattatatcttcttacatttcttttatgtaagaagggtgctctattatctgatcttcttaagaaataccttttctttgttctaatattattatggtttctattttgatgtttataaatccttttacttctaggcttgtcttctccatatgacaagggtatttgaactattttattgcagaaattgtaatccgagtgtttcatagatctttgggcttggatacccgtgcatatttttattagttgcttaaacacaaaagttatagcttgagagatattgatttcaactccttcagtttcctttttatattcttcaaatatcatacttcctagtgggtcaggtaatttattgaagtaacgttcaactattcccctgttatatccttgtttagcagttgtagcattatataaataatgttgggagaattcttttatgcctttccaacttgttaacgttaatttttctatttcttttaacctttcattttgcaaagttgtataacctaattccggatcttcagctataataatgttagatataacatttgcaaaattatgcggattgctaccagctcttttcaattcttcataattattaggattcttttcaacccattgttcccatagaaccttagcagattcacctaaaaatgtttctaagtaggttatcatatcttcaactttacttcctatattgtgttggttttgtatatatttttgaactattaaacctttccaaatactaataatattaggccaatcaatagggtcatgtgcggctaaatttaatatagcaccatcactcctctggttttgaaatttaacaggcttctcaaagtctcttctctttgtacccatatgcctatattgacctggtatatagttatatgaaaattcttctctatcagggggccattttcctgctgccctagctggtctttctctttctccttcgtttttcacagtaccttctccatatctttttctctttcctgttcctaagtccacttccatagcttccattgcattatcaagattatgtaaccctacttcatctaatgtgtttataaaatcattatattgttctgcattgtctatttcattttttatgttctccatctcatttattagattaatttcttcttcataactttcaagaaataatctttcattctctgcccattgctcttcttcacttaaaattttaccaagattttgctcttctttaccatgcttatcttgctctttcctctttatctgttctatcttggtttcttggtttttaaaaatttctactgccatatcttcgttcttctttactttctttactctagctaattctctatagaaataaagttctttatctcttattttaggccactcacacttcatagagttattatattcttcatttatttcctttaatttattttcgtaatattttatctcactttcttgatctaatttttccataaactctgaaacactatgtcttctattatctattatatttctatcatatgcttatgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgacagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacagagttattagaactttagctcctaatttctttcttgtcatacctttgattcctattatatacataccttggtgaatatatttataccctgaatactttaatccattttcaaattccttggctacaatttttagctcaactggctttgttaaaacgcttaactctacttctctagatattctgtataacccatttttattctcaaaaaatcccatgcaatatatttgttgaggtcttattgccctcagagtatctctttgatatctttcgagctgtttgtctacttctgcaatatcttcaagctcatctatgtcttcatttttacctttttgtttatcaatacaacttaaagatttatcgtctctgcttgctattcttctaaacaaactcctagataggtccatttttctgaattaatagcttgagatgaggtaattatgcctgttgaagccaaaactatctcttttcctttactagaatttattatttctaataattctttgatatagtcactgttttgtaatatcttattctgccttgtcttatattcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttagcctacaccttatattcagattatctttggtagtaattacctttccaatattagcttctgaatttgatttctctatgatgactggctctgataccacacttatgcttcggacaaaaaacactgttcaaaaacactatttattcggctgaatactattcagtttactgtttattcggctgattactattcaaaaacactattcagtttactgtttaaattactgttcaatactgttcacttcgagagatattttaactttaggatctttgcagggtggcgaatcctatttagacagcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18141 - DNA, 560 bp, Oryza sativa
ctgcagcccggcgcctgcctgcgtttcgcactggccgcgctggtgctgattccctggatgtactgggtcggcggctttgcccagctgcggcactggagcccccagcgctggctgggcatgctggcagccggtgtcaccggcgtctttggctacgcggcgttctttctatcgggcctgcagcacctgccggccggcaaggcggccctggtgatcaccctgaatccggtcatgaccttgctgatggcggcctggctgttcaaggaacgcctgaaccccacaattgccatcggcatgctgctggccgtggtgggtgcggtggtcgtgatctcgcacgggcagccgctgggcatcctgcaaggcagcatcggcctgggcgagctactgattctgggctgcgtggtgtgctgggtgctgtacaccctgatcggccgctgggtgctgaccggcgtggacgccctgtccaccacggccgtcaccagcaccatcggcgccgccatgctgctggccgccagcctgatcgtcgaaggccccggcagcctgggcctggcctggcacagcga

SEQ ID NO: 18142 - DNA, 487 bp, Oryza sativa
tttgggggagactccaccacgctttcgtacctctgagatatatggaacattattttgatatgggataaaagtaattccttgctcatgtattactgtggtttgtactgattgttgaaggaaccttaggccaattatcatgtcatcattaatcattgacaaatctcttattgtaatctcatctattatatatttagttgcattaatgtaaacctccatattataagctaactgattatgaattttctttattccggacatgtctgtggaaacttctgccttattgtcgtcaattgtgtgaactatttcaggacatcttgtgaaatatttgtcatgaataatattctttgtacacccagtgtctactagtgctaatattttataagatactttgggtgtcaattttactttaacagggattcttatacctaatatttctttgaaagacaatcttactatatatttatttccaaaattagttatggcacct

SEQ ID NO: 18143 - DNA, 663 bp, Oryza sativa
tcacagcaatgaactcaacctacacttgtctatcagattggtggaacaagtcaagtgcaatgacaccatgtgaaaacagaaagggagtattgggagctttgcttgttacgtggtggaatatccggcttgaaagaaacatgagggtcttccaggaccaacccaagaacaaggtggttttcttggtgatacaagacgtaaacgagctacccttagcgtttagtgctgataccctctaatgcggattttgatatgcaagttgctattcttggcgctgtagatatcctatttagtatgtactaaactagactctatttgttgcttcttctaatgtatttagctagcagatctcctgcctgctactttgaaaaaaaaaaaagaagataaacaaacatacaaaattagggattattgctccaataagtagggaatcagcaactaattgatattccactttaattctgtcagaattcattgtgctagatgaaggggaaaaaaaagacaaattgctcagattatttaacatgcttttgcggcccaatatatatatgaaacataattagttggcaccacgtcagataatctatcggatctggttcaaatttaatctttctagtatcctgttgtcattaacaggatttgtactgtgatggtctatagagtgta

SEQ ID NO: 18144 - DNA, 420 bp, Oryza sativa
ccaggcgggccgccaccttggcgccgccgacggcataggcagacatgatgctgccatccagcaccatccaggtcacggccagaatggccagttgcccggccaccggctcggccgggttcatgaattgcgggaacagggcgctgaagaacagcaggtccttggggttgccaatacccaccaggaagcccttgcggtacagctggccccaagtggccgagggcaaggaggtcgcgggcacggccacctcggcggactgcgccgctggcgatgcgggggccgcctggggccggctgcgccaggtgctgatgcccagatagaccaggtaggcggcgccggcccacttgatcgcgtggaacagcgtgtcggaagccgcaatcaccgcccccaggcccagggccgacagcagcatcagcgtcatcg

SEQ ID NO: 18145 - DNA, 7298 bp, Oryza sativa
tccattcgtcgcacctacatcttttatccatctcatatgctttaatttctagttctattaccgattactctcccctcaagaaacgttttcaagtcttattttatttccaaacacggcccgtgatacctagatttttccatgagcaaataatctcatcaaccattgagaaaatggttgagcctaattaatcttctatgtatatgaactggtcgtgtataaacctatgctgcaaaacccataccatatgcaatctgcagcgtcacctgcacaacatccacatccatcaacagacgccgtcatgcccaaacaactttgccttacctccaactgcatggtccagatgcattgctccattacaatgtgcttgggttttcaagctgcctaggaaaacacaagtcgtcgacccacaccaacaatgtcatccatgggacccttccctcagcacacggaagcctaaaagcaacaatgaagtcaccacctagccacaatgatagaatcttggttgtgccgaggcagttgtttggcttgcaagatggcgttgtgagacctaaaatcaatcaaataatagcaaatcggtttctacttgaagagagaaagagcacatgaacaagaggaaattgaggataacaatgagcctaaaaaaagagctaatccagtcgaggacacaacttcagtttgtttttcgtcacattatatcgtcttcaaactaaacctctagaataggtgagtagacggttatttaacacgttttattcgtttgccattgtcgcaatcaccttttttacaccgttacaacttacaagtaggtcgtaagtatcttgctggcctacttaaaaatagtgtattttgctgatccatacaagtcatttccatctgtcatttgcgtactgcatggcccattcaagcgaaacgaacagtacaatgcgagcttgtcatctttctccaatgtgcagtgcaatatgtcaaaatgcacacgaggcttcacgcgtaaatatcaatgcgtccggtggttatggagacagacctgtgcattgcacgcactgattcgaaccctttcatcgatgtcaatttttcatacaattttacctttacaaccccattggggaattgtaatatgcatattcgctaggtcaaaaaaaatgcatattctgaatatgtagagtctaaagtagacacgggagaccaaaaaacaacaccgacccaggctaaggctgtcaatgatgctaccatgggagcgacagtgccacccctcccctctttctctccatctcccccctcttttctttctccttccatttttcccttttcctctctcttgattctctagatccggttgtgccttttcaaatccacctcgtcggtgatggtgatgagtctggtcggcggtggcactgcttcgtgcgtaggggtggatgtcgagctagctcagctcggctcagctcggtttagctcgttaggataacaagctagcttggctcggctcgttatcctaacgagctagaaaccaagctcggcttggttcgtctgcaagcttgagctagctcgtatagctcgtgagctttgggaacaagagagaaagcgaacaaggggaggagaggcgccgggggagcgacgacatccacagcggcgtcgggcgctggggaagagcggcgcgggcgacggcgtcggtcgttgcctcgctgggagagagcggtgcgggcagcagcgtccatggcggcgtcggtcgctgcctcgctgggggagagcggcgcggacggcgacatccacggtggcaccgggcgccgaggaagagcggcgcgagcgtcggcatccacggtggcgccgggcgccgaggaagagcggcgcgagcgtcggcatccacggtggcgccgggtgccggggaagagcagcgttcgcggctgcgtcgggcactgagggagagtggcacgggcggcggcggcgatcgctcggggagaacggcctgggtgggcagtgagcggctggcacgacgcgatggtgcctggtggtggaggcggactggcggcggagagatggagagtttgagacacagagtgaggactagggtttgctctaatgggcctactatccttgtgggctttgtgggttgcctgttgttgctgggttatgaaagctcgttaaggctcgcgagcagctcgcgagccggctcgagctggctcgtaatctctaataagctaaaatgccagctcggctcgttaagaaattcaaacgagccgagccgagcctgtcacgagccaagcgagctaacgagccacgagcttcctgtccacacctattcgtgcgagaaccaaacaagggctggagaggcgctcgggcgccgtgatgtgttgcgaatgtgatggaaggctggaagcatcagtacaggtgctgagcttgaaggtgatcgatctgccccgtctcaagcctgacttccttagggaccatgaatggtttggtggcaaggcaggatgccgcaacaagtgttggtgatgacggtagtaatggtggcctttctaccctctagaaggaggtcagctctgttgtgccgcatcggacggtctaccctacgtcctcagcaatgaaatggcgccttggcagcgacaacaaggtggtgtgtcgaagcggcaatgaaggctgtgggagtcagcggtggcgggttctcaatgttggctccttgaacacatgccgacaacacggtggatggatctggcctaatggccaaatcaccctctaggtgacaaaaggttgttgcaccaagatggcctaatagccaggattacgataggtaggttgtcaatgctggctacaaatggggcataacactagatctggggcctaagtgccactagatttgagatgtctatgctcaaacccattcatgtgcggcaagctgcgttggacgggcttcttctctagctgttaatagtgaaatttggtaagcccggagtagtcatcggcttagagtcagcatcggctttgaagtcctgagattagccgatgagagttgccaagtcgtcagttgtcggattcttgctatattcggttaaggaaattgatctactaaaggaatcttatccagaagagaccaagttcaaagagaatgcggcatggcaagttatgtattaattaggaatagtttgttagtttcctgttatctttagaaaagtgtgtttagtgtcctataaggactttatcttttccttttatctttaagaaagtttctttcttgtccgacaaggacttgtatcaactcatgggtataaatatgtatacccggggtctatgtaatctatcgttacgatcaatacaattcggcgcatcaccaccctttttacttctacttttgtttttacgttccggcggaacttggcatccgacgcggggctgcatcgtcttcgatctctggcgaagggataaatccaatgttccgccggtccaagcaattgtatcgtctacgtcggtgttgttcaaggttgcatcaggacattcaacctcttggattactctggtttggataatatatttgcttggctatttattatatgtctatgttaatctagtcctaacatctcaatttagctctatcggctgtttctcgctttagggtttctgccggtatcagctaattcgccttgctagattagattagcctaggcatctaccaccctgaaaatcagtcaacggcttaattgtctagatattatatttcttttcatacttagtgctgcatcagttaagttcgatctactaagtcatgcttagaactataatctctaacctgcttcttgattgccaataagagtttcatcggggtttcaaccgatgagttatctagacgttgcatcggcttacaaggattgcatacatattggatttagccgatcgcagtaaaatttaattgtttaatataatcttgtggattttatgacatcagacctccagtcgatgtatgctttaaccttcggatcagtgtttattatatattgtttctagtcgattggtttctactcgattatattgttattttattacatcagccgattgcctttatatcatcatctatattggacatatagccgatttcttaaaccctatcgctatcggctggtatcggcatcggctggaatcactacatcggcttgtcagccgatcggctgttttatctgctgtttatatatcttgtcagttgcaggatcaaactgactggcacgcccgtatctcatcaatctttggacctgcacaggagttaagcagatcttccaggccggtgtttttgattttttcgtcaacactagctctactggatggcatgggcaaggaaggcactagggatagaaattgttagatttggatcaattggattcgcccaatgacaggggcaaggtgacgaaagagctagtcagatgtgaatagaacatggatgaggggggtccaagagttcggactacatatcaatgtcgactcggtgcaatttttggtgtggtaggattcattaggcaacgaaaggtatgagccttcgagtattttcattttcctttttcttttgttgtttcttatttatgagatttaaaatataagtatttatttatcctttgtttgttctcgtggatatagatgctagatttttatctattagctaaacttgaaaataagtaatgagtatgaacaatagaagaaatacggtagtgcaatcatgttatgtactccctccgtttcacaatgtaagtcattctagtattttccacattcatattaatattaataaatctaatagatatatatgtctaaattcattaacatcaatataaatgtgaaaaatactagaatgacttacattatgaaacggaggaagtaggaagtaatatggtagaggacggcttatatttgagtaacatacggcatgcatttccttggtaaaatcaaataatactgaaacgccaagcgcgttttatttgtgagacctactattttttaaattttgtgactgtaatggttaagtatgttctaaacaccttaagttttttttaaaaaataaaatagttctcgaaaggatctttaattgataccggcacacagagctcctgattttgtaacaacttgttatttaaaaaaaatagatttcaaaggaaaaaatatataagagaagataaatttacgtgaaattctcgtaatttacgtgaaatactcgtattcgttgagaaaatattttgggtgtgtacggaagatgcaattaggaccttgcacgcaaaaagaaatagctcattagcatagattaattaagtattagatataaacattttaaaaaatattaatataactttttaaaaacaaatttcttataattttttttttaagaaaacaccggttatcatacagaaaacaagaaaacaagggaatagaagttgaaaaatgagagatcgtataaatttttctactattatatcgtgcatagctagcatagcaaattaaccagctgatttggcatgtatctaagctatttattatataccgttcaaaatcatttccttgtaaccggcaacgaccggtcttaggttggttacgttgtgtaacaaaaatactctatttcttctaattactgacgtgcaatctttttatttgtttatgaaagaaaattagaaaacaatttagtttaaaatctgaagcagttcggaatatatgagtgggaaatcactaaaggaagttttttttaatgaaacttgtacaacctactttctgcagagtactccaaatcataagaaggggtgggaccggattgggaggggagagagatcaggctcctctaccttcgaagatgtgtggacccgataaaccatggacccgcttgtccgtgacatagacacggtgtctttgaaggcagagaatctcagttcggatagtttttttcagacctttttatttttttaattttatttttccgaaaagtatttgcaaatctgaaccttttggccacaccagatcgtgactaaatcactttgtcacgtcacgcatagctggcgtggcaaaacaatcgttggttcaatttttagaaatatttttcggaatgtatattaataaaaataaaaagaattaggagggggaggagccctaatctgtggcgccgggctggccctgggcctaggcgagttgtgcgaccgcctaaggccagagtggagggggggccatcaccacctccaacccaacaggcccagtcacttggcaggaatcgagtattgagatcgagggcaacgcgcgatgtggcggtttgtgggtcctggcgctctctcttttctccctgaccgcgacggccgcaaccctcgatctgtcccttctctttgcagcgagacgacgagagaagacaagtcaagcataagtgcaaaaccagcagccaggtagtctccgcttcttgatcttgtttgcaaaaaaggctcactgcatctataatctatttactccaaaatttaggttatgattttcttcttcttttgatttacttacatggcaagtccactattttaggtgttagtacaatattacttgacaagcatttgtcgattaatttgctaaagaaactaaagaactttattgatttgcaaagaaagagaactagaagttcttttttacaatacacatcggatcttgttgtcttcaatttctatttatataagttattcagactactttatttctgtggtttttttattgtctaatatactatcaacattgtttatcaagaataaaatattatataacaatttacaactagttgatttattatttactatgttagtaatattgtttttgtcactttagagattagaccacagttacatattacaaataaaaaatatttaaccttaagggcctatgtcaccgagttcacgtagggcccttgaaattatagagctagccctacgaacgggcggcggagggggaaaaattggagtcggtgagaaagatggtgagcagcatgaagcttcctttggtggatggggaggagcagtcgtcctatgaccccatgggggaaaagttgaagatgatgagcggcaagattatttcggaggagcagcgtctagtggagttggagttggagttggaagatgaagaggaggtggaagatgaggagttggccgagctgataacggcgcgagacttccgtgtcagctgggaacatcgctttacccctcgctattccttcaacgacaccagtaagtaataaatcctcctccgccccgccgttttattctgcttccgtttctttctttacttcaacgcaatcaagattatttctgcgaatctatcta

SEQ ID NO: 18146 - DNA, 3944 bp, Oryza sativa
cagatccttttttctcccattctgaatccaagtaaatttcataaaactacaggtattttgcacaatttatcacaaaactacatatttaagagcttgtttcacaaaactacagatttaatgtctctgtttatcacaaaactacaggtactttgtataatctatcataaaactatatatttaagaactgtttcacaaaactatagatttattgtattcgtttatcacagaactacacatttagtgtcttcatttatcataaaactacggatttagtgtctccattattacaaaactacatattttgacaatgctaatacctgtagttttgtgataatgaagacactaaacttgtagttttgtgataaatgaatatattaaatctgtagttttgtgaaataaattcttaaatatgtagttttgtgaaatattgtgcaaagtgcatgtagttttgtgataaatgaatatattgaatttgtagttttatgaaacaagctcttaaatagatcatgcaaagtatatgtggttttatgaaatttactcatccaattatcgttccagaaggtagctttactcccgtcacccaacgtgatggtagctgccgccgcaaaaggttctttgttgattgtatcacaaggaacctccatttggcgaagggccctggcgaactcctgcagctccaaaaatgggtccacccaaatttcttggtttggctggcatacagtcgcccaatttaccaaactgtgtccaggggtgatattttctgggtcttaccctttccacaaaaaggctctcctaattctgtcaattttcttgatcaaccatttttgtacgtagaactgtgagatggtatgttgggattgagctcagagcagtcttgatatgttgttcatcttactcctcattctcatcaaggttaatgtctagtactccatatatgtgcttatccacattgtcacatcaatcatttaactaaaacttggatttttgagtcaaaaatgggacacaacaatagcatccacaatgctattatttgataataaatattactgctacttgactgcagcaaccgtatgtcccatgcgctatacggagggacctatcccaagatatgcttgctgtggtgataccttgcagatcttctctctccaagtgaaagaagcaaaaggtggtcttgactggccgctgcatgtgtatggcttggttgccaccagggactctgtagatcaaaggcgcaaccttcttttcaggtgcacaagggataattgtcaaattctcactccacaggtatctatcttgtaatttccttatacctttattgttttctcatttttcttttgcagcttgaagtgctcaacctatcatactagtagattactactgttctgtacacttgtttgtataaatatgttgtctttttggagttattagtgcattataggctggctgcacctaaactgtcaattgaaggcatgtttgcaatttttttccttaccactcttttttcacataattcattggtaaaaactaaaaactgagcatttgtttagttcccaaattttttttactcaaacgtctcatcgaatctttggatatatgcatggagcattaaatatagataaaaaaaactaattgcacggtttgcacggaaatcgcgagacgaatcttgtgagcctaattaatccatgattagccataagtgctcagtaacccacatgtgctaatgacggattaattaggcttaataaatcgtctcgcggtttctaggcgagttatgaaattagttttgtcattcatgtccgaaccccttccgacatccggtcaaacgtccaatgtgacacctaaaaattttcttttcgcgaactaaacacactgtgagttgatagaattggcaccactatgacctatacctatactccttttgaaataatccactcgtggtgttggcattgaatctgctgtgtcaactcttcctaccacagttttctataaatcaacctgtgatgatagttaatattatcaacagccaaacatagcagtattgccacatgtataaccaagatgagcactcactgttgcaaataaatgaatagcatattgcatgcaaaacataaattaggtttgtttattttaggcaatattatggcatactttcttttattggtagcaaagctattgcatttaccttgtctatggaaatagaagttttgtgatggaccgtctttaacatgggctcgtaggaaataactgcatggattggttgcatactggatccttattatacggagggaaccaagttttagtaataatcaattggttgtgatgcctgcaggattcacacctgctgttaacaggcccatctcgtgcagttgtggtaattgatccagtaacgtttgaagttgaactaaaggtaaaaggaaaaacagaggctgaggataaggtgttgagcctaagggtctttatgcaccacactgtgcatgctccgcagatgtttgtccagcaaacatggggagcttgagttgacatgtgctggacttgtagagcagttgaggccacaatggtgagtatccaagttagagaggggtcatggccagatcatatacgagggttggtcgtttgtcgtacgggcagcgtagagggaggggattttgtgctgcttgattctggagatggaagaatgcctattaacagctacgatggtggcattgagctttcaaggcgtcgtcgcacaacctcaatgtcgtcgttgcaagaggcagtgctgttttcaagcctcgccgtgccgggagtactagtcttgtatgggaccttgggttttgtaaggtggaagctactgtttgttggtcgctccacgcgaccttgaggcaaatgctctcgggcatgccttgatccatactaatcactttagcttgttttgatttttgagttaacgtacagctcggctgcatatgcttgcgtaattgtgtttttggcgtcatggtctgctcaaccccagccgtgttcaggactagtaccatgtaacatatatatgcttcaatgtcagaatccaacctttttaactttctgctgttttcttaatgaaggttagctgcctattcacttcactgaacgtacatgaagcgcagcagcagtttattaaccaaacacgtatagttagccagcagctacgttgaatcaaacaacagatcgaagaggaatcatccgttccgttccaccgccaaatccaatgtcatccaatcacttcaatttgcatctctcacatcaccatctcttacccttattcagaccgcaacacccttacatatatagcgtcaagtaatggaagcaaccacatacatacatcgttgcatacacatgcaggcctgcaggctgcagctaatccaatcccgaccaagaagcaaccggttcaattcattaacaccaattaacatatggatggatgcaatcagcaagatgcaaaatgaacaagatattttccccacaagcatctgggactggaagggacatgacatgcccacccttgttatcgtcaaatatcaatcttgacattatatcaagccttcatcttcaagttccactatttcgcaaaggaaaaaatatgaattacccccctaaactatcgtcgtcggccgaagttccctctgaaccaaaaaatcagacatcactcaccctaaacttttaataccggacgaattacccccctcgacccaatccggagcagttttgtcctacgtggcgcacacgtggcaacccagtcagcatttctttttttaaacacggtggggcctgcttgtcattctctcacctcgttttcctcttcccctcctacccctctccctctcgtgtcgttaggagagcggtgggcggtggctcgtcgtcaggagcggccgtgcggccggtcggcgcacacggcggcgggcgtgcgagggcgggcggtggacgcgcga

SEQ ID NO: 18147 - DNA, 5442 bp, Oryza sativa
  unsure (1)..(5442): unsure at all n locations
agggaaggggaggaacggctgcggcgaggagatggcgtcgccgccagcggctcgccacccagccgcgcccgctgtcgccgctcgcgtgccaaccgcccatcgcccgccctcgcgcgccaccgccgccgccgccgctcgcgtgccgaccacccaccgcccgccctcgtgcgcccgctgtccaccgcccgccctcgtgcacccgccgcccacacttgtccgccgccgtgtgcgccgaccggccgcgcggccgctcctgatgacgagccaccgcccaccgctcgcctgacgacacgagagagagacagagagaggggtaggaggggaagaggaaaaggaggtgagagacaatgacaagtaggcccaaccatgtttaaaaaaaaagaaatgctgactaggttgccacgtatacgccacgtaggacaaaactgctccggattgggtcggggggggggggtaattcgtccggtattaaaagtttagggtgagtgacgtctggtttttgggtttagagggaaaattcagccgacggcgatagttcaggggggtaattcgtactttttcctttcgcaaaatcaaatatcatcccctcatactgagataaaaacagtaagtatgaggggaacttttagaggttaattaaagcacatttatacaaacaagtgtacagagcagtgaattgcctactggaattgtgcacacattatcgtcccctcgtactgagataaaaacagtaagcatgaggggaatttttagaggttaattaaagcacatttatacaaacaagtgtacagagcagtgaattgcctactggaattgtgcacacattatcgtcccctcgtactgagataaaaacagtaagcatgaggggaatttttagaggttaattaaaatacaaaccacctcattccaaatatgtgaatgcaccatggcaggttgcccatttcatatttgaatgaaaccataaggattactagataaaaactctatccaaatatatgccttaagatagacaacaacatgtgaataactcaggtagcaattagatacgatgatgcttgtagatcaactattattctaaggtaaaaatatagtacagacgattattgcatcacagaatagctactaaatactaaagctcctacacaaagcattgtgaatgctcaaccaaaaaatacatggagcacaaatacttcagcaccatcctctaaatgattcattcatataagctattagccaggtttatggtcatgtgacaaggaaggaatacctggtcttctcggttttaacttgtagttagaccatatgcatgttgatatgatcagcatgcagttattagatgaaagaacagcagcctggctacaatttctaaatcattacaacaataggtgaaaagaagtaaactgcaagatagagtatataggttatacaatcgtagatagaggaagaactctagtacaagagcaaagcctgatgtacaattatgagataggggatttctctagaattattatgaagccaatcagaagatagggacacccaattactcaattaaatgatgcaacctaatagcatacagatgcagtaagtaataataaatgtaagatgagctagtaagatgcactcatcaatgaaagtagtggtagaattgagaagcatcctcaagaagaaaagtgtagtaacactagcaatcaatcccaaagagacaaattttgcgagcccaagtaattaattagcaacaaatgtttgaaagaaggtaagaagaaacagtaagggaaccataaacttgcactagggtatattgcttcacaaatcagttcaaatttgaatggaaccataaggattagtggaaaagaactctatccaaacatgcattaagatagataacacaacttgtgaattactacaaattagcattcagatgtactagcagcaatagatgaggttgcaagaggagtagtagtagaattgagaagcatcttcagtaacagtaactacactgtaacaatcaaaattcccaagaggcacattttgcaagcacaagtaggagtaattagccacaattgttcgtctgaaacaaggtaaacaagagtaaagttgaactagggtagggtacaattggttggcagatctagcaagaactcagcaagcagatccatatccctactactccactaagcttaggtttgtctttcttcatacacaaaaaaaaacatgtcatctgatccgatccgatccgatccgatctgatctgatgagagagaaagtaggggaacaagagaaagggggatggatcaggcggaggcggaggcggcggtgcgggagcggtagagcttgccgaagacgtggagggcagtgacgaagcctatgaagcagagcgacatgacgagcaccatggtgggcgagaggcggaggccgggcgcctcgtcggtgtagaatcgcagcatgttgctcccgccgccaccggagaagcccccggagccgccggcggtggaggcgcggcggcggcgcatgccggcggccgcagcggccgtgccgcgggggccaacggtggcagggcgggcggccccggcggcggcgccgacggaggactgggactgggaggaggagcgagccatggcgattcgggtggaagacagggagacgagacgacgaatagtctactctctgggcttgggtttggatctcacatgatatactagtactgtacatacacccgcccgcccatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaatcatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaagatatgttatcttgtggtcattccaccacccgaggacgttgaaatcttgtgcttcatggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18148 - DNA, 704 bp, Oryza sativa
aattcctgcaccccgtacaggcgcaatgtactcctccgtgccaacaaatgaattggatgctcgcataggttcagcaaaaaatatggggtaactcccgttttttctcccttttttctcatcagcatcttcgggaagaaagacctaccaaataacataaaaatacttattgtaacttgggatgataatgaacttattgacatacatgctgaagtgtacgatagattgaaaacaatattacactagtataataatatgtgctatcccttgaggattagtatactgttgttaaaaaaaaatacttaccacacgatgagcaaagcatgtttaatgagtaaaatgcaacgctagtaccgcaacttgtgaggtgggtgcaatttagtcacccatattgtaaaatgctcaaacaagccactcatcttgttttagggggtgcaaagcacataaaacatgtgccttgtgggttgttcgcaatgaagttatgctctatgttaatttgttttgcaaacatggtcacatgatccataaataagagaacgtgcaataccaccagtagtaaatccaattaaagatgaattttgttattgattgacaagcacaatatggtcgtgttcattgacagcgggagtagtagcatatacatggaaaaaaatgagtattagtttgtaactttaatgcttgccttgccaaatggctaaaaaaagcat

SEQ ID NO: 18149 - DNA, 6156 bp, Oryza sativa
  unsure (1)..(6156): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagggagaacctggggagtgtgtagatgcaacagaattcagaagcttgattgggagtcttcgctacttggtaaataccagaccagatttgtgctattcagttggatacgtcagccgttttatggagaatcccacttctaaacactgggctgcgatgaagcatgtactgcagtatgtggctggtacacagaattttggaattcagtttagcaggaagaaacaagaaattcctcagcttattggctatagtgatagtgatatggctggggatatcaatgataggaagagtacatcgggtgtgctgttcaaattgggtgaaagtttactcagctggcagtcacagaagcaaaaaattgtagccctgtcttcatgtgaagcagagtatgtggcagccacaactggagcctgtcagggtgtgtggctagcacggctaattggcgagctgcgagcttgtgatcctcagtgtgtaattctgaaggttgacaataaatctgctatcaatctttgtaaaaatcctgtgcttcttgatcgtagcaagcacattgacacaaggtttcacttcattcgggaatgtgtagatcagaaacggattgaagtggattacatcagaactgaggagcagattgcagatgtgctgacaaaacctctcggcaagaatcgttttctagaactgagaaggaagttgggaatggttgaagtatgaatgcatcaagattagggggtgatttgttagcctgaagataatcttgtgcatttgcaataatttgtttgcttcagttagtaagtttgaattcttaggcataggatgctgcatgcattgtaacggctgtcccaggaagtttcagtcttgggcagctgagcttttcccctttttctgttagtagcgatggaactggatctggagcgtgggatggcgcgttcagtcgtttggatccggtgaaatcaatgtttgttatgcatgtaacaacctcacaagatgagggaataaaattgaagagaaatcagaaaagctgcaggtggttacgcagcaccaaaaaaaaaaaaactctgttcttcgtttcagttcttcagttactgttcacgtctgaaaaatattcagagattgtaggttagccactgatcgagagctaagcgaggggtttttgctgacaccactacctagtgtatattatttgatagaaaaacctcctaatatatatctcagataattgtggacctttagattgctttaagattcgtgccaacaccttaaaccctaacccttcttccttcctcctcactcccactgccgccgccattgccattcctcctccaatcctcccccatctcctccactcaactcgatggcgccggttgaacctcccctcctccccgcctcttctttttctcaagctgctggtggtaaggtgtccccatctcgtcatctttcccgttttcggtggcttcccgctatatgaaacaccaccaccgtccccgtcttctaatgacttgctccactttgtcctcactagcaacattattggcccaccgcccgccaccgattctagggcttcagcggtgccatcgccgccttgtcaacgagttgccacttggtacctcccacagtcatccctctaagaccggatcagatttttatccctctttgccctccctccacccctaacctcatctagaaacctaaaccctaactcgttgggttagtgttagtcgttgaagttcgttgcttgaccaggccccgcctatgcctaagaggaggaggcctggcacgaaatgtgaagcatatcagaaggttagaaatgtgcaagattttggtcccaatttttattataacatgatttaggaattccgtaattagtactgcattaagtattcttaattgtaacattgcaaagctgatcatgtgtacgtgcattaatatttggtattcattgatcagtacgcttgccggaagaggcttgcggacgagagggcgagggtgaagggccgcttcgtctccagctccggcggcaacgataataatgcacctgcacatgagctgccgccgtcgcttgtcaatctcagcgatggtgctgctgctgctgcaatcatcccaacaagaagtgtgccggagtggtggccagaaatgcaggcgtcattggccagggatgagatgtgtggcggcgcgggcatgaatctccacctgtgcgacgccaacgagatggagcaggttgctgcctacgttggcgtctcctccatggacctctgcgcctacctgcactgctcatggccgcccgtttagctaattagctagctaaatcgcatcgattgattttggttcgttgttataaattcctcaatgatctagatcggcacccgacttgcaaaattgatctgtagatcaagcagcaaaggaacattttgaagaaacaagcaaagcattcattcgttcccttatttttgtcttgttatactattttgttagtccaacgtgttgaatagtgtcgggtgagaagaatatataaatattagacacgttatattaaacctcagggtagaggaggtatataaggaaacgagtctattcaaatcaattctatcataagatatattttactaccatatactctaacatcccccacaatacaagcgtgagcaacacagacgcttatattagagaaaaatcctaggagagtgctcaacacagatgatagccttttgtgttgtaatcgatgtagctaaagtgaagggtaaaacgtagccatggtcgatgaagccatgcatagagtagctgcggtcgatgtagctgaagtcggtggtgctgatgacgaggtagccgagccacaggacgcacaaggggcatcgtagagtggtcgtgcgtgcgcaggatggctccaaggaccaaggtgtaaaatgatgtgctgaagacaaagatggtgacactggagaacaaggtatcacaccaggtttgccaagcctagggacaactcgggaagatgcacacaatggtgctgccaataccgtgcgcgcgaggttgtcgaccaacttgagtattgcactagtgtcgaaggggactagcaaagaaagcctcagagacggtcgcagtgcatagagcggcatagaggaagtagtgtcggtgcatcttgctgttgttagagtcgaacgaacatgtttgaagaagagacaacgctggtaacgttcgtaataaataacaagaaggtcccgaactagtataaatccttatcatttgtctgctaggtacaatctagcgtacaccataggatcagccgattaggtcatggccctacaatttgcacgcattcagcttggctagcgcactcaaccaggtaacttcccaatggggcctccaaatatgtgagtggacgtgagtaagccaaaactcacatgtacactccaccttatcctcttccacaacaaaaccctcctcctatcctctacacgtgatgtaccccatgtaccccattgcatgcgccactgttggttgacgcccgtttcccgctgtgttgaccctgcccatcgccttttcccgaccacagctagcagtgccactgccatctcaccatcactcagttcccagtaagacactttcacaaccatctctctaaacacagcctccccccttccctgttcctctggctgcccctccaacccccactggtccaccctggtagggaaccctaatccatctaggcttgggcaataatggttgtgccgcattggtgctcatgcgcgtcctagctgtaacgccccaattttcattcagaattaaaaatcattaaataatacattttgtagaaattaaataaaagttaaagcaatttaatcaagtgaaattatagaggaaattaaaaattcctttaaaaatcttatccgggaatattttgtaatattctctgtgccctaataaactctctgaaatttcccgtgaattttcagagctcaagaagtaattataataatacaaacaccatttaatcaattaaattaaattgtaaaacaaattaaaacttccccttcctcctttttgggccgcttttggcccaatcccccttcacctcccgcagccgcgcaccccctctctctccctcaggccggcctatccctctccctcggcccggcccttttgcctccccgcgcaaagcctattttgcctccctcctcctccttcctcccctcgctgacaagtgggaccggcggtcccacccgtcagctcttcccctacctctggcctcccaagccaaaaccgccatggccgccttctccccatgtcgtcgcctcccccgcgcccactacgctcccctcccccgcgtcgcccgtgaccgccacccacctcctccactccgcccgcgcgccgcgcccgcaaatcggcacggatttgaatttcgaatccgccgccctctctctctcttcccccgcgttgctagccggttgccgcccctctcggccacgatctctcctccccgagcctatcaaaaatactccccggggcagcctctccccttctccccatttgcccgagctccccacaccacctcccgtgctccccacgctaccctccatctctgccaccctccgctgagcttcgaccgcacgccaccgccgctctagccgccgccaccactagctccgccgcgcctcgccgcatgccggcctttgctccatttccccaatccgccaccgaatcaccacctccactgcgaacccgaggccgccgccgcattcgccgcctcccgctcgccatggctgcctgatccccctttggggcaatctgggccatccacgtggcccctcggtgccgccccgtgtcagctcccacgtgacgccacgtcggtgccacctccgcctacctgtccgccatggccaccacgtggtgcacccgcagatggtgtgcgcgtgaactcggtccaccgtgcgccctccccctcaccgacaggtggggctgcgtgtcggcgccacctaatcccctcggctgacgccataaatagctttaattgcgcaataaattcggtttaacttctagaaatccatttaaatggctcaaaacttctaaaattgagttgttcaacttgcaaaattcatctaaaattgagctctgcatgtttgtttacttttcatgtattgttaacttgatttttattagagtttttcctcgttttgcatgccagcacgtagattccgccgtttcggaagtccgtggtcgcgaggaaagagtttagaagattatattgaagaagcaaggcaagtcacacattccccttgagaatgttgattctagtttataaatgttttatcgttttcaaataaaattgcatgtcttgctaattacgtgggatcatggttttacctatatgttcatttgtgccatattactttatgtctgtcctttgtcaaacttgggtaataattcgactagcttgtgttacttaagttgacctagctagaactataggattagccatgcttaactaccactagctcacataatgggataatcacatcattagacatctcgtatcttgatgagctgcgtgctcaagacatccgatcatgtttcattggtcgtaattatccaaataaaacacgacttaatggtgggttgtgggtgcatggttttgctagtcgcgcccatggcaattaaggtccggttcacgggatgaactggaatacttactgcgcgtaccacaagcgggaatgggtaactacttgatctgtagctttcctctagctgacgtacccaggctagagtgggcatgatggagtatggatgggccctgcgacggcctttgctgcttccggattcaccgtggcacgggggggggggggggggcggggggggggggggggggggggggggggggggggggggggggggggggggggggggggggcgggggggggggggggggggggggggggggggggggggggggggggggggggggggggggggggggggggggggggggggggggggggggggggggggggggggggggggggggggggggggggggggggggggggggggg

SEQ ID NO: 18150 - DNA, 10529 bp, Oryza sativa
ctgcctgttagggcaggggcgaaacctgaggtgtggcatctattggtccgaggaagttatataaagggtattgtcataatcactcgacatggtgacgtgtctggccgagcatggtgacacgctggtggattgtgtcttgtgggtacagttgtgcacctctggccagagtaaaactatttgaatagccgtgctggttatgggtgatcgaccagattcaccgtgattagtcccatccttaataattggttaatgaactagtgtaattcaggtggtttggttgggtctgttcaacgtggtgtagcgttgatcagtggagatttaatattaccttaattaaacaactgttttaccgttttcaactataaatgctttacaactgtctttatgcaaatagccacaaacctccctttgtgccccattgcatgagtgcatcattggtgtggcttgctaagtatggtggttgcactcagccatgctattgttccctcttttcagaagtgtagagcttctgagctgaagacgaagttagaggatcaaggctcagaccccagttgagttttgtctgtggagtggagctgaagcctcgctaggatcgcctttttctgctgctgttactttcatttcgatgtgaggactaagtgcctcttatgtaagtattttacgctttatttacgtttggatatgtatatttacttattgttttgtgtaccctggctgattcctggatagaaatttaatatacaaaatagtctgaaaattagcaaatcagaagtttatcataatccatttataggtaatgagcgtgcacttggtatgcctgtctcttgggtagccaaataaaatttctacttcccaagtctctaaatatagtttattttggattgcggactatattaagaaagtatgtgaaatagaattagagatggtacgtgaattacttaaaatgaggaagtacatggagaaatttaactgggatggctgtgatttgttgaaaggagggaatagatagagaagttatgttatgttttgggatcgataaacttttgaagttaaaagttactattattcgagtaacttcagactttcataatgtaatcaacataatgatggcattattatcaaggagtactacactagctctagtggccgagtagactcctttgatcccatgcgcctgactctctctctctcgaactgtcactcatctgactggggtggcgtttgtctccctagcagagtggcgctgctgatcgatttcaagcgaattcgggtggtgggtggttatttgggtgtaaagtttttaaagtatagggacacacatttgcggtattaaatataaattaataacaaattccgcttgtaaactgcgagacgaatttattaagcctaattaatctattattagtaaatgtttactatagcatcacattgtcaaatcatggcaaaatttgggtcaaaaatttgtctcgcaatttacatacaaactatgcgattggttttttctatatttagtgctccatgcatgtgtccaaatatttgatgtgacttttttaccaaattttttgaaatctaaacagttgggcaaacatgcacaatcaattaatgtacctgcagacatggaaaacccttaacttgttcacctgtaaagcgagcgagctaattcatggaatgtgtactgcgtactccagctatatactagtagcatgcatgttgctagactgtgtcagtgtatactagctagagatccagatcatccagcccatgcatgaacaggttaagatcttgagtaatttataagtccagatgtacgtctaatatttaggctttatttagattcaaacttttttcttcaaacttttaatttttccacgtccatcaaatgtttgaacatatgcataaagcattaaatatggacaaaaaaaaattaattgcacagtttgcatataaatcgcgagacaaattttttaagcctaattacaccatgatttgacaatgtggtgctacagtaaatatttgctaatgatggattaattagacttaatagattcgtctcgcagtttacaggtggaatctgtaatttgttttgttattagtctacatttaatatttcaaatgtgtgtccgcatacttaaaaaaattttggcacacgaaataaacacagccttagttaagaaaggcctaattttatcatatatatatatatataatattaaacgatgttcattgtatatgtattactactccatccgtcccaaaatataaacactttcggactttgacacagtctttgagatgctactttgacaaacgatatctctaaaagtaatatgttttaaataaaaaaaattgcatattgtgataatttatttaatgataaatctagtaacatcaattttacataattgcaattttaaataaaaagatttgcatattgtgataatttattttttatattttttctattaatagtcaaagttacaaatatttgagttgacactatgctaaaaatgcttgtattttggacggaaggagtatatcatacatatgaattgatagttgtgaagtttattaattacctcacccctccatttagaaagctagtacgtactccagccacgtatacctcctctcatcaatcctcacaactaattgatagtccttgagactctgttatgtaactagcttggctaaatctcagtcaactcgagcatgctaaatattcttgatacgagggcctagatgatgtattcagcatttctatacaacatggagagacgtcagtgggagagatcgcgaggaagggctaccatcgaagacaatgttgacttcctcaacaagcccttaggagaagtctttcttggcaacattgagaccagagctccatcaaagaagaacattttgaaaggaacaccaaagaagaacattggaatatgtttttgagttgggtgacggtgggaagaaggtattaggtagtggggggtttagagggactagactaatctttacctattataaaaattaaagatggattctctactaaactgatttttcgtacgtcatcacttatccgtgtcggtcttgttctcgcaattagcgccacaaattgatatcgttctgcaccctacgcgctcgcgtgatacgtccgatacccgtgtcctgtactctccctgtcccaacataaatcaacctagctcgtactaggatatgacacattctactacaacgaatcaggacatactctatgttcagatttgttgtactagaatgtgtcacatcctagtacggggttggtttattttgggatggagagagtactcagtacgcaagcggaggactctcacaggctagacccaagggccccccgatttgtaggctccccatgttatctgtgtgttgcgaggttaattttcctagattcaatgaattgtaaatgatgttgcatgcttatatatataagttttgatatgtacttgttgctagtggatgatgtggtatgtttgcaactttgcatgttttgagcttagatctagtgggttaggtatagatctcacaactcatagcaagccggcacttgaccttaatttcacatttgctagctaagtactaattgaagaagtgtcatgcatatgcatgaaattaatcgatcagaattgcattgaagtaggtggtgcaatgggcataatgcagtcagcaggaaaagtatacatacaggctatttaactcatcaaacaggtccataaattaggttttgaatggcctctagctgcatgggatcagaaggaaggaaggaaggaagatatcgatctggggaggagagatagagcaaagaaaaaaaggtatcgagatgacagatggcatgaactcgatctgcaagtttttatggctcgagcggcatatatatgcagcaatatattgaaggcctggcagcatctgctaactgctgatgagacagtgcgtaggagtatactagaacagtacttgtttgagttcaaattaaaacccctttctttgtcgaagaactgctctaactcatgacaacgctcgtagtggaaggagcggcacatgttcagccactccacattttcagtggctatatcatctagcattctgtctgttttggggattttaggcagctacatcgagaacgcgcgatatgtgatgcaaataccagcatatagctagcaaatacaacttacctaattgaaataatatacacatatagtcaattgctgggaggtcattcttcaatttgtgtcagtcaagcgtgcatgtaatgtatgggtgggccttcatcagagggtctagtagtacgtaggaaaagaacaaaaagagagtgagaactgaaggaactgtagagatatataggtggtgtctctctccatcatcaccttatgatgcagtacccaataaccaactgcagcctcaaggcagaagggttgtgttgtgcctagcatatatatgcatatgaatgcattccccattactctctctcgtagcttggtgtagtacgtactacaagctatagctagcaggcaggcaaaactttaaaaacacatgcatcctcctctgctgtctagtgtagttgaagagagaattgaaggggcatcgatgatcgatcgcattcaagatttcacttgaatgccggctaaggacaacagtgtgcatgcaattacgtatatatagtatcgatcctcttgcacccatgcatcctgtccctgtccctgctagctagctacatgcaattgcagcgatcactgccctcttccattccacactacgtactctctgacctctgaacgtctagccattcatttaacattaactagcaccactgcactgcgctgcagctgtggtactactgtttgtcaattcaacgtagacgaagagaaaaaagtacagcttaaagctggaacggaacctgtgaaatttacatgcatgcgcagcggtctaacagcagctcatctaaattggctactccacatctcagtttggatgactatctaataaagattccttttctatatttcttcctacttcaacacatcatccatatcatccttattatacccttcatatcgcctcttatatattttaataatactagaaaaaatacccatgcgttgcaacgggtgaagtctattttaatcttattaatgttatatatgatttagttaagatgaaattcactatgggagttcgcttggatatatactccctccatccacaaaagttgcacctatttcatatttgagttttttcaaataagttgttcctatttgtagtctttatgcattcaagacttaaatgaagagataaattaaatgttttattagaacccaaagagtcatctaaatactcattggttacatgcttgcattcactccttgattttgtaacatccaaggtgatttaatttctccttggtattggtgtcaaaagtaatatgtgtaacttttgtggatggagggagtatatttttacaaaatcatgagctatagttaggagtctgatcgtctcaagttagcatgcgagtttttttaaacagatttcttatatgattccttctgtattaccaaaagtgaacgaccttgaaaatcgacttaaatacggatatgtatttccaaaaggaaacgaacataaaaaccaactcatacacggatgacgtaccaaaataccggcaaaaacatcttcaatttttatatattttaataatatattgtaaccaacttttctatgtacgtgtttttttaaagcctggattagttaaaagaaacaatgtatcactattctctagacatgcttcactgatagttactaatttaatctctcacatatatggatggttgattaataaaacaagtactacgtttactatgaaagcaaataataataataataataataataataataataataataataataataataataataaaaagaagagataacgcctttccccaaccccagtccccagccgcatagatgtgcgatactgccgatgcggctaagcgggcggagcggcgaccgaaagcgtgcgcggagggaatgtgcggtgggagcggcggcggaagcaaagggggaggtgcggcggtggaaggcgggcgcaaaaattggaggtgcggtgggagcgttgatggaaggaaggcgcggagggggaggtgcggtgggagtggtggcggaaggcgcacgcggaggaggatgtgcggcgacactgcttctactccgactacctccaccagatcctgttggtaccaccactctacctccattccccaacctctattcctgaatctgggaaggacgtgattctgattgtggcgcgaatttgatccgaaggaagacagttgtgggatggtataaggagagagagatgccaatttgacgttcctctctccaggatggtggatgcgctaaaattggaggctatgatggcgcatctgctggagcccctttttcttcccccatatgttattttcggaatggcgtacgtgatagaggagctgctgggatgctctacggaaagaaaaagaaatgaaatagtgaagcggacatatataccagattccagctgctagctcgatccgctaattactagtgagttaagagtctaaattgcagaaattgaatcttagccttaccaccactgctgattgcggaattaattttgtactaagcattaattttatgaagccattgaacttgcctttgatctctccttccatcctttattttattttcttccttcttgatgcatatattgcaatatccgcctgctcgagattgcaggagatctgtggctactgatcaccagcttgatcaactagtggtcaccgatgggttgatgtattcgggaaatttaactatttgccactatattaggtttggcatgcaattatacaaatgcccctcttaaatttacttttatttttctctctaaagaactggtttagtaactagtatttactacttttcttcacgtggcatgccaacgtgataacccacggtgaaaaatgtgagatccactcatcagtacctttgatttcctcactatacgatcttttttcacgagtaaagatcccacactgtttttcaccctaggttgccatgttggcatgccatgtgggcaaaagtggtaaatagttaagaaaccacccctttattaaagggggaaaaataaaagcaaatctaacagggtaatttggataattgtcaaacctaatagttacaaatagttaacttaatttctcgatgcatcatgtagacaacatccttcagtgcattggcggcgacactggtcagggatcgcctcacgaaccccttcctgcgctttgagatagatcgagctctctatggtttagggtttagcgatagagacttatgtttcataggccttctcttggtgtcttaaccccatataaatgcattggtgagactcaggggccaattttgattaggaatctaattagttgttacggatcacaacttttttaatctcttattttcttgttgggaagaaaaccggtgaaaaattgtatctcccccattttgtatggatactaaccaataagatcaaccaacaattaggaatcaaacaaacaataacccagctggtgttgtactacgaggtatgcatagctcatgtattaaaaaatagtaatccttggagacaaattcgtttgattcaatcaggttccggtaatttcttaaacttgaaatatacctcggagaaaaaaaataaaaatagtaactagttgaaactatatattatggttatttattctctttagttttgttgatagcgggtcttgtttcgtcccttttatgatttactatcatgtttttatttggcgttatttgaaattttgaatatagttaggttgtgtacgtgcacctaattaatatcaaaaatccttatacacgggcgtctgatgagagagaaaaatatcatgtgcccgcgcgtctcatttcgcgtcgctaggactccccacgcctccctcgctcgcgtcgcctcctttcccccgtcggcgccgcctcctctacacgagctccctcgcctgtgctgcctcctctcccccgccaacctcgcctgcgctgcttcctctctcccgtcaacctcgcccgcgtcgtctcttcgtcggatccgccgctgcatttcttcttcctcgacgtcgacggcggtttcgtccccgtggtggtggccgacgcggaggatgatgcatgcgcggcgaggtggcaacgacggcggcggtggtggtggaggaggagactcgccggctccctctctctcccaggagcactccctcctcatctccaccgccctcccccttctcctcctctagattcggttatgagggcggtggagaagatcaatgcgggcaaccctgtgtttgtcagagaggaggagatgcaatctagaccaggttctatgttttttgtgtgtttcagctagtgtactcgtaatgttcattgtgtttggatcaaatgttgcaatggatattttgatagggtttcatatttctattttcgacattcaggtttcgttgatatttcgatggttcaaaagcaatgttcagctaatatactcatgatgtttctttatgtgtagatcaaatgttgtagtggattttagatagtgtttaatatttttatcttgatgtacactgggtttgttttgttgtacatagggtttaagtatttcaatggcttagatcgttttgttgcatatgttaaaccaaattgtttcatctagtgatctcaccgtgtttcaatttttttaagaactgaaacattctttcgctaagtgctgaaacattgtttttataaataatggtgaaacaacacactgatttttttggaaaaatctggcgcccaatttgtagacgcctccaattaataagtgcctgaataagattttccactatccaagaaatcataaactaagtaaatttatatatgctggctagctagctagcaactccggcctatatatacataagcagcttatcagatagctctaccagctgcaacgactcgatctcatcatatcgtgtcactcgcgctagtcacgctagatcgagtgctagtgatccatcgatattcgatacatatatatagagagagagagagaaatcgtgtgtaggtacgtagctgaggaggatgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaattactagcagagagtaatcctacttccactctaagctagctagctgctaatcacttagatctatcgatttaatttgtttctgcggccatatgcgttaattcgtacgtacgtacgtgtgtgccactgccaatatgcatgccacatgtgtgtcggcatatcgttcgtttcgttatcgcttcctcgatcgattacatatttgatattgttcttaaattagttttagctatctaggttagtcaatttccctcgactctttatgtaatctgatgagctagcttagcttctttgtgtaccaatggactttgctgatcaattatctatatatcgcttgctgttgattgacttttcgttttcgacacctaagggcctgtttacttcgcgaaccaaaatttttgacgtgtcacatcaaatatacgaacgcatttgaaatattaaacatagattaataacaaaacaaattacaaattctgcctagaaactgcaagacgaatttattaatcctaattaatctgccattagcaaatgtttactgtagcaccatattatcaaatcatggcgcaattaggcttaaaagatttgtctcgcaatttacacgtaatctttgtaattagtttttttctatatttaatactccatgcatgtgtccaaacactactaagtgatctttgccgagtggggaaaaaccacaattgtcccggtttggataggaactagtactaaagatcatttttcgtcccggtttaaaactttgatga

SEQ ID NO: 18151 - DNA, 3515 bp, Oryza sativa
ccgggactaaaaatcatctttagtcccggtttattcaatgtgacaggaaactaaacaggctgacagagtgaaaaatttttgtttgaaaactaaacaggatttttgccaagtaccatctcgtcattctatagctagtcaattagccgattcatatgacatttcaattgactagctatataaggacgagataagtttctatttgacaaatttattacgtataatcctgactgtttttaaacaaccattagaaataacctatactaatctctaacggttctgaatcgaagactttagagagatcacatggcatctctaatggttattgaccttcatggagaggccaacagtatgatatcacataatcacaaaccttaagcaatacaaatgtatggcaatttgacatcatgcatggatgataaccactcgcagatctaaatcaaaatcatcgcgcgattgaactagaacaattaatatcacactttcaaacataggaagatgaactgtagggcgtatatataattatatatagtaatgtcatatattcatgtatcaaaatataagcttgcacaataacttgacaccaattatatatggatcttaacaaaaaccatgttgcagctatgatcaagcagaacaaccaaactgatgataaataaatgaatagaagttacactactacgaacatagtttttgatggtgacaaaatctggttgtgcaggcggccgagccaccagcctctaacaaattaactaccagttccacaaccgtctatgaaaaatagattttcagaagcgagtactctaaggagaccgcttgtgaattgattttcaaatgcgatagtctaaagagatatgtccatgcaaatgtcttttggtgcaaaagaaaatggaaacttaaatctaatcatagcccgcagaatcccaaattcacaaattcgccaaatccatcacggtgcccctctgcatgcaatagcagctgcagccatgcgacgatgtcctcaccatagtcattgtcgctgtcgttgagtcaaatgcctcgtcgtggttgtcatcaccgagccaccatcgtcgccgagggggttgacgaagaagggtaaggaggcaaagcgagcagatttgccactcccaagaccatgggcgcgctcagtggtcgagtcgctaggagggagggagaggagcagtttggcggtggttgacagtggtggcgacatggatggaatagagcgaaggaggagagaattgggagagaggtaggagactgcgcgactcatggatgggccagcgcattttattaccgctcctcaatttgcataggccttctcgctaggaggctctcacctgtgaaaataaagatattttcaaaaaaataaagatattttcgggcggtcctcttaaatgctcaatagtaaaaatcatttttaaaggtgagtttagaccacaagaccttctcagtattattaccagcgtaattttaatggtagagataaaacccatttgtctgggaaaatcatctttcatattattaactattaaattttgacaagctataggtatatgtcactaaataaatgaaaatcatgttaggactctgtgctgaacacacaaactgataataaataaatagtactccattcgtttataaatttcatacataagtcattttgactttccccaaagtcaatttctttagctttgatcaagtttatagaaaaatatagtaacattttgaatataaaacaaaagaaattatcaaaatatattaaatgttagatttaataaaattaatttgatgctatatgcgttgctatattttttctataaaatttgtagattgatttaaaatagacagaacaatttataatatatatggaacagagggaatggaagtaacatggaggaggcgagatcgctgtgacggttcaaggtagcaattgggcatgtggttggagatggcccacaggcatatggcatggccaattttcacatacatatatatatatatatatatgcatccaaaattcccccatctaggccggtagctagagttgctaccaaccttcctctaggaaaaagtgaactttaaccccctcaactatggtccaaatatgattcatgccctctaaacgtgaaaccgggtatatcgactcctccaactatcaaaaccggtgcaaactatgtccctcggtggttttggctgacgtggaacctacatgacggtgttgatcgggttttcatcctatgttgcgttgacatcgcaaccacgagccctcttcacctcgcatggctcagcggggtggtgtggagctagctcgacggttcggagaagctcatggtggtcctcctgtgcacttcatctaggagacgggtagaggcggcggccagagaaaggtgaggagagagggttggcctagaggcaatgggcgggcgtcgtagagaggaggggcagagggagaggtggtgggggagaggagaacggctacctccatggctgagagctccgcctagccatccgaggcagtcgcggtggtggaagagagaggggagaggcggttccgccgagctcgtgggtgcgatggcgcgaggcaaagatagaaaggagggaggatgacatgtgggcccatatatatattttgtatgaatgactgttaacaacggaattttgcatcaaactcagagaggaaggaacaaaatcgaagcagatttggtgcaagatcgaattagatttagaatcggactacgcatcggctggtattgtatcggctggaaatagagtacagacttggcttagccgatatggcgaatgactgatacgatatgacttgggctcggttttggcctagtttggaataaccgccatcgccaattatagatagagctcaattaaggcaattgtatatattaattagggtatttatgtcagtttttgttagagatatggtaagagaccgtcatgcggtcttgtttgtattttatctttaggaaagtttgagtcatgtctataatggactaagcccttgtttagttcccaactttttcttcaaacttccaactttttcatcacatcaaaactttcctacacacataaacttccgacttttttcttcaaactttcaattttagtcaaactttcaatttgagagtggaactaaacacaccctaagcttgtattcggggtataaatatagaccccagatcattgtaatagaagacaacaaatccaatacaactttggtgcatcgccacccatttgttcttcttttcggcgacttctctcaacaagaggtaagtctcgatggcttgtgctatcggagctattatgtcgctttagatgttttatcatgacccatctgctatcatatgtcttagttaatctagtcttagtatctcgctttagccctatcagctagttctcactttagggttctcgccgatatcggctaaattgtcttactatattagattagctaaggcatccaccatcctgaaaagcgtttaattacttgattgtttagactt

SEQ ID NO: 18152 - DNA, 7236 bp, Oryza sativa
atttatttgtttatataagcttgtactagagtattagctagtagattatctttatttacctatcttgctctaaatattgttccattggctatttctatagtatcctctaaaatacgtttgataaaccaaacaaatgatattactgccgatgaggcatatttagggtttgtgcttaatttatatttcaatccattgccgatctggttcaactacatcggctgggatcactaacgatatatcatcggcctatcggccgattggctatcggctgactcactctatttattgttttccttgctggtttcaagatcaaaccagccggcacgcccttaacacactcgaggctagccttggacctgcactgggattaagtagatctcccaggccaccgtgttttccgtcaacaatgacatatgggtcccacatattttttaaattctaatgccacagaagagccacatcaatgccaggtaggatgaagacaaggtcaacacctccacgtcagtcaaaaccgctcgcaaaaccaccatgggacatagtttgcacctgtacttatagttggagtagtcgatatacccagtttcgcgtttggagggcatgagtcatactcggaacattgttgagggagttaaagtccctttctctatatatatgcatagtcaacaacaacgaggctcgagagagactactttattcacgctggttggacaggtacttatggttcaaaattcctatgcggcacaaactcgcgacgtaatgaagtcgcgtgtgtgctctgccccctctttttttcccacatgttttttctcagggttcgatgagcctccaagcacaagggcacaagactttttttttcaatttcaatttcaccgtgacactgatagatatcgaaaatttcacattttgttcctttctgaaaacttatttcaaaataagtctagccgaaaactatcataaaaaatggaccccaacctcagcgctagggccgatggcactgagctctagcacgctgcttagcgctgaggtagtgacgaccgtcacaggctgtcgagcaggagattgggcatacaagctgacgtggcaaaggtcaccacccgcatctgtgctgacctccccaacctcaatgccaagcctgtgggcgctgaggtagtgaaaaacccctctacccatgcccatacacttctccctcatttcgcacaatcaaactagggtttctaagggctcttggcagtttcgaaggtgagttcactccattccattccatcttctcatttgttgtgttcgatttgttcctcctccattaaccttgttggatgtgttgctatggccctttgtattctgttgccttaggggagttctccaaattcaaaccttgatcaattttggatgagacgatgatgttgttctatcagcgttaccttcttgggggcattgccttcgagttttttccttcctgttttgctagctcaggacacttgggtgtgggagagcaacgatgacacccttgtgatagagtcagcgttttcgtgctttggtgtagcaggttcatcttctcagggattgtatggttggtttgtttgttttgatagtgtcagagtttttaatagtttttcttgtaaatttaactaattatcttaattgcaggagctacgttccttcggaaaaaaatatgggtacgatttaatgtatgtttgcttctatctcgaagaatagataaggatgcatatgtaggattgtaggtatatgaattgaatataatgtagatgcatgcatggagcgatggatggcaagtgaacaagccaaattggccgacaacctggcatggaaagcgatgaagttgctctcttctcgccaatcgatcgatgagatttagcgctacagtattatattcttaccatgttgtctcacaattggttaggcggctccattatatttgtctagttgttgcatgtatgagtatatcaccggattagtaatgcacaaaagtttttgaaaagagagattgagggtttttgttttatagattcaacagagtacttcaatgcataatataataattatcttactaataatatagtaaaatttaaaaacatgctttttagaatatgtcaaacagatacaaagtagccaactagccatctgtcttacttttaaatttgtcattttaattaaaacagacgtaaaacattttttctctttacttaatttagtatttggcaccacgatgcagtatttatgcctgaattatatatttggatcacgataaaactaaaatgtcacggccaaacccatctccctgatggcagtgccatcgcagcgagcggacgccctttggcgctggtcgtgccaagatcacctccaccgcttcggtcgaatcggattccgctatccaaactcggccgttctctgccatagtcaatcttgttccctgccgctgtggtcggctgactgctcttcggtcgcgagggaccggatcttgtttgacgtgccgatggtcgttcccaatctcgagggccggctgatggcacacactcactaccatcttcgaacgcggagaacgccatgctacgcaccttcctcgccagctgctctaggcctctgctccttaggctgctcccactacccctgcctccggcgcctaccgttgtggttgtaggggtagtgccgaaactcagcaagaggattatggccaagctcgcgaccgctagcccgagtcacacggtctcgcacacgcaacacaatctgatgcacaagctcaggctggtgccaaagaagggtctattaacgctagaatttggtaaaattctttagtggattcggttaaggaaaaagtaaaatcagtcgatggaaagcttatccagaatagacaagttcaaaaaagaatcatgaagaccatgacatggtagcttcatttctaccatataatttaccaactgcagtcctacaaacctcattcatcaaatccgatgatccaaattcatcgcatccaacacctcaaatcatcccacgtttcccctcagctgctcaccccctctcactccgcccacccgaaaatcactcacaaaatccccatcctcaccccaatcatccccgatgccgccaacacatcgcgccactgtcgccctgccatctcctatcccggttctctctcccgaacaccccaaaccctagaactgtcattatcaccgatccatcaaagcgccatcctccgccatcaccgctgcgccatctcctgaatccccatctgccgtaccatctcctgaatccccatctgccccctcaatccgtcatcgtcgccatcgaatccccatctctctccgatcctccctcatcgccgacactgatgatggggacactaatgtgttgttatgtggtagtgcatcatatcgagaatttgtgtaaataggatagaacattggaaatctagtggattctttattttttttaatttaatatcaaagcgagagtccaaactatatacaacttggtacttattatttctgaaatttataattattaaattaagaaaaaggctaaattgggagtccaacaagagaacaaataggcagtgattaattccagttttgagaaatttaaatcatggaaaatatataaattatactctaaaccaagtatattgcgaatttcagaattattaaccatgaaaagactaaaatttcgactccaaattgaggacgactcaatacttgtttcttccgaattatgaaattattaaatcatagaccagctataattagcattccaaaccaggaaaaagtcaatttcttcaattaatggcaaattttataactataaattcaggaaaaatttataactgagacttcaagccgaatgcaactcaatactaattttggaatcattgaatcataaaagctaagtataattgaggctccaaaccgaatacacaacttttcaattgtgaatttcagatttatttgatcatggaaaaagtagggttaattaacactagctataaattcaatgcatacaactcaatatttatcaattatgaatttaaaagttgttagatcatgcaaaagctaaattgaggctgcaaattaattaaactaagtacaagtttgtatacttataattccaatttttttgaggagaacgacggcaggagatctgccggaatttaaattagggaagggcgaaacctagcaaagagtttacaggaactataacaaagaggaaatacaacttaagaagaaaggaggatcaggggggcttgaaagcaagcctgcgcaagtccatatcttgtttaataaggtgtgctacttcacctactgtgaggcaagaattttgaaaaattcttctgtttctttctagccatatattccaccaagtagttagtaatgagcctctgatcgcttgcacttgatctttgcttcccacagggttggctctagttcaccaagtttcaacatgagggggggtggggcgtagccaaagggcccagattttgaaattggcagattaaactccaagtttgtctagtaaaaatacactcattgagcaggtggtttgtgtcttcaaaagaacaagtgcaaaggcggcaaatccaagtgcacggccaatgtcttcgaagtatattttgtgcagtgagggttttttgatgaaggacaagccatccaaagaatctcattttgggctccgctggagccttccaaagtgaaagaaagtcaagttttgcaaaagaaccttcaaattggtagagatacgcactcttggctgtgtaggaaccgtaatcagtccagttccaggtaatgtcatccggttcttgggatagcgaggccaattgaattaagcctcctagctgtacgagctcatgaatttcctccacggaagtaaattgtctaaaagaggctagccatttgttgtctgtaagttcaagttgcacagatctttgttttctcttcgccaagctaaaacatcttggtgcaatgtcttttgggaagcgattttgtagccaactatcatgccagaatcttgttttggcgccatttacaacctaaatagttgttgcagcttggaagagtctattgccggattcgtcacagggcaggttcatgcccacccaaggcttttcttcctctttccaattaagccataaccaacgaagatgtaatgccctagaaaagtgttctaattccaagagaccagcccctcccagaaccttcggtttgcagacagtttgccagttaatcaggctatctcccgagttagagtggtctagatcttcgcctttccacaaaaaagatcttctaaaataaaataaaattaaagtaaatactaaatcgaggaggctttgttttggtgtactataagtactagataagttatgcatttttagatgaaacgtgatcgagtatggatgtacagtagagtatggagtgtccatgctgtacggctggtttcacaaatacgtactgtacaaattacagatgaacgcctagctagctagctctagctataataattgtggacacgcccactccatatacatgtgcatctcttgtcctgtatatatgtcctttttaatgtgtgtgtataattaattaagcagtgaagtgaatcgatctgattaataattaattcatggatggatccatcggggatatactgaattgttcaagacaagatcgataaattaattgagcggcggcggctgggactatatatagagagatagagagaggggccgggggggggggggcaaagaagaggaatttaattataagaggaagagggagaagaagagcttaggtacaggctccagtacaagagatcgatcgagagacagaggatcggagaggaggaagaaggagaatccaagtactgggaggcaattaatttgagttgagatcgacttgagagctagcagaggctcatctcatctaggccagcagaggctcttcgctcgcttatttcatccatggcttccaaaggtatgtactactagctagtatcttaatttctatctatatctatatctatatatgctgaatttactgaattcgattgatcgtacgtttgtggaccgatttatcgatcggttaataatatactataagcagctagctggagtagcttaatcactactttgaggaaagaagtaattaatttgctcaatcgttcaattctttcttcgttaagcaagcatgtagaatatctaacctactctctctatatatatatatatatgcaaaattaagctgacgggcagggtgattttgaggccagctctctgctgcatgcatatatactccatataacttaatatgtactaaatatttttctggtatataatagtacttgtggatttactagctagcaagtactcaaactaatgtacttagcgagtgtttactgtgctgcctgcagtaatactcctaattaatagagagagctagaaagcagagagtgataggcggaggtccctcaggcgcagggtgagggaaagaaataaagtgcaggattatcgatggatgtgccttatccaatataatcgcccaatacatccgatatgatcctcatgtattggttggccagattattgtatcagtcgatcgatcgattccccatggccatgcataatcgattgtccagattcatttctataatttaaataaatctttttgaaacagatcggagtagatattcgtgcctcgctctactacaacatgctgtcctgtcccgtagtacatcgatcgatcaatacttgctagtgatctatcgatatcaatagctaggcagccgacgacgacgtttctgtgtgttgtcccttttactaactaattagcttcttaattaataatttattaatttgcacccactcctcatcgttccatctccatcgatatcatcattaattaacggtgaaaattaatttttcagacaagctagtacagaaactgatgtgatctgatctgatggataaatataagtagagaaacgatcgatcaagacctgcatctgctgcaggcaggggcgagcatctgaatcgatcaaagcaatttgcatatctactacctccgtcccatattacttatctttttgactttttgtttgtcaatgtttgatcattcgtcttattcaaaaaatttaaaattattatttattttgtttgtcatttgctttattatcaaaagtactttacatactacttttttttatatttgcactaatctttcaaataaaatgaatggccaa

SEQ ID NO: 18153 - DNA, 5324 bp, Oryza sativa
tgctcttagagcaagtttaatagtatagctcactataggctccacttcatctatagccaatccatacaatagttgcttactatactatcaatatatggtctcatctattatacacacattgcgtcttggagtccgtgctgcagctggctacagatctgtagcccactgctcttctctcttatcttttatctcattaaaatatgtttgcagctggttaatagtctttctattgtacctgctattacttcttattaaggttccaactaattaaattgtagtactcctactgtagtggagtaccatattactatatcttaacataccgtgcctaggagataagtgaacaataatgatcgatccccatgtgctcaaaatcaaaatcatgacctaacttcgcgtgaggttttgataaactaattaatattaaccagacctaagcagtgtccactgtatatgtatatgtagatgctggtagattttctctcccatctctacttttttttacttggcttaaataggataatctagtacttattaagcaatacaattcaaatctatttaattatagactcctattctttgggtattttatacttgataatttgctaaagtagctttacggattcatctatttaaacacgatacatgatgtgcgaatttatcatagaattcaaatatattccaactacttttttcaaattaaatttctaaggtatgcagtgtaatagaatcagattcattggataggaagcaatgaatgactcataatcatttgaaagtaaggaaaaaaagagagacgagtccattttacatgtcaactttcgtcaaaataaaaattcatccctaaacttcaaaattggatactatttatcccttagtttttaataccgttttcttttgaaaagtatgtacatcattttttttatattttttctcaatcatttactaacttttataattaatatatattttaacctatttgaatcggtcaaaagatgaaaagtaaatggttgagggatgaataatgtctggttttgaagtttatgaataaatgttagacttgatgaaaattggagatgtaaagggatttttctattaaaagaatatgcgattttgacatgtacaaatggataagctcaggccggcacgtccattgcggtttcaccagagccaatccatcttgcaagattccaatgaaatagaggcatacatggaatatattctggagactgtgaagatttgaagatgttacagataagatgatttgaactatataattccagctacgtaaaaaagctaagacaatgattatatatgagatggtagcatatgtgaaatggtttagtgaatacttaaaactttatttaggtgtttggttagggagagagagagtggcgataattataagggacaattgtttatttgactttgttttgaagcctaactaccaatttgaatctattttttctagtttgcttatttgcctgcttttcgaaaatgaacactccgtctgacctgtttctacaacaccgttaagagttcattttaaaaaagaggaaaaataaaaatcacatttcataatgactaaaataccctccaactctatcctcatctaacccttttctctcccggtctctctctctctatcatatcccttctctctccggcgagggagctgtggcggggaaggtaagcggcagagccggctggtggagggagggaccaccggcggcagcggcgggccatggagggaggggatccacgccggcgccaacttgcggagggagggcggctatgccggcgtggatcagcggcagcgccggctgatggagaggggagcaccggcggcggcggggggccgtggagggatgggatccacttcggtgtcaactcgcggtgggagggcggctgcgccgagcacggatccacgggtgtgccgctggtggagggagggagcaccggcggcggcggccggcggtggaggaaggggatccgcgccgccgtcaacttgtagagggagggcggctgcgccgagcgcagatctgcggcggcgccggcggagtttcaacccataggaagtccacccctgctgcttccagcccgccggcgagggggagctcgttgtccaggccaagcagagcaggccgatggcgtggccaacgcgggcgcaggcgctcgaatggagggaggaggtggcagcggcaacgccggattcgccgaccgcagctcgagatccaccgcccggacttgccgccgccactcctcgtcgtcgtcgtcaccagggccggcgcggctcgccgtctcgactttcgccgcctctccctgtggtggatccgtggaggagaggagaagaacttgcagccgccactcctcgtcgtcgtggtcgtcaccagggccggcgccggctcgacgtctcgccttttgctacctctccctatggtggatcctggagggagagaggaagagagaagagaggattggagaagatagaacgggcgggtgggtcccacatgtaatagggtcaaatgagttagggcagaaaagacattttgtgcttcagttaacaccgttagacgcccttatcggaatagggtcagacagtgtcttcaattttgaaaaggaggatcaaataagcaaaccctaaaaagtagggtcaaattggtagttagagttcaaaacaggttcaaataagcaattgcccctacttataatgtcaactagttgatacctcgcgctttgctgcgggatatatggatgattgcatgttatacattatagaaatgatagatgtatatgtctaaataatgtaaaaatggtgtggaggtaatgattcgacattgcttgcgtattgagttctaaaaatacaataaaattaattataaatgatatgtcatgtttgatgatatttaaaatactctagataataattaccagtgggtgataatgtggcacgcttgcatgtgatttaaaatactctagataataattgctagttggtgatgatgtggcacacttgcatgttgagttttaggaattagtgggcatcaactacatagaaagtatagttatagatgcgggcacacccaaggcaatttgaaagggggttatggtagctgttatgaagaggggaatgtatcattgcaggagaagattctagtgcactgattttttttttactaatgtcttattgtagactcatagttacagagcatatgataaaatcgtcattctataataatgctcggtgctaacttatctctatcaaactattattgaatgatttcagtactccttatgtattcattattcccatgcttgatagtagattgaatttcatagtgaagcattagtaaaagttgcacaagttttttttaaaggaaaaacaaaatgatatactgttgcaggcacagaaggaggccatggtggcgtggagagaaaggagcagcagcagcagaggggttaccagctgccccgtgactcccggggatcactcgaggtgttcaacccctcatccgcttcctccttccgcactgctgctgccgcccccaagtccgcctcccccttccttgctattcccgacagggaagaggataatgtggtggcacagcagcgggcagcagagtggggcctcgtcctccagaccgaccaccacacaggcctcccccagggcgtctccgcacgaccctcctctggctctgcacgcaccagctctgaggacaacccacagcaacagcagagcgccgccgccatcccacgggtgtcggaggagctacgggcggcactatcagcgttccaacagacgtttgtggtgtctgatgccacccaccccaaccaccccatcatgtacgccagcgctggcttcttcaacatgaccggctatacctccaaggaggttgtcggcaggaactggttcgatcctcacacacacacacacataaacacatcaatccaattattcaattaataatcaattgtgtgtgcagccgcttccttcaaggctctggcaccgacccccatgagattgacaagatcaggcaatccctcgcaaatggctccaactattgtggccgcatcctcaactacaagaaggacggcacgccattctggaacctcttaaccattgcccctatcaaggatgaggacggcaggctcctcaagttcatcgggtcagctattttcccatcacgttaattacatacatcacataaacagattattacatttcagcaccatatttttatttggctgtttgcattgttattccaggatgcaagtggaagttagtaaatacactgaagggaaaaaggatactgttgttcgtccaaatggactttcagaatcactcatcaaatacgatggtactactaaatgtttatcttctgctacaaaagggttttatccataaggtcttggaaatttacaacttttggtttcaaactaaaaaagagaaaaaaatcaacaattaatatttacagctcgacagaaggatcacgcccgtagctcagtgtctgagctcttgttggctctcaaaaatccacgctcattgtcagaatcaagcaataacaccttaaaaagaaaatcacaagaatccctaagcatgtcaatgaccgaagttcctagtaagagaagctctgaaagtggatctcgccgaaattctcgtagcggaacaaggagctcgcttcagaagatcaatgaagtacctgatcaagggaatagaactagaaaatctggtctgcgtgcatttatggggtatgcatacaagtcaaattatataacatgttgtttgcatttatcttgtttgtcttacttaatttgtacatgcagttttcttggtatgggccatggaagtgtagagaagaacatgctgaaacctagagatgaagatccactgatcgatagtgatgatgaaagacctgagagctttgaagatgagtttaggaggaaagaaatgaggaggggtatagacttggctactacacttgaacgtattgagaagaattttgtcatcacagatccaaggttgcctgataatcccattgtaagatccatatggaatctcttttacctcttacaccgcacctgttctttttattaatatggatattaaattttcatgattgtatgttttggttcatatttcagatatttgcatccgatagctttctgcaattgacagaatacaaccgtgaagaaatattagggagaaactgcaggtaatgatgatcccatcttgcccttttgctgcacaatttactggaaggtttttaaattttatagaaaatttcaggcttttgtaaaatttttgcactttaacggtataagtt

SEQ ID NO: 18154 - DNA, 1276 bp, Oryza sativa
gtttcttcaaggccctgaactgatcgtgcaacagttaggaagataagagatgccatagataacgaggcagaggtcacagttcagctcataaattatacaaaaagtggtaggctactcgtcacttgtctgcatgtttttgttctcaacttataaatataatagctagttgataccccgcgctttgttgcgggatatgtatatgaatacatgctatatattatagaaaatggtagacgtatatatttaaataaggtgaaaatgatgtggagataatgatttgacattgcttgcatattgagttctaaaaatataacaaaattgtaaatgatatggcatgtttgcatgatatttaaaatactctagataataattgctattgggtgatgatgcggtacacttgtatgtggtttaaaatactctagatgataattacttgtgagtgataatgtggcacacttgcatgttgtattttaagagttagtggacatcaattttataataagataggatatgtcttttcacagtaaagttaccttcccttcattacttcattacttggacaggtaaaaagttttggaacctctttcacttgcaaccaatgcgtgatcaaaaggtactatagtgacagacatgggaaaagtttctgctgagttattcaacatatttgtctacaattcttttgtatgtaatttgacatgagtccaatttgcctgtggatcagggtgatgttcagtactttattggggttcaattggatggaactgagcatgttcaggatgatgctgcaaaagagggagtcgtgctggtttgtatcttgaaaaatcatatttgtgcaactgacaaaagcaacacaaatagatatgggcagtcccattgtcatgttatgttttgtagtctgatgcttctggagttttattaagaacgaaggctatgttcatttgcaagagttggaaacacagctgttgcgcacgggaaacggagcgatccattagcacattattaattaagtattagccaatttcttttcaaaaatggatcaatatgatttttttaaagcaacattcgtatagaaactttttgcaaaaaacgcactgtttaacaatttgaataacgtgggcatggaatacaagagagatgggttgggaacatagagaaaaaaactcagcctaactggaattgcaaaaatgctctatacccgaagtcaaaactagtgctacagaacctgtgatacatctcacatattataaaatctaatctacgtgactagcattctctt

SEQ ID NO: 18155 - DNA, 2506 bp, Oryza sativa
ccgcagataatatcgatgaggctgcaaaggaactcccggatgctaatttggtcagattaaagcatcactctttgattcatcatatatgtgcttgcagttctaacagtaacccatgctcacattcagagaccggaagatctatgggctaaccactcaaaagtagtcctgccaaatccacatatgaaggatactgcatcatggagagccatccaaaaggtatgatttgactatagttcactgaattcgctacgcaaacatcactttaaggttattgcatatagcgggctcatcttttcgcttatgcttatcagccaaaatttgaattttcaaccttaaattcgaagccgattttgaggttttttcatcgaagtttatttttcagcttttgcttttagatcactaagaacacgtatataaaagcttcatttacaaattacttttcatttgcaaatatgtcgtttggcttattccgtagataagccaaacaatggggttgtaagtgtcattatctggacaaacttggaagagttatatatcattatctagacaaacatgggagagtgatttacatgtcaacctctatgttttaaaagtgtcattttaatctcatcactattctgttgtagaatacaacagcctttatagaacactagttatttgcctactatattatatgccatcacagccaggagatttatactgatgtataatacaatagcctttacagaatattaataactaatatctcttgtaggttctcgagagtggtgaaagtattggtttaaaacattttaggccagtaaaaccattaggatctggtgacactggaaggtaatcatttcatggtttggttaaattggataaacattgaattgttgccttttattgctaatacatttgactcattttacaattgttgtttcaacaatgtgtattatgattggaattgaagtgtacacttggtagagttgttgaatacaggagaatactttgccatgaaagctatggataaaagcatcatgcttaaccgcaataaggtttgatgcttgtttcaccttttaaaatgtatacattttttgtgaataaaagacattgtttatacttctagttatgtctattgcattatatctctgagtacattataatgtctctaggttcacagagctactgctgaacgccaaatccttgatctattagatcacccattccttccaacattatatgcatcatttcaggtttgctctatcaataatctagctaagatgtcctatttatgtataatcatttccatttcactctataatgtggaagctatccctattatctagtcttaataccccaacatagctatagaaatctttttgcagtacatcagttttatgtggtattttcttatgaattttccttttcaatatatggcagacaaaaacgcatatatgcctcattactgactactgcccgggtggtgagctctttgtgcttctagataatcaacctctgaaggttctacatgaagatgcagtcaggtcatcatttaaactattgttttcgcttagttctgatgggatgatgtgtgtggctttgttttgaacacacgttggcagcatatgtgctaatcattgtggcaaagacatgctactttgatctgttgtgattttgtttgattcaattattgtatgagaagacaataagcatttgtataatactatttcattgttcacaggttctatgctgccgaagtggttgttgcactagaatacctacattgccaaggtacatatacatcattgttgataacttgcatgcattaaaaattctcttatttcaatgatcatcaatatatctagggatgcctatcaactttacataaaaagaacatggccttaatactcataatttatccactttgactgcatgccatacataaatattgaaccataacagcacttcttcaatacagttgaatcctcacaagaaatccatgcatttacttggtgggtaatagatgtcttgtctctttttgacaattcatgatatttagttggaaaatagttactccctccatttcaaattactagtcgtgtagatttgtcctaaatcaaatatgtttatctttggctatttttttagaaatctatgtagtttaacatgtgaattactccctctgtccctaaatatttaacgccgttgacttttttaagcatgtttaactgtttgtcttattcaaaaaaatttaaataattattaattcttttcctatcatttgattcattgttaactacttttatgtatacatatagttttacatatttcacaaaaaaatttgaataaaacgaatggtcaaacatgtttaaaaaagtcaacggtgtcaaatatttagggacggagggagtatatagtatgaaagtatttgtcatggtggatctaaaaaatatcaatcttattatgtcaaatattaaaatgtttgacttaggacaaacctaaaatgacgagtaatttaaaacag

SEQ ID NO: 18156 - DNA, 7698 bp, Oryza sativa
ttccaccaacaatatagttatcttgttagacagtccttgtagtctattcaattactgtgaataaataaagtattgaaaattaaaaggtgaaaatagtttagaacaccattatcatatcatgcatggttacattactgtatcagacatggttatggttacgaggtggtggtaatgaatctatttgttgattcagggattcttctatatgaaatgttgtatggttatacaccttttagaggaaaaacgaggcaacggacatttgctaatatcttgcacaaggatatcagatttcctgctagtatatcggtaagtaaatcaagcgtcatttttttttaagttggagaagttaaatcagtttgagttttcaggtcagcctagcggcgaggcagctaatgtataggttgctacatagggatcctgccaacaggctagggtcctacgagggagccaatgagataaaaggacatccctttttccgtggtataaattggcctcttatacgcgccacggtaacgtaactagctatatcctgctgctatacatgagtgtttaatttggatgatgagatcctaatgtagaatgtgtgtgtgtgaatgaaatcaataatgcattgtaggcgcctccaaagttggagatcccactattttccaaggatgacatggagaagaagggactagtaacaaataaccgcacggatatgttctgaagaccctgatgatgatcttcaataaaagagagggacatatattgttgcttgctttgcgtgcgtaggccaagattaagattatgtcatgtaaatatgtaatgtatcgtacagaccttgttgtgtttgaacctagtatgcgatccatcatcttaataagatgcaatgcagcgcaatgtgtgccagtgaacagtaatgagcttgacttgagtttatagtagtctagtatagtgagtagaggaaaaaaagagtaaattgtattgacggtacgtaaacttgtcaagtgggtgcaatttagtatacgaacttgtaaaacactcatttggatgtatgaatttgtttgatgtgtgtgaaccaagaccaaaagaacacgacatggccaagtttagcaagttagacgttggttaggacatgatgtgcacaggcataagactgatacaggggcgggcccactttaattcatgggtattcaaatgaatacccaagattttggaaaaaaaaaaagtacatatatgaagttatattattccatatgtatatatagaaaaaaaaggaaaaatacttatatctattcaaaactcaaaagaagcccaaactgaaccctcccaccacccaacatttcaggcccgttggcccaatagaaaaaaaaggcccaattcctctctaaccctatctcatctcctcacctccctccccttcccatcccagccgccacgcccacgcgtcgccagccgccgcacgcgccatcccggccgcctgcccacgcgcctcgcccgtcctcgctgtcgcgacgtcgccgcccgccggtcgcgctgcccagccggccagcccaccagccgtctgcgcgcgcgcgcgcggtgcgcctcgccgtcgcccggtcgccggccgcccacaggccatagccggctccgcgcctcgcgcctcctcggccctcgccgcttcgccgagtcgccggacgccggctcgccgcctccgcgtctccgcacgaccgcacctcgcgcccggcggccgcctgcacgcctcgcgccctcgccgcctccgtcctcgagacctcgacagcagtctgcaacggtgagtcgccgagtgcccgtaagacatgctatattggtaaacttgacttccgtttttattattggtatttttatctttctccaaacaatcttaagccttattaaacattttattgaataggccttattaaacaatcttaggccttttttatctttagctagaagaaattaattaagacgagattttttccccctctctttgaaatttgaatgaattcaaagagaaaacgctagtagtgaccgccgcaacttactaacgtaggagaggacaaggaacaggatgagtttgcccaggctgagggcacagaggtggtcgatgaagcataacgcgtaccacgttcctgagcaaatgccactagatgatcgatgatcaagaacaacatattaaaaccctaaaaaaagatgccgtcaaaaaggcgtgcaatttgatcacaccatttacatggattattcttctcatcggatgtcatgcattgcaatttgatcacaccatttacacggattattcgagataatataatttcagtacaaattcaaagtcttttttcccggagaatataatttcagtacaaattcaagtactaattaacttattgacaaggcattgtcgacgagcatggcgacgccgttcgccgtggcgcgcagggaggccggcaacgtgtcgtgtaggcggtcgctgcttcgaggcggaagatgtaatggtccttcctccagaaccgcatagccagcccatccgacgggcgggtccacttacacataccactccacttacactttcgtcctcgcttcgtgtaaaagggttaaccctggagtgatatggttcgagggaagaggccttataagttagttccacccttgctaaactagcgcacatagctctcatggtattaaacatgcgcacatagctctcatgggccacataggctttgtcctaattaggccaggatgtcatagaagtagacacggatgacatggccggcggaggtgagtgaggttgccacagtgttggcggcatcggcggtggcggcggcggagcaggagttggagttgaagtcctcttcgttgacctcgagtttgcgtgttgtccttgacctcctccctctccgcgcggtggaggtggtctcggcaacatcagagttgctcttgggaggagctcgatggcaagtgcatgctcaagagcgcctacaagatggccatggcggcgtgctcttgctgctgccacgcgatggtggggatgccgtgctacctctggcgcacgttgcggagcaccagacgcgtgcgccgtgtacactgccatgacgacgacaacgtggaggaaggaggaggaggatgggacagctcattgtcagacttcgcctggagctccagcaaggatgaggaggaggagggctccacctccactgaaggtggggagtacggtggccacggcggcggtagaagggaaaggaggaatcaagaccagatgcggcggtctctgcggctgagactgatgagctttaggtgggtctaactattttttatatacttgtttgactgacatatgggttctgcatgttttgttttaatttgttagtcttcaatttttctcttttaatttttctttttaggtcaaactaccacgtaagcgtcacgtcgatgccacgtgggatgaagacctagttaaaggagccatataggtaccatgctagcaaaaaccagggacaatactgttgagagaccttgtttgcactcgttttcgtaagttgggatgttgtatccgcttatttgcggtctatgaacgaattggtaggcctgaaattgggctttgctctcccatgttacttgcatgaataagtttactttaagtccctcaaaaattgttgccaagtctgtaattcgtccctggacctcaaaaccgaatacaacacatccccaacgtacaaaaccagtgcaagcgagatccctcggcactattgtccccggttttggctgatatggtgcctatatggctcctatgactaagtattcatcctaggtaacattgacatggcagtttgatctttaaaaaaataaaatgagcaaaattgaaaactaacaaattaaaacaaaacatacagggcccatatgctcctttaatttttctttttagatcaaactgacacgtaagcgtcacgtcaatgccacgtgtgataaagacctagttaaaagagacacatgggcgccatatcagctaaaaccagggacaatactgtcaatggaccttatttgcattggttttataagttggggatgcgttgtatccggttatgagcgttctaggaagactcagcgacaaaaattgggatctaaagtgaacttattcgttacttgcataacaaaatgttatgggcttcatcttgtcttgttgttgctagtactttctagagcactcggcgtggagggatggcagcggcagctcgcttgctgccggtggcggcgaagcgactaacgacgacggcgagggcgaggcgcctctccacctctacctcgacgtccccacccgccactgccgtactctacgaccagcacggtccgcctgacaaagtccttagggtggctgagctgccggcggcgaagatcggcgagcgcgatgtgtgcgtgcggatgctggccgcccccatcaacccctccgacctcaaccgcgtggagggcgtctaccctgttcgccctcccctccctgccgctgtcgcaggctacgagggggtcggccaggtccacgccctcggcggcgccgtccattcccggctcctctcccccggcgactggtcatcccttctccgccctccttgggcacctggcagacctacatcgtcaacccagccaccgcctggcacagggttcgctccgatgtgcctccccaatacgtcgccaccgtcaccgtcaacccactcaccgcgctcaggatgctctgcgacttcgttaacctcgcccctggtctcctgtcactgctttcttctcttttctttccctgtaattaagtctcacccctagccctggatacgtttgtttcaggtgacactcttgtccagaatggcgctaccagcattgtcggccagtgcgtcattcagctcgccaaactgcatggtcttcacaccatcaacatcataagggacaggtatgtatgcctacctacactacatcaacgcattctgcatccaagctacccaattgatgatgactacgctagcatctccataatttgttctataggcctggttcacaagaggccaaggacaaacttaaacagcttggagcagatcatgtgtttacggaaagccagctagacatcaagaatatcaaaagcttattggtacttctccctacaggcctgcatttccgtttcttaattcaacctcaaactacctacttgtccaccctttttcataataaatatatgaactaatgtggtaaattgtatttactcactctgatactgttgaaccagtcccctgtattatggaaatgcttccacacatggatgatccttgtagacgcttttacatttctgctaatagaaatggaggggtacccacccttttgatcaaacaaaaagaaacttgaaatgcttgggctcctaattaaacttagtcatgagttttactggaagctattttgctgcttcacagctaaatgttacagtgctgtttcatttaattaatgggagtgcctcgcactaaacaattatctaaaaaattaacagtaaggaacaggacaatctcaactgtttcattatactgctgctattttgtttactgtggtatcagggtgctttgccagaacctgcattagggttgaattgtgttggaggaaatgctgcttctgtcatactgaaatttttaaggtagtgctttaaacatgaacaaaattctgattagaaccgtctttgtcttccacatatatttataaactctctctttaggcaaggtggcacaatggtgacatatggtggaatgtccaagaaacctgttactgtttctacttcatctttcatttttaaggttagtacatcagatctttggtccttaacagtggtcgacagggtttctaatttcatatgcaatttactccagttgtgtactctaaatgtttataccaatctactgcttgaagcttctggcatcgtaatactagactagtctagaattagaatcaggggcgtttgtctcataagcacaagtcataggggcggctttgttagacgactgatcagtgaacacaagaatttgtttctgcatcaaaagtatcacctgtgatatcataaagttttgaaacatcatgtagttccgaaagaagaaaccctgcatggaagtttgaaagaccaatcgtttctttgtgctaccatgtatcatgtcgtttatgtcaattacttagcatggttttcatagacagtatttaacacaatgctattttgttaagtaggatctttccctaagaggattctggctacagaagtggatgagttcagataaggcagaggaatctagaacaatgatagactacctgttggacctggtgcacgaaggcaaacttaaatacgagtacgtaatgctactctcttcttgaattgctgttggattacacagaatgaaacaaatgtaggtcctatcatatatgagggagaaatgaattgttttcgtacaggatggagttgacgcccttcagtgacttccatttggctcttgataaggcactcggcaaacatggaagccaaccaaagcaggttctcaagttctaagataatgcaaggacaacggatgagagagagcttgtattacaaaaacaggagtagaaaaaaggatgtaaacagtgcatgtgtgcgtggctaggggatcggtggcctctttcagtagtagttaccaggctgacttgggaagcggcaatatgttttgcggtgattgcagcggatctctgtccaataatggcggatcacttcacttgagagtagaaagacgtagtatatcacttcacttcaatccccccgcgcaatatgaccttgtgtggttgtaagttctgaagtggtattgattaccgtccgatctggagaaagaaagttttcactagattatcgtcaccgattatttgctctaagttttcaaaaaaaattcttaaaagatttcttctgtattgattagaccacttgttttaaaatatttaagtttatttcttaaaatatataatctatccctatgatcaagtagataatatcaaataatcaaactgtctaaattgcattaatttctgagtaaaataaatagtcaaatatcatatccaaaagtagcactatatattttcattcaaactgaggaagtatgtttggcaggcacaatacaattatataaacctatatatactaatcttcaaaaagaattttcatttaacacgattgaaatagcttgagccttatgaaaaagagaaaaatgtttaacgcggctagtgtaaaatcaaaatgagaaaacaatcacgctcagttgtttttatgttggatttaattctttgactcggcttgggcactcttatatgataactccgttagttttaaaaggtagagataatttactccatgctattgagctttcccagtcaacgatttgccatcgacattgtctctttctacaatatatcgatgacttcgtcgatggttgtataatattttattgggccgagccatttaaacaaaaaatacccttagaggattgatttatctaattagaagttttaaaaaaatatgtgacctccttacacaacatggaagtttctataagtttcatgttatttttggcatctttactttctacaaaaatatttttgtatgatatatctcatagaacagattctctttaaaatgtactcgagcccccttaaaaaaaagagaaaaatgtattaacgctcatgtgaaaccaaaatgaa

SEQ ID NO: 18157 - DNA, 5344 bp, Oryza sativa
  unsure (1)..(5344): unsure at all n locations
ttccatgcgccgcacttgttgaaggaattttctcgtcttgacaaagtctactgctctatttaggtttcaatttgttaaacaaaaagggatctcacgcttgccctacttttgtttgcattgtcaattagagtgcaaaatgttgatctacacacatgccattcctcgtgtgccaagattctagacatctgctatttaatttttttgttaaatctatgtccgaaatttagataatagtattatccttgaggaaggaagtggatagctctacttttcctcatctgttgaagccaggttataaagccatgtgctctcttcagtttcaagaaccattacattacattacatacgaaaaccctcctattaccataaggcgtgatcttgtcttgcactcttgcttgagtaggctgagctaagagcaagtgtgttcgaggccatagaagaggaggatagggtagtggagaatgatgatggtgggaatcccgctttgcttggtagctgcaatgaccgagctaagcagctgcatgcttcaccatcaggtttgccttcttttctacccagaagttcagattgtttcccatgctgcttcaaaaataatttatctcatatgtatgattctctagattccttttttggagatttgttttcataccattctgtgaatttgcagcttgccaaaatgccaccattgtgccaaagtagcatctttattcgcttcatctttctcttctacgcttatgaaagaaccttttttctatcctgctgatgattagttagtctttgcctttcatttctgctgcatagtttcttcttcggttataattgatttacgtcgaacattttctactgctctcaggtaggttattaacagcacttgtaagtgaatacttggagtgggcccagctaagtcacacgatgaaagtttatctgcctgaatgtaatctggtaacagtttgccatatctcataaatcttggatggatatgtccaaaatcaacatctgctaatgctgctattgattgttggctgttgcatttgtaaatcagccaaaggacttctggaagaatgaattaaaggatttttctaacaaaagcggagctgaagggagcaggagtgctgaaagtggccccatgcttctagatgttcttgaaggatatctcaaatatgaggtactcttgctaactcagagtctcaggcagacagtatataaatgtatatggaaatctttctgtttatggaattttgatttgattaaaatccctgtgttgcaacaggattttaattaaagaaaattattattaacccattattaccatcatttcctgcatacttttttcttttaataaaatgtaaggaattggtaatggaggtggttgacatgtggaccctttggtcctacttgacctttttctttttcaaatagtagagagttggtggtgggaggggtnncnnatnnncanntnancancnccnctnctttcttttttaacatttacgtaagatatccactttttctttccttgttcttgagcccctgaattagctatcaccacttctattagtgatactagtaaaatgtccttgtgttgcatagatttcaactagctatactatgtataaaatataaaatacaatagataaataattatcgctaaaacttattcacttgattaaatgagacgaaatgagcacctatgtatacttgtatacagatatacaatacttttctatggaatttctacaaataatacacacaaggctacatattttttaaccacgaaaaatctagagtgaggtgggtgtagaacctatcataaccccaaactctctgtttctcttactcttctaaaagaaaatgcatttttacatatcttagttttaatctttatttgcttatattgcctgattttggttacttgaattgctacattgagcagaatttgtctcaaacaaggatggctggtactggtaggagaataatcaattccgagtcggatccggctctaaatgctgaacataggaacacgaggaggccaccgtcgtcttcttcagttacaggcttgcctcctatgggaaggtaacagcttactactattcagctattcaatttgcagatatttgttgtttcctcaaaacacaggtaacatttccttgcaactcgcaggccaatgccatcgtcacagatgtcaggtaaattataatttttttctcggtttgtttattttatgctagagtgctcctctaaagctagcgctttggacattcagaccgaagaggggggtcttcggcttccaatgcaaggaaggatgaatacaactggagatatgatgctgatgatatctctgaagaagtgttgcgagcatcaagtgctctagaaaacgtccagctagaccggaaagctcgcaatctgacgacttcttggaggttggaactattgcctttcttctttgcaccttccctttttgcctggccatttgtttctgatcatagaatatctgtttccaggcatccaggcgacggtgctgagtaaaatcggaaggtgggatgggtccaattcaccattgcgctgcttggacccccttgggccatttgtatcgttttggttgctgcggtgggattgtgcgcttgcgtagaagaatgctcagtgttgatcatgcctactgtactcctagctcatttgtttatgcaccatatatgggatttgatttctgctggacaatcttgttcttgtgcgtataattttagttgcgtgtagtttctaacaaatttgcttttgcttacatcgggaattcttgttacaacgtgcatacaaacctgccctgcagcagttctctccaaatccagtttcctgctcctcttgtaactcctttgagcagcattcacttattagttgccaacaacaattcccagcggtatcatttgataaaaccaatttgcacataaacaatgtgttaaaccaagattctggagtggttacatttcagttttgtcacagtatcatttggtaatttatgcctaatctagctagtagagtgacagcacactagttcggaggcctagcaattgcctattacacctcactcagttcactgacattattcccctttttgttttgtttgaggagtataccacgttaacatgccaataattgctgccaatgctactggtattgttccaagatgagtagattgatctcgagattatgccttccctctgatcatccacgtactcgcgcgtgctgcatctctaattactcctgcaatgcacatccaagcacttaacatcgtagcaacacatgacacaaacctatactatgtagcactgattgacaattttcttacagaaaatacaaaaggtgaagcgacaattacatttcaggggttaaacaagtgtactaactccaaacaagcacagacaatcgcaagtacgactgcatgtgttcttcagcatatggaattttgagcggacttatatacacaaatctgtatctctttttctttttttcatatcagtaagttaacaaggcagtccttcctagtttgcagttacctcaaccttgatatacagtggcatggaacaattcttggatgaggcattctagggcagctattttcatgttgctgatttttttttcctctgaatagattagtcagcaaggtcctacaaagtgcatgaatttcacgacatagattgtcaactttacagtgaatgaattcattgccaatcaatacctattcagctatcaacattactgcttttcctgaacatattcagctaccaaatgtgaccctaaattaattatattatgcggttgtgccagaattctcttacatgaaccatcatgaaatctcactccaaaacggaaaagcctaggcacacgacaatttcacagcaatcatctaagagtgtcctccaaggaggctgtgggtctgtaacgtaaatatcataatatgctacttgatattttaagcaaccacttgcacatttttggcacaaaaaaacattagtaagttctgaatgaaaattacagcataagcataccttttcttgcagtcactgatctcattaccatttctaaatccatccaagcagtgacagccacctcttaatgcttcaacaacagcatcagaaccaatagcttggtcacatccttctaacttgttttctaatccagcatcattagtggcaaccagagtctccacacttgttgataatgttggctttcttggaggatgaggtttggggtggttgtgctcaccgttgtatacaatttcagcaatccggccatctggtgtcatctccacctttctcttgacagggcatgttgggtgagtgcacttgtagtagctccgtgggaactcgctccctttcacttgcttctgcccatacttcctccagctgtagccatcgtaggacaaactgttcttcgcactgacatttggcttcctgacactctgggacactgtcaaattgtcccaacaggccccctttcctgtatctgctttcttttgatcgtatgctgtatgtgttccactgtcttctagctaaaaagttcagcatgttgttagaaaatgaccatatgatcatgtcaaaggtaggttcaaaataatctaatggacagatgtataattataaaaagcatcatttaaaagaaggtgcaaaattatgtaactgtcagaaagaaaatgaaatttctttccaggaaacagagaagttgaatttcgtgtcgaactgactctggttgcagcaatttctgtcgatgaattactcaatgggtgtgtgaatcgcgttgcctttggacgccttaatataatctcctccagggaagtaacccgaggagaatcaatagcagtggagtcttcctggagcattgagaaggacctcaatctggaagaaggcctggaagccacaggcttcacagcagcaaccttcttgtggctttgcatatcgcactggtgaaatttttagcacagtttatgtaccaaagtgaaatgacaaagaaagaaggtagaataacacaaaatttatgaacacaagtcatggatgtgctcccctctgctgctacctgtacgtggtgaatgaataaaagagaacagagggaaactcatagtgagctagatgtaaaactgaggaattgaccaaaaaaaaaagaagagaagagtgatactggaacaaaatagcatgcatggaaaaaaaaagtgaatttatgcaatctatagctgaattttgaagcctggttgagaccaagcaacaaaacatgcagaacatgctgaagtaataatgctttatttcaagatgtttacttgttttcctcttgtgcatgtacaaagcaaaaattgagaaaggaa

SEQ ID NO: 18158 - DNA, 2161 bp, Oryza sativa
ccgccgccgtgtgccatcgccggtggggtgggcggaggagagggagacaaggggctcgccctccggtttaatttgcgcgttcaggccaggggatatcccttaaccctcttcggaatagtattaatttattaatctctctaaggctatgtttagttcatataattggtgataagtttggagaaaatcggtagtttgtaaaaaaagttgagagtttatatgtgtagaaaagtttaggatgtgatgtggtgtgatggaaagttgggggttgggggaaagtttggtgtgaacaaacagggcctaaatgccgtgggatcgctgtagatccgtgcagtctattttgtcatttcgctgttgatctcaatcatatcttttatttaacaactaactcatttttcggaggacaacgagtgggtttgtgaggtagctccaacatttgtaacacataatgtagcttagcagataatgcaatacgagaatgaaagaacatgtaacgagacaatccttattcgtttgacaaaacaacataatgtagatacttcattatgctatataaggattcctgtattaaggacaaagagagtttttcagactttataaaaactgtgtttgattttgttttttttatcagttatttgatgtacacatgcccttcatcccaatataacttggattattatacgattactttgcgtcaacaccattcacaaaatagtatgtgacaactaataagatgtttggtaatagttggatataattgatcactacgatcatcttaatgcaatatgttgacactattacccgattagatacttaaccaaagtagagtggttactatacattaacacatagtgcatgtttggatcatgccctgacaaatcacgcttgagcaaagcatcattcccgagcgtccaatttcgtacgcctatagctagatgcacatgtctaggcaagaaccctaggtcagagcactatccaaatatgacatgtactcctggacatacataaagaccccctctcttggaaaaaaaaagttaattgcacaatggctaggtatatttacaaaagttttatattggatcactctttagcaaatgtttttactttgagttaggtaatcttacctctagtgtaatttagactcgttatctccatcttttcatctctccctcacctctggcttcctatatttgccaccatcattgtcacccatactttagagttgctcgcttagcccatgccatccacactttgagctcgagctttgtgttgccggtggcctcttgagttatgttcatgtgccgtgtcaatgtttattttgagttgaagtcccccggcgctgtggtgctcatgcttgaaatccatatgtgctggcccctgatcgggcgcaatctctattaatattagcggttaacatagacaatggggaggataagagatatgaatgggagaaaaggactttcaaagcaatgttatgttctaaatcgtggagatagcatagttgatgcctttttctagtcattgagcgaacaagcagttcaaaccatggaacaaaattgagagaggggggctcgatgacttggaaaaagggaagtgagtcagagttagcaataatagcacgcaatggatgattcttgatgtagcatgattttgtactcatagtggacgacgacaccgtggcggtcaggagcaacacatatatgtttttgttgggagcatataagataatgaaaaatagaggtgacgaggtagggaggaagaagataagtggctaacatgtgaatcaacagaccaaagtgtaaatgtggtaacaataggtagcaataaaatgaaaatattggaatgcaacttacttaaaaataaaaaagaaaaagaaagaaaaaaaagaagaggaaggcacaggggagggcacaggaggaggagatccgggtccctccatccctcgtcttcttccttactcgttcctccttcctcatcaccaccatacgcgaacacgacgacaccagccagcaagcagcggaggagagagagagagagagagagactccatagacggccatcgatcgtacgcgactccccccatccatccatccacccgccggcgccccctccctctcatcgatcgatcgattcccaccgccgcccccgttttgaccacctacct

SEQ ID NO: 18159 - DNA, 1688 bp, Oryza sativa
tctttctcttaggaatcctcagcatcgactggatccatgtagattccaaaatgtgaaacttagattgtatatagaatgcactgtgtgtgttgaaaatgggctcattattgtgatgttttcagatatattacatatgccaaagaagaagaggccatcaggtgtattcaagctgtacacaattttgttttggaagggaaagtgttaaggtcaccctctatgctttgtagccttattgcagcagttttttttacataacgcagttagcctaatcgttaatggtttgttgcagagcgtgctttggtactacaaagtattgccatgcatggctgcggaacatggtatactcgttgcttcatcctggcagctttatttaccattactctacctactgccatccttctgagggcttttatcttctcttttttagacctgtggaaatccagattgtctctatttacatgatgtaggaagccaggaagatagtttcactaaagatgagataatctcagcatatacaaggtaagctgagctcgttgaacatatgtgtggaaagttccactgttccttattatggcactgtgccagtcctagccatatgtactttttcccctgccaagcctactgctactgttactatataatgctcttctgttctgagaatttgtagtctatcaacttttccctatactatgcatgaattattatgctttgctaaatgctaagattttcagtagttctgattggtgctttcgactcatcatctctcgttcctacaggagtagggttccccaaatggcgtctaatgtttctcaaagacgcgcagggactgtattacctcctccagcagaagatttctcatatagtgcagtggttgcagctaaacatccaatcaagaatggaataactgtatgttttttatactgaaaaatccattgggacactggacatgttcatttctgtttgatttcatgctgctacattaactggtcttattttgtacagaatactgcaaatcaatccaggctttcgcctccaaacagtagttctgggagatccacacttccaccagctgcttcatggtatgatgctgcttagggtctcatgatatgttttaaaatgtgaatttgttgctaaaatttttttggtatgagcagggggcatcgcgatttgaataccaggacaacagcaactggggtggcatcgtcacaatctcttactaaatcaaaagcagatcctcaaagtaattcattctcgagttcttcgactgtttcaagtacaaaactaccttcttcatggaatgatgacacaagcacagttccgaaaatgacggaaggacgagatagtttgtctaaaaccttgaagccatataagcctggtattgcaaaggaaacccaagctgtaacatcactggagtcatcgcttgacatagacttctctaccataccttcagcttggaacgatgatgatgtcacatcagatggcatgtcaaaaggaagtgacgagaagcaggttgtaaatgacaatggaaagtttgaatgttcagtttcttcaaagccagctgaatcagggcatcttacatcgaagtcaacgacatcaccaaagaaagacatcgcagtaaacagtaccaggcaaagtcctctaaattgtgtatcaagtccatcggtttctaaatcagaagtaaaggatgg

SEQ ID NO: 18160 - DNA, 1348 bp, Oryza sativa
aagggtgagaaggaagttgagttgaagggctgataaggagaggagaaaaggaagatagttaaggatgcatgtatgactgttaggtccggaagtggtaggtagactggcagatgccagatagctgccctccttgctgcagtttaccaaatgcaaataccaatgactcggctcatctaacattactaggtaatgtaccaatttaatctgtggatcacaaaaacataagataagaccatgagctccaacactgattcaaccatatactcaagtaacttgcaagcataagcacagtagcattgttgcattaaccataaacagcagtaataaagagtatttgaactgatgaattctgcaaaatggattactacttacttacacaagacctagtatagtctacatgtccttgttgcaagctcaggggaaaacaatcaccgcaagcacagagacaattaagctctcaagagcagcacagaatgaatcaatagctaggactgttggttgctgttgttgttctatatggatcacagaacataaggctatgagctccaacactgattcaaccatttatactcaaataataggcacaatagcattgtttcattaaccataaccaacagtaaagagtatttggaccccaaaattctgcaaaaagattactacacaagacctgttctatttgtacatgttgttcttgctgtgctcacagaaaaccatatatataatatcagtaagaacacgaagactacaaataagttgtgaaagagcaacagctagctagcacgaatgttggttggtggtggtgttgttttggatgagggtatggatgagctgcagcagctgggtcctcatggccttgacgctgtcggcgttcacctccctcttcacggcctccaaccaatcggaatcggaattggaatggcgggcgcgggtgggccaccagttgcagatggccctggccaccgctagcacgaagacgccgcagtcgtagccgtttgtctgcctgggcgtggggccctcgatgagcgggatcgcggaggcggggagcagcgggcggagcacggcggcgaggcggcgcgcggagggcaggttggtgggtgggaggctgtcgtggtggacgaagcgggggccggagacggcgttggagttgtcgaggacgaggagggtccagtgggagccgccctcggcgtgggagacgtcggggttgtcgttgacggggaggaggacgaggcggcgggaggcgaggcggagggggtcggcgacggcggcgacggaggcggggtcggggaggttggagaggaggtaggggacggaggggggaagcaggagtaggtcgtcgtcgtggtggtcg

SEQ ID NO: 18161 - DNA, 1426 bp, Oryza sativa
tcttattagggattgattgattacaccgtgttactacagattgttattcccacaaacaaacaatctcatgtactactaataatattatctttcatgtctcctgccgctgaattgctcccgaaggatgaccatgagcgacgatggagaccgcacctgcccgctctgtgctgaggacatggacatcactgaccagcagctcaagccctgcaaatgcggctatgaggtttcttcccttccctccccaccactctactctccacaccccccttccattcacctcccttttgcatctcactgcagatttgtgtctggtgctggcaccacatcattgatatggctgagaaagaggacactgagggccgctgccccgcatgccgcactcgctatgacaaagataggattgtcaagatggctgccacttgtgacaggtccctccatctcaaaccgtcttttttcctttcacctcactaactgcactgacatgcgaagatggccgcacaagagcttagggtcttcagttcaacaaaacgaaacatcacccagttgtcgtgaattgtggtttgcaaagcgccataagcaacttcttttacctgtctatcgcatcggaaattttgtacttatgcttcttttaatggaaacaggacggtagtggagaaaaatgtggacaagaaacagaagacccaaaaggtcaagtcaaaggccgcggtaactgtggaagctaagaaacatcttgctagcgtcagggttatccagagaaacctcgtgtacataattggactacctgcaaatttatgcaacgaaagcgtgagtaccatattgtgcacagacagattcttttcaactgagtaatgtgtatattttgtttctcaccttggcaacacaattcattttttatttcagatacttgagcgcagggaatactttggtcagtatggcaaggttctgaaagtttcagtttctcggccgactggggctccttcccagcaggcaccaacaaacaacagtatcagcgtgtatgtttatgtgaatctcatgccacatgtttatgatgtttctctcatggataaacatgacctattatttcaagtgattagatatatcttaccgtatgtacaagtggtgttttcaagttatgctctcctgtactttccaagcctagagcatttaagcataggtgatttattgttgagaaattatatgcttaaatatagatgaaaatgatggctaattcaaatatgatatgtccatgttcttgcaattaatttcagatttatattacctacttaacagtatgatttgactaaggatcatgaatttccatatccatttgtgaatcagtgaatgccacacctagcagcctagtagccaaagcaaaagatgtagatttctagtgttgaataatcagataaatgcaaacgtgactgct

SEQ ID NO: 18162 - DNA, 1613 bp, Oryza sativa
attcctgcagcccaacatcctagaatgaaaaaccatcagcctggagcagttggtgcagtgagaattgataacataggcagttttgacaaggctgtaagtgtaaataaggatgagagcagcataattgctgatattttgtctttggagtttgatccatgggatgagtcgtattcaacggctaacaattttgctaagatgcttagtgcatctgaaaagaacgatgtgctttttgatgcacgttcatggaaaacaaaaaccagcaatagtgagtctagattttcatttgctagacaagataatcaaggaagcctcctagattcatctatgagaaattataaaagtgagcagaatttcagtttgccatcccagaattctcatggaaacatttatcagagtggcattgcatttcaatctcctgaggaaggtttctcaaagagcaactctcttactatgttggatatgctagctaccggtgagtagtatgaagttatattacgctgcttgtttattaaattcttaatgaacagtgagatgcagtactgcagttaatgtttttattttaatatttattttatatatttgaggtaatattaatgtgtcacaaaacaaatagatatattcgctaggatacagaagggatccaatgtttgtgcacccattcccctcttttaattcaatgttggcaatcttgtaacatatgtgattgggttgtggagctattaagtataaaatgcactgtgtttttatgttgaagcattttagtaactgatgttttcaccatggtacttctatgtacttacaaaaaaaatgctttttcaggcacatcaaagcctaaagtatccgcgcctcctggattttcagcaccagcaagagttcctactgggttttcttctggattttcatcccatgaggggttgaatccacctccaggattttcatctcataatgggcctaatccccctcctggattttcttctcagggtgggtctaatcagatctatggttcggcatactcaggttctctctctctctgcttctcctaaaacaatttcagtttctaataagtttgcaatgttttgcagaaactcgcccatttgatgatcttttgggtataaatactagccattatcaaccacagttagctagacaaacaagtgatatagaatttgttgatcctgctatattggctgtgggtaaagggcggatgcctggaataagtgattcagggttggagatgaaaacttcccatacttttccttcgcagttgcaaacatcaaatgatccaaggtttcaattacttatgcagcagaacatgccttcccatcaaaatgttggatttgcagaacatgttcaagatgcattcaaccctatgaatgataattatcttgcatcccgacttatacctcagaaccatggttctctatcctcttacacacagatgtcactccaacaacctagaagctcacatcttacaaatggtcattgggatggctggggtgatttgagacaagggaataatgtttccatgcctgacatgtcaaggatgttatatccaactgaagcaaacaacttccacatgctgggttcaaatgatctgtataacagagcttttg

SEQ ID NO: 18163 - DNA, 4782 bp, Oryza sativa
ccccttgggcttcacgcacatcgtcgccacctccgcaatcttccacaccgactgcaggtcgtaccctgcgtctaacgactgatcaatgatgccgtggatatccccactctccatgtgcgatctagcctgccaatggacaactcttcactcagcatctttgtctgcgccaatcgctcggatatctttgataattcactatcaggaagaaagactaaatgcaaagttcatgtatcatcataaggcctactacttcttacccattcaacaatgttacggcagtggagcccaaagttgtcatttgagattggttcatggcctgagattagctcaagtaaaatgacaccaaaactgtacatatcactcttctctgttagctgctgcgagatatagtacctacgagcacacgcaaaaagggtgagcttggggaacacttggcatcagatgttacaaaggtatatagcaattcaatttgcaaggccattgataacaagaatagacttcataaatttcaggaaagacatggccttactctgggtccagatatccaactgttcctctaactatacttgatacatgagacccgtcgacaacaggttttgacaagccaaagtctgcaacttttgctctcatgttcttgtcaaggagaatgttactgctcttgaggtctctgtggatgatagttggggagcatcctgtgtggagatactctattcctgatattttattttatttttcatggaaatgaaagacttcagaatctttgaaatgcatgttggtagaataatcacaggaaaattgtacacgaggaagggagggagataaaccttttgcagcatcttctgctatctcaagacgcttgacccagctatttatttttacatcatcagggcctcctgtcaaagtatgataaagttcatgtcaatcctgagcctcagtgtcaaagaatcatgcacgagctagacaagtagacaaagccgcagctgagccttgatttatgtgtagtatggaaacttctgaaatcttgacagtttgtattcagttcttagttaagactggaaagaagtaaacatcagaacagaaaagaaaaggcttatacatcagtgaagatcctataagtttttcagaacacgaatccttatccaaaactggaaaaagaaaactcaagcatgaatttgctgtattatctagggaaatatcaggtgaaaagtaccaatctgataaaatcgtggaaaccactgcacaaactatgcatatgactccaaaaaatttctcaaaataattactgtatgaggggaggagataatgagataccatacgaaatcatggagaccctaatattctaaaatataactacgcatggaacatttacttgtagaagaatcattctctacacaacgacaatttggtgttgattctgcaaactagatttatcatcagatggtaggaccataggaacttaccacggaggtgttcttttaacgtcccgttatgcatgaattcatacacaagtatatttttaccatcttgctggctgtaaccaaggaagctcaccaggtttctatgatgaattcttgaaagcaatgttacctgaaacataagtccatcagatactatactaagcaacggatcgcagtaaccacccaaagaaaaagtatgcgcgctgagttttccagtagaccttgagaaaaggatatatgagggatgcctacatagagggtgagggtccataggatgttccaaatagaaaatgttcatatcttatactacttaaaataaattgaggttataagtatatgtaacgcaacatggtcacatcccattagtgtaggtctatcaattaagtaggaaatgaatgtgtcccagaatatactgggcttcagcttcagcttcaaggtttcaatctaccaagcagtggtaaaattagcaataggtacgcaagttctatttatatcttaaactgttaaactgtgaaaaacagcccattttgggccgaacgcaaagcctttttgggccctgggtcaacactcattaaactgtgtgcacaaaggttaaaattcatctgtttttggctaaaggctactcatgagtcattgggtcaaaggctaatatagatgcacttttgggcccaaggttgactcacgaagttttgggctgaaggcaaatagtaacgtgtttttcagctgaaggtattagggtcacgtgcttttgaactgaagactgatactcatgtgtagttgggccaaaggctaatattcatgtgtttttggccccagtgataatacttgtgcccaagactaatactcatgtgcactttggccaaaggctaataatattcatatgtttttggcccaaattaatactcacaattttttttgggttgaagactattaatcatttgttttggggtcaaaggttattatccatacatttttagccccaaggttaataatcatgaattttttgagcagaaggctaacattcatgtgtttatgggtctaaggttgaggttgagttcttttcagcaacttgaaacaacaacttcctcgttttccgtcaacatgcttcccaaactgctaaacgatgcgttttgtgaaatatatagaagttcttaaaaaaatcaaataaatccatttattaaatttataatagttaatactccgtccatcctcaaatgtaagacatatttcttttgtcaccaagaccaaggagaaattactcatctcccatgtaacaaaatcaaggaactatatgcatgcaaccaatgaatattaagatggttgcttgggttcctgtcaacaattaatttagcacatgaagactacaaatataatcatctcttttagaaaaaccaaaaaaaaattgcctaacacttttggatggagggagtacgtaactaattatgtgctaatgatatgccccgtttccgagctgcgaaccgctgcagccaaactgctggttcgaactagccctaagagtaaagaaattatggggcaaaagctaatattcatgtgttttttgaccaaggttaacactcttgaaatttttagacgaagcccaaattcatgcacttatggtcccaaggtcaatactaatgaaattttgtgccgaaggttaatacttgtatgtttttttggtggaagagtaatacacctgtgtatttggagtaaggcaaatattcttgtgttttttcagctcaaggataatattcatgacattttgagcgaaggtaatatttatgtgatttgggctcgaaggtaatactcatgtgtttttgagtgaaggctaacaatcatgcatttttggcccaagctaacattcatttgtttttgggcccaaggttaatactcatgtgtttttggaccaaagacttaatagttgtgtcattgaggtgaaggctaatagtcaaccatttttgggcccaaggttaatttttggccaaacgggaatagtcatccatttttagcctaagtttaatagtcttcatattttaggccgaacgctaacacttactgtgtatgtgatttatatttcaagaaaaaactataaggcaagaaaagaaacatacctcattcaggaattctcggatgccttgataggagtcatttgtgagaagtttgactgcgatttctctcccatctgtaagctttccatagtatactatgccaaaccctcccgaaccaattcttctgtcaaatttgtcagtagcatcttcaatttcagacaatgcaaatctgtgcgccgattccgtggccacttcactgaaaaatgagcctagcttttttgctggtgccgcaataacaacggtttctggagacacaaagtaattactacgcgaccatacaccataccagatatgtccaatgagctaaagaatacgcaccgtccgatgatttcttcttccttttgcatgtgaacaggtaacaaacaatagcagcaacaagaatcaaaatggccccaaccacagcacatacaataattactatagtgcggccagtgttactgtgtcccatgcgaaggtcactgtttcctgagaagctgcatacgggtaacagatcagaacaaacagcacaatcctatgcacaagttaggtactcgatttacatgggaaacaaatatatactttcatcgaaggtaaatgaagcttgctaagccacactggagttcatataggcacaaaagtatgcactgctcatatcaaatgattaagctatgcttaaagaaaaagctacacatacttgaaaataatgctctttttgaaaagcgcttgtgggacctctccagacagcttattgttctgaatatacctgtgaaggcttggatcagtaaggtatttttgtttcaatacaatgaataaagcagtaaaatgagataaaatctatagcaatgatgcatgttgaggtcttgaggatcataagaacaaaataacagcacaaattcatatttactgcacttgcaatacaaatagcatgggggtggaaagaaagtgtactgaagcgtataacttacaactctttcaggttaggtagttctcccaaggaaggtggcaatgcaccggttaattggttgtcctcaagggactgcagtgcagacacaagctccctaagtgctaaattacaagaataatgtttccaggatacactatcaaaataatggaaaactcacatatattgtaaatcatggcatccagtgaaatcaggaatttgaccagtaaatgagttaccatcaagctttctgaatttgaagaaataaatttatcagaaaaaagccaactacaaagagggg

SEQ ID NO: 18164 - DNA, 4091 bp, Oryza sativa
gatccatttttgccaacaactgcagtttgcatgaccctttgaggtggttcttcgttggtactgacgaagatgggttttgtagttgatattctctccgtccccggagcaacatcgacaaggtaatttgctcgcctcactaaatcagactcccatattctatcaaatggatcatcaggatacctgaaaacatcatcaacaacaaattctttaggcagatattgcaacgaaagtatgaacaatggtgctacgcagcagtagtagcgcatacctgactgatgcattgctttcagcaccaaaattgatcctcgcagagagtctaagaaagaactgtttttcatcagtggtgtagtagagggagccgttaaattggcgaagctcgagagtagaaataaagggctgtccagtgctggcattagagaggcaaacgctgagtgttggagcagcagcgaggataatcgcctcctggacgactggggtggtggcatcatcaatgacaacggtggtccatggggtcggtccaagggagagatcaaactttgggtagacattgctgttgtcgaagttgccatagaggaaggtggctctaacaaggtagcgtgttctgttcctgacattcatggtgtagcaatacttcctgttgtctgctggaaaagagcgaacggtggtatattgctgcaattgttgattttggagcaagaggttcgctttctggccagcagagacaaacttggcatcagaagtccactggatcccaatgccatccgtgtaatcatcgtctcccccgcaatccaagctgatgaaacctgcatgcatcaaatcaaagatggaattttcttgtagagatttatatttggagatggatttgatttcccagccctgaagctgaaggaggtccagcgaatggtaaagaagggtggaaattattgagttccaagaaactcgaaaagaaaagaagggagtagggtgagtgagagggagagtgactgaccaggctgagcattggagagcgagaaggcgacgaagaggagcacaagagcggcggaagcagacggcatctccctcagtaatctgaattgatgatggattgattagcacagcagtgggtgcgggctggtgaatcaatccatatgctccctccttggaacaagtcctaaaacaaaaggaaaagagaggattgaaattttgttggtagctggggttggggagagaggggcaatcaccaattctctctctctctctctctcacacacacacacaggcaagaaagagctcaaccagaaacagccaggggagtgaagagaataccaaaccaagcaggagtattccaagaagaagaagaagaggagcaggacaggaggaaggggaaagaagaagacaggagggtcccaatcccagtctcctgctctcactcacagccagcctctgcaccctctgtctctgtgtaataatcttggagaaaagcaagcaagaaagaaagcaagcaagcatgcagcagatgtagaggaaaagcaatggaaaaggtgagagagaggagaggccagcctgagcctgctttgccttttgcctttgctgcgcctgcgccgagctgagtggaccagtacactacctgttgctgttgccctgttgctgctgcatcatccacgtctctgtgactctgtcactcatttgtggtacctgtgcctcctgtatttaactactagagtaataaactcatcattttgtggtactactcgtagtaattagcttaacctccaagctcagactcgactttaaaaggacttctcacttaggagtataataaatccaacactaccatgaagattgaggacctctgtttttccaactactacggcccaagtttagttccaaactttttcttcaaactttcaatttttccatcatatcaaaactttcctacacatataaactttcaactttttttaaacaaattttcaattttaacgtaaaacacacccgtatacaataaactgggctaccaccaaccaaacagcatcttctataactacttgctactactgctgcacaagaacattctaacaaactgcgactttaagttctaaactactacattaaactaccatcagttcagtttgtctgttgttaagcatgttacaatttagcaattgttcaatcatgattcatgaggctctgtttcatattcggtggttctagtactacctctggactatttgtctttctttaggaaataattgtataaatagacaaacctatgaggcatgttcaaaatacttctaacggtatagccaatgatatctttctttacttatttaactaagtaattgaataaacattgttgattcaattttgacagaaatttgagtccaaaatgttatagttattaaccttgggccaaaaatgaatgggttaacttgaccctagactttcatgagtattaaacttggaaaaaaacgcatggatcatatattcaaaattttgtgttcaagaaatttaggcctagaaatacatgaattttagcccataatacatgaggtttacctttcagcctaccatttcactaatattagcattcggctgaaaagaaaatgaacattattactaagtccaaaattttacgataatacatgaattgtagccttcaacccgcacaaacataaccttcggccaaaatttcataagtattaacctttaaagaaatgcacattcacctttgatccaaaatgttgttgagaattaatcttgaattcaaaaatgcatgagtactaaccgtggcattattatacacggatatcagtctttctaggtcttgtgcctaggaacacatgaacattgcccttttgcctagaatttcatgatgactaacctactgaacaaaaggcaataaatttagcctttgacgaaaaacacatgcatattatcctctggctaaaaaaattaagggctttcatttgtgccaaaaacacatgaatattagcctttgaccaacaatttcgtaagaattaatcttatggccaaaatggtcctactcaaatattctcaactattaaccttgggccaaaatatgcatgaatttgaactttagacgaaaatacatgagtattagcctttggcctaaaatttcatcagcattaactttgggaaaaaaataaacatcacccttcggccaaaatacacataagtattagtctttggcccaaaaacacacgagtgttaaccttgggtcaaaacacatgttaatattgggcgaaaacacatgagtattaaccttttatcgacaacacacagacattggactttggtccaaaatttttttttactggaactttggtccaaaattttaaattttatgagtaaccttgggcctaaaaatgaaaggttattagcatttggcccaattacatattagtattagtcttataaaaagcacattaatattacatttgggtacaaatttcatgatcactattgttgtgcctaaaaatgcatgaatttttgccttcagcaaaaaaaatgtttattaaccttccgacacaactccacaggtattaaatttgagcctaaaaatatatgactattttcttttggtcaaaaatttcataagtattaaccttgggttacaagcgcgtcaatattagccttccatccaaaatttttcataattaagtattaccctcgagaactggaaaacatgaacattagacttcggtaaaaaattacatgaatgttagcctttggcataattacacacaagtgctatcttccacttaaaaacacatgaataatgaccttatgtccaaaatttcaaaattatcaaccttgggcccaaaaggcacacgagtatttgcctttgaccaaaatttcatgcatattaatcttgacttgagaacatatgaaatttagtctttggttcaaaatttcatggtttcataattaacgtggtcctaaaaattgcatgaattttaacccatgtccccaaaaacacattgagtattagcttttcaacccaaaatttcatgagtactaacgttgagcccaaaacagatgaagattagcattttagcctaaatttttgtgtgtattaatcttgggcc

SEQ ID NO: 18165 - DNA, 14460 bp, Oryza sativa
agagtagaggggctaaagaaggaagaaaaagatgagccccccttgcataaaaaaaaaagaagatgagcgcccccccccttccccaccatttttggatccaccctcacgaataaagcatttaaattagagttttacaaaaagaatttccaagaattagttacaagtaaccactaattccatagcatgtataaagaccaatatgaatattcaagcatcgcaagaaccctagaatccaacgcaaaaccgaccctgttcgtgaaaagttacgcctagtcgacaattggatggtctctactctcttcttaaaccattctggcaaaaaaaaaagggtaaaatatattcattttcagcaggatataaatttgcttttggtgaggaatttgacttttttaatttacatgcccatgctagatggaagtaagcatttttacggtttgaatggataatctctataagtttagaattctatgtctagaaatataatttagtttcctgcaacggctgatttatgaaaagcaaaaggttggagcaatgggctgtaatttggtcgaaccatatgatcgaagtgagaaaatgcaatatatgcatggattcggtgtgagaccgggacaaggcttaattaatttgggctttttcccaaagtcagtagccagaggacccacatatataaatcatcgatgcagctaaaaagctaagctgcaagaggttgaccaaactatcaattctaaaagaatgaatgaagaaagaaaaaggacgaccaacttggatcatgcgtgcatgcagctaagctagctgctggtacgatattgtgctaacagtaacaaatggagtatatatacatgtatatcatactacgtacatgtgtgtgaaaaaaaagatatataatgaacacactactcactcgagtcgatctgcaggacgagaaggttaagtaaggaaagaaaagctactactctcctaacaattactatgtgtttaattattacatatatatatactcgactcacgctgctacagcgttgggatcctctgcaatcctgtaacagaggtactacgtgatgtggtgatatatattatttagtgaagctgcaggcacgcagctgccaaatcttaaaccagctaagctgtaattaatttaatttgatcatgcatgaagaatatatactagctcgtatatataaagtcgatcgacatgcgtgcaaatgcattgtaaatttgtaatacggccttacaaacagtaggttagttgcatatatatcgatcatcatcatgcgagtactgcagcatataggttggtagctagctagccttccaagctaagctaagctaagatggagatccaattaattgatccaacaatgatgaaataaataaaatgaggtaatcatacccacgaatatagtacattttcgcctttaattatgggcgcagactgtgccatgcaaaggtagctaaatacaacttgcttgcctcgcatggatctgtatgtttcatcaaaccagaccaaagcaatcaacgaatgcatgtgattttcgttcacatatatatcattgatttaattagtcctagtggtctaccggcccggaccagatagtggaaaaaatagtaattagtatgggagaaaccctattgtcatattctattatgatatattacatgaaccttctcagaggtacatacgagatagatgtttggattacaagaaaagttaacagcagatgtatccggaaatattattccgcgcacgtacgctagcaagtatgaaatgacaaataaattattcacttattatcctctcccacctggttcacttgattccgcaacaaacctctcgcaccaattgaagctatgtgccacgataggcgagacgccgctccccatgcccgcaagcaggtcaaggactgctttgtccttccttccttctcgacatcccgtgcaccctagctatccctcttcttcctccctggtgacccctggttccccttcttccctgtccatggtgagacatcatggatgtcgcctaagcctcgccagcactagatgagctaccgctgccctagatgttgggtcgtcggattctattcttccttctcctagcatccatgtcgtcctctgtttcttccttttcctagggtggggttgggggggggttgttccctttcttgctcctcccagtgagatatcgggtttgagattatgagatgaaactttttagaatgggcataaagtttttaagtttctagttgaaagtttccaaatcatagaggggtgttagcgcgagtttcctctctcatgtaatgagtgtacgccgtgtagttgtgctaactagcggtccctatatttatatctaagatttgattaagagctctatttatctttaggattttatttttacgactctattttatcttagaactctgttttatttttacgatgtttatatttgagtggcatatgtactgggatgggtaagttgcatgttgggccgggccgaatggaatggaatcggatgtgtgtgttatgaaatcggacacgttagccactagtaggccagccaggagtattagtcggagaattggacacgtcagcgtcatccaggctcccagcagcctctcccaatctctcctcctttcttcttcttcctggcttcctgctcagtcgacttggtgggaattccattcccctgcagttgcaatgcttgggtgaatccagctccgtcgtcgccatccccacccccacccgcaccggagaatgagcagctcatccaatgcacttgtgcagcactactactcttgcaagcccccaccgccccccagattagtactagtaccattcttcttctccggctccggctccggcaccaacaacaccgcctcctcccctgctgctgcatcctccacgcacactcacactcacactgcagatgccaacgcccagctggacgcacacctcctttccctcctccgcgacggccacaccgacgccgcctaccacctcttcgcctccaacccctccctccccctctcccctgtctccgcctcccgcctcctcgcccagctctcctattcttccttctcccgcgcctccgccctcctccaccgcctccgcgcccgccaagccctccacctcctcgacgccaactccctctccctcgcctcctccgcctccgcccgctccaacaacccccacctcgcctattccctcctcctctccatgctccgacgcggcctcctccccgaccgccgcgcctacaccgccgccctcgcgcgcctccccccttcccgcgccctccgcctcttcgacgccctcctccaccacctccgccaccaccacaataaaactaattccctccccgacaccgccgccttcaacgccgcgctcagcgcctgcgccaacgccggagactgcatccgcttccgccacctcttcgaccagatgcccgcctggaacgcgccgcctgacgcgctcacctacaacgtcctcatcaagatgtgcgcgcgcgccggccgcaaggacctcgtcgcgcgcgtgctccaccggatcctctcctctggtctcaccccctgcgccaccacgttccactccctcgtcgccgcctacgtcggcttcggcgacatccccacggccgagaggatcgtgcaggccatgcgcgaaagacgcaccgacatctgcttgctgttccgggctgtcgcggcgaccacataatcagccacgaccagcagagctgtgtgctggaggacatcgtcaagccgtgggaacaagaggaggtgccgctgctccccaaggcttacccgcccaactccagagtgtacaccacgctcatgaaggggtacatgaacgccgggcgcgtgcaggacgtggtggccatgctgcgcgcgatgcggcgagagggagagacgtcgccagcgagccgccccgaccacgtcacctacaccacggtcatctccacgctggtggcggccggggacatggagcgagcgcgcgccgtgctggaggagatggggcaagcaggggtggcagccagccgcgtgacatacaacgtcctcatcaagggctactgccagcagctgcaggccggaaaggccaaggagctcctcgccgtagacatggctgaggcgggcatccagcccgacgtggtgacgtacaacacgctcatcgacgggtgcgtgctgacggacgacagcgcgggcgcggtggcgctgttcaacgagatgcgcgagcggggcatcgcgccgtcggcggtgagctacacgacgctgatgaaggcgttcgcggcgtcggggcagccgaagctggcgcacaaggtgttcgatgagatggagaaggacccgcgggtggcagtggaccgggcggcgtggaacatgctggtggaggcgtactgcaggctggggctgctggagtcggcgaagaaggtggtggagaggatgaaggcgcggggagtgcagccggacgtggcgacgtacgggagcctggcgaaggggatcgcggtggcgaggcggccgggggaggcgctgctgctgtgggaggagataaaggagaaggaggtggacggggaggtggtggaggcgctggcggacgtgtgcgtgcgggcggcgctgttcaggaaggcgctggagatggtggcgaggatggaggagatgggggtggagcccaacaaggccaagtacaagaggatgtacgtggacctgcactcgcggatgttcaccagcaagcacgcgtcgcaggcgaggcaggatcggaggcgggagaggaagcgcgccgcggaggcattcaagttctggctcggcctccccaactcctactacgccaccgactggcgcctccaagacgacggcctcaactaacaccctactatatactactaatgataatgttaaatcttaacacatgttttatgtactactcctacagtccatgaagctacttgcttcccttgctcattatgtacaacttcatagtaatttattttccagcaaaaaaaaaacatagcgacatatatactgatagtgataggggtagcaacgctgttaccgaggagccgggacgaaatggaacaagagattttcctttattgatttgttagccaagcgtttgcctgggacgtggtccgtacaatgttctacaaatttggcaaccaaatgataacaaaatgagcgcaagtaagcgcagtggcaaggcttgtgaatgtctcatgtacaaggttagccaattacatggaacaacaggaccaacttgttgcaagcaaggcttcgtgttgtgctgtgacctcaagacaagtccaaggccaacgatttgattgctgtcaaggggtatcatcagtcacttgttctgacgttcttggaatacttggtacagtcgaatggcccaacatcttgagctttccgtttaacctgcaggaccatcacaaggaatggctcttcatcaatcaacctacttaacttcacttttgttaccagcaatggcaagaagtgatcctacgcaaaaagaaccagcgatgcatcttcgtttactacatctacatgtaatgcatacactgactgactgaaacaataaggcaaacgctctacatatgtttgaagaaatttcatcccatacttctaaatttcagaaaggcataccggtgaccatggactaggttctggagcagctttatcggtaggagaattttgcacagcgcccgtcttctgttccaaaacttcctgtcaaaacatacgtaaactcaggtataagcctcacagcagaagactcaatcaaacttgtacggcgaggtaaacttcaggttagccgattagggtggcaattcatgttgcatatcataaaatttatttcggggcataaaccgagctcaacctctcctaagaacactggactgggcccatacaaatagaacaaaaacaagcagttgtgtaagacacacgacaacctactcatgtaaatgacaacctgacaagctcaaaatgtccatgatgcaagtaaactgacctctccaaaagcttccatgacagcaagccattcttctgtaaacggtaccaagttttttagatgatctttacttatggtatttgttcttgatttacccactgacttaatcctcctgcagaaatataagaatgacacgctatcaatgcaatatataattgtagatgactaactttgtacattcaaatattcgatgcagacatactctatacttgatgcaccctctgaagacgacaacttggtgtcaaacccaattttgtcttcagtatcttgttcttctgataaaataggtcgtctttcctgggtcgaacagtgatgtgattctgttctaccgtcagctgtatctactttttctgtcaaattgccagctagtgcctcttgatctacacaaggtgaaggcgctgccaggttcatatgtgaacattctgcactcctgtaatcatggtcacattcatcccctacatgtaacaggggaggttcctccacagtgaatgaatcatctgtatcaagctccatttcactatcaatatctggtccttctgatgaagtaagctgaacttcactacacaaagaattgttggagtctaactggctgtatgctaaagatggttttatgcctgttgaactatcaaactgtggtatttgatctgtacaatgtatagactgaactagcatattctgctgatggcaggaatcggatttttgcaaggaatctgtagctgaagtgcaattgttgccttctgatgaacaaactgtaccagatgtctctccagagagtgaattttctatgtcaactgctgtttcaccattgtcagacttgctttgagaattgagatcatttggggtgcaccctggagaagaaatgcaagatgttgtcaagttactccccacggaaggttcgcttgacgagcaaatgactttaagaaagcaagaatcctcagcaggctcagtgcttgagcagcaaatagcattaagatcctgtccgacagacagcgcaacactgcactcattgggcatgctatttctgccatcatcattatctctaaaactcaactctgtggtagctccatttccagccaacgaaaaatcatcatctggcatttcttgataacttatattccctgatttttctgaatatggtacagtactttccgataaggattgcttcagtgaacaaactgtcgcatcctcaacaccaggtagagaagaggccaagacgttgggagtgctgtcactagtggcaggttgcacaggaagactggaagcagcagagaaattggttggcagctgctttgttagatggaatctgctttttggatccacaggctgcttatacctggggggttttactgatgaaatatttccactaaagcacctctctggatttctttgagcagtaccactatgtgatacagaagcttttccctgaaataattagtcaaaaatgaggtatggagattttcacaaaaaaaaaaaaaatctcataaaacataggcatacactttgtaggatggccaaagtaaaatttctccaagaatgagaataaaattttgtccaactcagacatacattttgtaggatgcccatctcttgtttcaaacaattttcacaccacctcatcatccagtaacccacaaatgcaattattacacacaaatcattcaccgctatttttttaatgcgctttcaggtaactaatttgtaacgtctggttagatgcaagtaaacacttaaagtgtaagagaaatatattgatacatcaaagtagctgtaaaaatatcacgttattttcatatcactgagaaaacaagaagcaacattagtgaatatgtatgaaagagcataatagattacctgagtgaaaaagccaactgaaggtgaaggcatccggagagcagatggcttagcagatattcgtgcaggggcgacaacagaactggaggggttatcttgtgaatatggtgaaaaagtttcacatttcccagaaccattggtttcttgacagatggtagtaacagtaggcggcacctgtagaagtaaataagcatgtaacatcctttgtagttttaaggttacaatgttttcaaattcaccgctacatcctttgaagtaaataagcatgtaacaaccataaagtagttttaaggttacgatgttttcagtatcatatataggggcaagatttgagatcttgagtggtatccaacaaagtggcagtgcttcaaataacagaggtgtactaagagtttcccctcgattaaatgtaattgacgctatcactcaccatgtccttccctatggtaggtccagaagatttagtgacagatgaacgctcagtcttcgatttaagcgggagcccctctactttatgtgtacactcacttgtaactgaaaaatagtggcgtgctgaattagtgatagtgacatgcaaaagtgctgaaacctaagttatatgtcaggaagatttcattggtagagttgaggagtgaggactatgagcaagattacctgtagctggccttgttgtggtttgggaacatttgtcacagatgaggtacttctacttctagagaccacagaaggagaaggttcagacttctttggtatcctttgtatttgagctataccacttgagtttggcacttttttcggtgtataattatgttaagactaacaatagcacgtgtaattaataagagtgaaacttatgaaaagagtattaaccagacaattggcatgagtctgttaagaaaaaaaaaacaagacatccaataatcccaaaatctccataaggatatttatatcctgcaggtggtcgtggaatggacttttggatggcttttgctgaccttttatcctgtgtgccctgcaattgtccagaagaaaacgagaaattgcatgagctttaataatagcattaccataagtaagcaaaatgctatgtgatgaactgaccgcaagtgcttttcgttcatcctgctcagaagcttttgaggaagcaaacaacttccttcccttgttttctgcactcaaacattttgaaggaaattttccacgagaattctctccgatttccttgagcacagatgtattgctagattttccaaacctagacaatggggaaaaggtagaagaaaatccagaggcagggctcctagttgccttcacttgggagccagtaagcatagaaagctccgtgttatccaaaacgcctgccagaagcatagaggtttttcagttgccggaagcatttagtagctgtgaaagaaatcttgtaccttgttcagtgaagaaagcaggattccatgcgatgctttttctgagattgaacccccctgcaggcttgttcttcctctttttagaggtagccacgcctttgccttcgcacggggtttggcaatccaagacatggcgtcgattttgggagatattgttctctttgttgcctgtccatgaagatattattagagaagtaaagcttattggatacctggaaagtcaaagtccagggcaaaccctagtaggtgcaaatgcaaagagggggttggggggggggggggagctcaccggaaccggtggctgcagggatgcggcacggcgaggccatttacatgtggattcacgactgagcgtgccagtgagaagaagaaatttactttttgtttgtcctttttggatacctggtatcacaagaaatggattcgatttcaatttatagttgaattgagtcaagaggaatcggtttgaactgccattttttctttacatgtttggtgtccacgtgaagtgcaaactttgcctttctcaaacaagagcaaacatattgtgtttatcaatctaaatcacaagaagatactccactagatagaaagggggcaattatatatataaataaaaaagaaaaagatagaaagggggaaataggcatgttgaaggcgcctgatgtagcggagaagatggccgtagtgcttacccacggagtcgtggacgagggcggtggtgagcggagatggatctggcttgtagcggaggaggcagggaaggaagctgcgaggagaggaagaggagaatgtggcaagaggaagacgaggagatggagcaggtgggtggcggaggagtcgaggacgacaccgtcggcgagcggcggcggcggcggcggcgagccggcgatgcggttgagttggatggggaattgaagttgaattttctggagaagaaacctcgcgtcgccagccagcgggaaatgaaaatctacatgggccaataatcgatgggccggcccaggcccaggcccaaccagcagcggtttcctttttggtttctgagtcttctttgagaaggaaagaaacggcagtgggagtggagtcgatcatgtccgccgccctccaccaccagctctccctcgcctcctccgccgccctctccgcctccgaccacgacctcgccttccacctccagctcaccgaggccatccaggcctccctaccctccaatgccgccgcccccgcgccaccggaggaaccttcccacgcctcatgtgccctggaaatcccacgccgccgacctcgcgcgagccgagcatgaccgccgcgacgcccaggcctgccgcgcctaccacgcccgggccgccgcctccgtccgcgtcgccgcgcacgacgccctcttcgcgcgcgacctcgccgccatcccggaggacaggtgggcccacgacggcgactacttcgagcggcccctccccctggaaggaggcggcgcgctcttccgcgtgctgttcaagggcatggcgagcagggaggtggtggggccgcgtgaccgtgaccctggcgtcggggtgctcgccgtcgccatctgcgggccaaggggggaggtggtgctccggatacacaagcccgtgcaggcgcaggcgcagcaagggcggatgatgctggaggcgatggcgctggtggaaggcctcaatgcggcgctcgccctcggcatccggaccctcaacgtcctcactgacaacaagccgctgcacaaccatgtaatgtactatctatgcttgctctcatcgtaaccatattaatattgatttgccttgactacgggtagtatgttgttgtcctgttaactcaaaaatattatattctccaatactccagcacatggtgtcttgttatgtttcagcatactagtttgtttcagtgcctgttcatttggaaatgccttcctcgataaatttcgatcttaaagaaatgctgcagcttctttccatttaaataccttgataaatttccatgtaaattcattgatagatattctttctgttcatgctaaaagaatgattcaattatttttttgtctatcactggtcttgttatgatgtgcactacatgattgttgatagatacaatacatacaatctggtgtttatttcctaatgatgttgggaattgggattgcagatgagtggtatatggcgcccaagacagaagaggcttgtggatttgatcaatgaggctttctcaacaaaacagaaatttgagcaatgtgagatcctctgtgttgcacgaacccaagtcaactatgtcacaaaattagcaacagattctctgcatactcaaattgccaaagctgctgctgtgagtgctggcaaggagaaaaaagagaactgcaccatctgcttggaagacactgacgtctctaagattcatgcagttgaaggctgcgcgcatcgcttttgcttctcctgcatgaaggagcgtgtcaaagttaagctacttcatgggatgctcccagcttgcccacaagatggttgcactaccaagctaaactgtggagggttcaaagatgttcctatctccacggttattagcgatcatggtgcagcgtatcagggaagcacaaattcctccaactcacaagatttattgcccatatcccaagtgttcagccttgatgtccatgagagaactgatacatccaatgcaagcatcatcctcaaagtacactcttgttgatgctgccacattgaggaagtgtgtcaaatgcagtggctctttctgcattagctgtaaggtcccatggcatcatcagatgacttgttatgactacaagaggaggtacccccatgctcgtctagaagatgcctatctacagaaccttgcacggcagcggttatggcgtcaatgtatccgatgcaagcacatgattgaactagcagagggttgctaccatatgacttgcgtgtaggtgttttctcctcaacattgagtctgccatcctcatattattattacctttactaacaattcaacattgatctgcctccaaaatctttgatacttcctctcatatgctaatgctcagattcacttgaacgtttcattcatcctgttcatgcctgttacaggtgcggctatgagttctgctacacctgtggaaaagaatggaaggagaagaaagcgacctgctcttgtccactgtgggatgaacgcaacattatccgtgatgatcctcaaggcaatgctgctatccatgatgatcctgaagatgaatatgatgactactatgatgaggacgaaaataattactatgttggagaaggccttcagtacaatgtggattaccatcgtcagtatgatggaggggaccgtcaccatggccacttctatcaatacaatcgctagtgtcaatgtcgtcttctacagctactaatatctagttattagtacagtagttgagcaggacaatccccgtacttttcgctttcgctttatttttacctagccatccaatgttgctacttcatgggatcctatttgtgccagacatcaacctttgcagttagctgaagttgaagggctcaatcctggcgagcctgttcaattgccatgctagtttaatggatattttcatcataacttgctcatgcttatcgtaacaatgctgtctctgatatctttttaacatctcaaataactcacagtgtgtaactcatggacttgtcacaactgagctaactaatcacgaggagggttaatgaacatgtcatcaaggttctggattactaaagaaataacaacagatgaagtgaactgtgcaagaaagggcagcacgtctactcctgtagttgtcatctactatacagtggtataatgaaggcctatggtaatgggaattcgacaaatttccctctgttggggaggatgggaaggatatagaaggacctaacatttggtacatgtatcacgaaggcaatgccaaaaaatggttctaattctttgcaacaagggcaaaaacatttctgttgcatggcttgtcctttctttacaccatatagagtaaccaggtgaatttggatctgtcatcctctggaacccactgtggttctcttctcatgtacagagtctgcggagtcactctcagtttggatcattgctttcttggcgagctcatagcctgcaaagttcattgctccgagaggagcaatccagaagaagcgggggatcgcacccttgaacagtccgagaggtccctcatttcgaaggatggagaaaactatcaactgcatggagactggggtgcctggtggagcagtcatcatccgagtcttcatcacatcaaagggagttgtgacaactgctgcaagccctccagacaacgctcccactgcaatagtttcccatggttccaagtctctgttcaacacatgctgtgccgcctacaataacaagagcatatgacatgatcattaaattcgtcaaggcacagggcatagttctgaatctaatggcattgcaacagaactagatattatacagatctcagtccattaaaagaaaaggttcagcaacttccccgtaactatatttttgtattttgtatatccagtcgaacaaaattaaacttcttaagaaaaatagtgatcagagaaaagtaatacatgcagaagaaaacaaaacaaccttactgtgggcaatctttgaggaaaataaaacaagccaaataattcagtccaatgacatcattgatagacaggtggatagaagaaaaactccattgagatgccatttcagaagcatgaaattcaaatatgcagaacagattttttttttgccgggtcggtagaaggaaccggcgcccaaatttcattaagattgggaggaataaaaacaaagtacaagtagttttcgcttgcattaaacaaaggcagctcactgcacctttcagtcaacaaaatatagatggaagaaaaccaattttaaggtatggtccaaagaaacaataagaactcacaatacctttttagcttctgcataaagacacattccagcaacatagaaggaacctctcggcaaagagtggccccagtgccacggaagaagccctttggaccatctttttgcatggtaccaacaatggcctcccctacattattgaagattccagcctgcaaacgctgcttaagaacctcacaaggtatacggactgctgttccca

SEQ ID NO: 18166 - DNA, 1091 bp, Oryza sativa
acaagtgaataaatgagttaagtggaaaggttagtatctaatgccatgagaagatagtcaagaacatgttattattttcatgactggtcagatatcaatttagatgaggaaagggttattgtgtaatggttcaaagatgcaaacatggattctaacgcaagacatcaacataccgagggtcatcttcaaggcgctctgaaggaagcaggagcatgaaattgcgaaaatggctgtaggagattgattcttctgaatctgcatttaggtaccgcagcatggcagcagcattatcttcattggccggaaggcctgcaccttttaaagatgtgagaatttgatttttgtgaagtgtcccagacttgctcaaacacagggtggtgtatgcccgcaatattgttggctccttctgctccatcaaggatagaaattgtttccacccaattgattttgaaaacaagttacttctggtgcgccgtaaaaaatcccgagcatacctccttggcaatcgcctctttctcattgcaatctcaaggtcttccagggtgacttgaccatcaccatctctgtctaactcctcaaagaatcgctttcctgcagaagcaacaaaaaagagcttaggatatcaacatgcaagagttacctccatctatttccaatagaacaacaaagtaacatcatcagacataatatttcagtgatatcaatgtcataccaacagcatcaagccaatatctggagctctagttatctgtacatgattgtacaccattggggaattgtgttatgcatattctgaatctgaagagtctgaagtagtgcgtatgaacgcacaaaagaaataagatactacaatcatgttgtgctggaagtaataaggttgaggactggtaatatttaagtaacacatactgcatgcattttctcggtaaaaccagaagaatactgagttagagaaaacaccatatcctatatctgcgtacttgaacaaaaccatgtgaatctttgtaagaaactaaattcagcatttatcctacggttgttagaattagtgacttgtcttattgacataacaatgctatcatgttattaga

SEQ ID NO: 18167 - DNA, 667 bp, Oryza sativa
tttctacctccgtgatgcatcccattgattcaatgaaggtacacaaacttgttactttttaacccttttagtgtaaacaacttaaccgatagcactgattcaacagtgtgttcacttgatggcatttgttagaagaggatgtcttaatgacagagcaaataaaatccaacatactaaattttagataattatgacaaacaccatctgcttctagcaggttccatgggaatatcatgggatgcaatcaaatagaaatttatacaaagcatactactggcaggagctttttatttgtactatttctttttccagtttttcctctatgaatgatcgcccttcactcaaggcattacctacaatgaacttgccttactttttttagaaagtcgataatgaatttacttgctagattttatgctaatggattttttttttgcttgagaaattcaacagttttatgatatttctgattcaagctctttattttctaaactgtatcagacacgtgtccaagcatcttctctttcttttcctgatctcatatcaacacttccacaaattgggctccgaggactttatcggggttctatccccgcaattcttggtcagttttcaaggttagtgtcgattcagagttttagaggcaaatttgaatgtaggctgcata

SEQ ID NO: 18168 - DNA, 930 bp, Oryza sativa
acggtactggccgtgcagcgcagggtgcatctgaaatcctgaacgaaactgccatcctagttactagtagatgctagtaaaacaattcgaaggaaaaaaggaacagagattttgtcatgaattgatattattaacaacagcacaccgaagtactcctcgaccttgtttttgattcaacaccaaacaacacccaattcagcataagctggctggcctggtaccatatagccatttacgtttggttcagcaaacccatcaacaaaataatctcatgtgcaccacaaaagctactagcaacgagtaacgtatcatgtacaaaatgacgcttttactatgccaaaaccaagaaaatatttccacatgacggcaaaaaaagaagaaagaagcaaatgctaaacggtttatatattctcgagtctgcttccaccacaagtatatataaacttgaaggacaacctcatggatgcatctttgatatatatatcctttcgcccaaaacagaacctgatgaccaaacgaggcaaatggtgagtaacttgccagcaaattccagaacaaacacagcaacaaattccagaataaaatggaagagaccaagcacaaacagtactaaccaatgcaataagaagataactcacaccacctatccaggacaaggggtagcaagccatgcatataatatagtaaaaaaagatgtgaatagaatggtgaaacacaaacctggtgcttgaaacgtctggttacacacccagtttcatgctggtccacttgaatccaatgcctttcaataaacactcatgcgccaatccacaagctcaacaatcaccaagttgagcctgtgcaaccaatcaatttcaagaactgagaaatgtgcaagttagctgggtgataggtcaagtcgcatctcccaaagatagggctgcaggaatt

SEQ ID NO: 18169 - DNA, 478 bp, Oryza sativa
atcctatgcatgtttagggtatgagtcccgcatggaaggggttttcttgggcctgctgatcggtatttcagtcttactcatgttgtccacggtgctgtactggatctggcgtacgggtcagcgcgaacatgtgctcaaagtcgaacttgaaaaccacatgaagtggctggagcgagcgcagaaaacggcattgctgggctttttctcgatcgatttttcaaaccggaagatcatgctgtccccgatggcggcagagatattgggaacgcaaggccagcggcaactgaatttttccgacttggcacgctacatacccgcagaacaaatcaaacgcacgctgcgcaagctgtgaaggtacggcgtttcgggacggtgcagaaaattgagttcgatctgcgtccccagctcccgcagtcgcatacgcatacgcatacgatagagtgctggtgcgaaatgcaagatgccgccgcatacgatc

SEQ ID NO: 18170 - DNA, 23678 bp, Oryza sativa
  unsure (1)..(23678): unsure at all n locations
agttgtacattggattttgtaccgctttaataggaataatatcaaactttggatttggggagaagtctagtgttatgacactatcaccaagcccagtgtagaacttacccccaactacagtgagaagggccatatatccaatgacgctaccacgatgacgatgaaacctcctagactgatactcatgcttaaaccattgggttcctccgggataacaataccaaattaccgtgtcattaaggcttaggacgagcacgacacagtttatatcggtgggcttacacgatagcaagcaccttgtataattcgttctgaggaatctgtcttgatcgaagggcaagctaattctctgagatgtgaatgggttccacaagaatgtctcatgcgagtctcggtgtaccatgagcagccaaccttgtggtgttatccagtaaaagtgatctttcaaataatccagcttgctattagctagcaattgtttgctagatatgctatagaggagcaaagtgtcatttacctccttaccctcatcattagcagtatcatcatcattatcattactacttgcatcggtttcatcatcatcagtttcctccatagactcttcatcgtcacttgcctcagtaaactcatcttcgtcgctcacatcctcgtcatcaccactttcttcattgtcctggtcgtcgtcgctttcctctagagacatatcatagttgtaatgaaacaataacatcggagctaatttatgatccaacgaagttgaattttcactttcgtttatcccgatctgcatcgtgatttagccaatacgtcgtacgtactccagctacataaaaaaataaaagaattactcaaatgatgatgctgcacaaagaggcggctcgataatttctaaactcttagaactatatgtggagatagtaattaaaagggaccctatacatatcatgcgaagcataacttggatagcaaaagcttataaatatatattcgaaaaagaatagttcgtgtatgggggcttatatatctgaaaataaccagcaaaacatacaagtctccttaaaaaagagagagaaaaaaattaaggaaaaaaaatctaaagtagcttgatataccgtcatcacataataatataataataattgctagtatagtaattaaattaattattctgttgcaaaaagaacataataacatttgctagatacgaacctctttgcgtgcgttcctttaaattgccgattaaacgggcgcaggcacttaaccaggcaggcgctgttcgccgcgtttctgtaaattgcacggctcgaccgctcaatccctcgatgttcatcatataaatacccgcgaccgcgaggccgtgaatccgcctcggatttattcccgcgatccatgcatgcgtcgtttatggtatcggtatagtatccagtgaccgagtccgacgcgaacacacgcaggaccaggcgccgcacgatcgcagcacgtacgtaccctgcgtcagcttcaggcctttcttaaacgtgacggcctggccgtgctgtggcggcgccggtacacgaatcaaactgatcaaagaagaaggtcgagatcgatggatcgagagcccaacgcgatggaggaacgggactggtcgtctctcccgtccgacgtgctcgccgtgatcctggagcgcctgcggtggtcgagccacccgagcttcgcgttgacgtgccggcactggcgctccgccgtgtcgcccttctacccggcgtggatcaccccgctcctgctcagcaccgcccacgtcggcgtcacgaatattcggtactatagcccctattaccacaagaacttcgaggtcggcggcaaagacggcgaccacgcgggcgccaagatttgctgtgccgctgggcgacacctcacgcttgattcgccgagcgcggtactcgatgtcgagcttgtgactgggaacattaataaggttccacatatatataggggtaattttgattttgtcatctacgacgacagggcgcatagaatattcggtatcgacgcggttctcccactcaagattggctatgccaactggaacagcgatgatggcgtgtgggaggactggacattgatggagctcggcatcaatgggccacgactactaccgtcacctgtcaccaacccggttatccattgcggcttgatataccttctaaacgatcaaggagggttggtaatgtatgacccatgcaagcatgatgaagggtttgagtttcttgacaaccccacgagcttcggtttcaaacactacaatagctacctggttgagtctgatcagcatgagctgatggccgtcctccttggccgacgcgggacactgaaccatgtcatcaagcttaacgaaaagaagatggagtgggagaaggtggagagtttgcaaggacggacgttgttcaccggcacactcacatcgatggtgaagaagaccaagtttaagtggatggaggatagagtgttcctcccggtgttctacaaatggcctgacaccatccatgctgaccttatttctcgtgatgatgaattagcctttgtataaaaaaatcatcgtcgtttgacacgggtaatcccaatgtggtgaatcacaataatggcgcatgttgcgaaaaatgtgtagacgtgtggtcgtacaaattgggtcaacaagaagaacccagagaaaattggggagccgagagggtggactacggtgtgtggattgaccttcactagtgtcaattgagctacctaccaacttatagagtactcattctactttttaatagatatctccgttgatttttttacgtaacgtttgatcattcgtcttattcagaaaatatatataaatatcttttgttttcttataatttatcactaaataaattttaagtacgactcatagtttagcatatttacactgtttttttaaataagacaattggtcaaacattattttaaaagttattaacggtgtcatctacttaaaaacggaggtagcatcatgcatgtatctacgaccctttttttattataaagtcatgagtagcagcttaagaacctcatcttcaacatcaatacaaaattttagacccaaaaaaattgtaggaggcaatcttttcgttaacactcattcagtagtaattcaggctcacaaaattagcctgaactaactcaaagggaatcgcttgcggctacaaccttgctgatcgcactgaccaccatgaaccagcaaagacgctagaaacaacttgattgctattgtgtaggatccaaaatcatgaaataccatatttacaaagttcatacatatggtaaaaaaaatggtatacacttatagcaaggttaatagtatagcccactactagctccgaatcatctaatgccaatgtaatagccaattcatacaatagttgcttactatactattaatacatggttccacctgtcatacacatattacgttttggagtccgtgctgcagctggctacagatctgtagccccttgcttttctctcgctttctttatttctttaaaatatgtttatagctggcttatagcctgctattgtacctgctcttacagtggcagtagttgcaacgacgacatgccaggaacgccgcctgcctcatcattgtgaaggcaaacaattctgtcaatataatgcaaaatctttcttaccaaggcgaaagtttcgcgatgcatcatgcggatttgtgtttctctttgggggggagggggtggagggaggtgacgcgcacttcctccgttagttcacgctaatgacagtaattagaaaaaattgtgaagatttttttggggagttttttttactaatggattgaaaattttttaagttggatttgaaaactttcgacttaagatttaaattttaaagtcaaattttgaaaacttccaactcagattcgaaaactttcaagtctagatttaaagattttgaaaaattttcaacttgaaattcgaaaattttcaactcgagatttgaaaacttccatgtccagatttgaaaattttgaaaatttcaacttgagattcgaaaatttttaactcgagatttgaaaactttcaactcaagattcaaaaactttcaagtccagatttgaaaactttcaacttgagaactcgagatttgaaaactttcaagtccaaatttaaaaatttttaagttcagatttaaaaattactagtaaactaatcactagtaaaaataggaaactaatcactagtaaaactaattacgaatttttcttctacccatacggcatcaaactgcgaaaaaagcaaaaaaaaagaaaagaaaaaaagaaacggcggtaggttagcgaaaataaaaagtatcgtgcgcgcgtgcgtgggccgtgtgagccgggaatgcgcgccagcagtgcgcgcgcgaattagcattctcgttctctgggagcgtcttccaccaaatcccacaacatgagcagctcagaaatatgtcctagatataaaccatccgtgagcatcactctcaagttttactattttatctctctcacatcctcgaatgttttgccgttgacgagagaattttggggagatgagaaaatacgtaagcatcactctcaagttttactactttatctctctcacgtcatcgaatgttttgccgttgacgagagaattttggggagatgagaaagtggattatagtagagttgtcgccatcccgtgcgttgcacgggttattattattattattattattattattattattattattattattattattattattattattattattattattattattattattattaaaaatttttacgttaaatatgttggttattcatagcggcttataataaaaaaaatttcatgtcatttacaactttctgattattaattttagaattaaattaatatgggaagctaaattgagaatccaagatgggttctccgtatttattaattcaaaatcatttacgaattatggggtttaggataaaaatgtcacttataatttacaattatcaatttggaatttcaaaattaaattgataaagtccaaatagatacaattctgtatctctattgattcttagttttagagaaaaaaaaaacaaatcctgaatagtccttggtatcgcccatgccatgttctatctaacacaaattctcaatataatatactttcgcaataatacttttaaaatatccaatgacatgaatagcaataatatgccatgggctgtatacagtacgcataaggataatatggacaacacatttgaaaattagttattagttgttagttttctttcagaaagatatagatcaatatatattctttgtttacagattaagatcaaataaataatccaaattttatagtgagcatgagatttatgccgttaatcaacctgatttctttgacaatgtacttatgagttatgagaaaacagatattgaattgatataagattagcagcataatttattatttcaatcaaaataaagcaaattcatggatgtcttgaattaggcaaatagaacatgcatgtttggcataatacatccgagaatgtgttgaaattaatagaagatgcaaattcagctgtacatgtgtagattacagatgaggtgatcaaccatagatgaatctctttctgttcatcggactcaactgtcagacataaatattaatattagtgctacttccatttttatttttaatagatgacgtcgttaactttagaaataacatctgactacttgttttattaaaaaatagtgtaaatatgctgaagtgtgagtcagatttaaagtatatttaattaaaaacatacctcaacaaaataagaaacatcatataattttaaatgagatatatattttttataggaaaaatagtcaaatgtcatgtcaaaagttagtggtatcactatctattatatactaaaagtccattaaacttcctacaaacgcttctaaacctctacgtagcactcctataaatgctcctataccgccacgtggcactttaatttaaactggtggacctaatattttaaacaattaaattaataatttccaccattaaatattatcttcaagaaaaaaatcggcacgttcccctctctgttcacaagttcaggtaatatacgttccgaaagaaaagaggaaatacgtgcgcatgtatgtacttactcccctcccacaccctctaccctccccatccgtgtctctcctatttatttcctattttttagccaacaaccaaatacatacatagaaattgtttatatacagatcgatatattaattaatacgacatgaattatctattattattatatagtaaaagtctattaaaagtaatacaaacgctctcaagctgtgacgacgctcttataaattaaagtaaatataagaaattctgagaaaaaaaatcatcttacccaaacctatcgaccttatccgtcagagtgcgtatgaacaacacatgtatatagttgcctcctcaccgatgagacgaacccactggctctcgcctcatttttttccttacaacaattaatttaaccaccgaataaaagaagattctaaaaattacctaaaaaaatatccaccttaattttttaataaaattggtggattaattacttcataccattagacatctaacaactttctaccaacttaattatatttcttaacttgtatacgaggtctgtttacctatacaaatatgtaaagctaaatcaatgtacaaaggtacaaataaatccgtctatgaatgaagctcttttttattactatatatctccgtcctataatggatcctaacattttataagaattaaggaggaacgaaaaatactaagatacccattattaaataaggctcattaaataagggtatgtagagagttagaagatggttagagtaatgttggataaaaattaaatgaagaatggctggagtagtattaaaaatcccttatattttaggttaaaatttgaatccttcgatttatggatggaggtagtagtacgtgactatgtctttaattagataaaaaagtcatattatcatatttttaatagaaaattccttaaattaatatatcctaaaatatacagagacatatttagtatacaagaaaaaaaatataacttaaaagtttaaattaagattctaaatattttaaaaaagaaacacatgtagtagaaaatgatagtttcatatgaaccagctccattgttgtgacatatttttctcataaatttaagatgacatgtgtaaataattttagtttataatttgtagctactttagtttaaaatagtcaacctaaaaataatatggttggaggggcaatgccttattagctacactcttgcttaactagcaagatgaaactactcaagtgcacataatgctgtttatggacaacacatgttacatcctttaaattaaaaaaaaacatagaccacatcctaattacactaggatgtcacatacaccccctcaaaagacccgacatctccgtcggtctaacttacttgcatagtcgctgtaacagcccaccctccagaaccacgtagctaagcccaaccaccaggtgggctcacttacacataccagtccacttacactttcgttatcgcttcgtgaaaaagggttaactcaggagtgacatagttggagggatgaggctataaaagggttaactcaggagtaatatagttggagggatgaggccttataagttggttatactcttgctaaactaggagggtgatactaaatatatgcacacagctttcatgggccatagttactgtaacagcctgctctctagaaccacgtagctatgcccaaccaacgggtgggctcacatacacaccagtccacttacaatagtccagtgatcaaaaccaactttcaaaacaatcctaaaaatgttattaataaacaaagatttagaagagcaaaaaaaaattttttaaaaaaatcctatacataaacattcgtcacaaattttcaaacaccactaaaaaaggtgcccgcgcatctgcgcgggctaccttcctagtttagaaaacagaggtagtagttaatttctttttccgcataaagccctcatcgaccaagaaaaaaatggagggagcattaaaatgaaggttaattgattgtgcattagtcgtcgctgcgtagacacatctccttccttagcctgtattacatacaaccattagatgatgccgtgagaatcatgtgtgactgaccatacaaatttcatcgtatgcactcagaataaatcagtagtgaaaatagatgacacaggacatgcataattgatcgatcggttcatgcaaaattgatgggtacctgcatcttacttagaatacagatgcaagggtggaggattctgacgatagaagattgcatgcacggcaacggatgcgcaagcgttattttttatttgacgaccaacatcttgatttatgacctatcaaatttagaggttcagacgatggcaaatctcaacccaaaaggttttgtattgtttgggatgcatgagaaacctatctggattgaggaaaaacattacctggaagagatctgaaggtcatcacttgtgtgccatagagttttttccatggctttgaaacttcaacaaatttcgcttgcactgatgcctccagttggagtccagatcgaccatcttgtgtcgttcgtcaccgctgccattgctgcaggagacaaccctgtttctctctatccctggtgctggagataactattcgtaatagatagaataaaataacctccttgctcgatcattagatgggctttaacgtggcccatcagaattgctatgcgtagctaaattattttttacatcaatggttactataccatgatttatctaatcaacggttggatttttctggttaacgtgagagctcgtaggaagtgtccaattagtataaatatagatagacggatagatagatagatagatagatagatagatagattggccttaagtaatcaatttcgttaattagtactccccaattgatctgcattcgaatttcagatgaaatgagagaatcatgcatgtatgtatgtacgaccctatagctcttttatcacatcagggccggctccattttattaccttagcgattgctgactctgattgtcttggcgctagaggacctcctatgagaacaattatagcgctaaccacacaacgcgaggcgaatcagctatatcgggtactcacatggtcataggtcacaattgcgtgagtgcctatatatagcgcctaatcacgccgccgttggtcgttcgggtacacgtaccgccgtcacgcctctcatcaatcgcggaaacggtagtatagtactacgcacgttcagcgcagccgcctctagcttcactctccgaagcacacagacacctagcctgcacgtacggttacacgccacggcttacgtgacggccaggagcgcatgcgatagccggccgcgcgcacctagcactagtatacttcccaagcatatttttttcaaatacttttatatagaaatttattttaaaaacatcaaataaacacatttgtaattttgtaatttttaatatttaactagtatatatttcctgtttagcgtgcgaagtaacaaggcctaaacgagctttaaagagagcctaaaaagctccaaactcaaactggatttattaatttgtcgtgcgtaccttctgcgaaaatcctcctactcaccgattcacgccgaaaagatcggaccaccttttgcatgcatactcctatctattgttgtgcactttatgcatgtagctgtcgcctactagcctaccttcctttatctatccttcccatagataatgggttctttaataagtttcaaactattttttcacttaaattattattttgatctatgatccgattacaccattaaatttattataattaaatatttataacaagatcatacttgatcatattatgatgaaaaacaatagctttattaatgttgcacgtgtttttctttaaatgtttcaaccaataatctgtgatgtcacagtggcgctctcccatcgcctttcctcctcccctttgacagcggccgagtgggcctctccgcctccttcacggatccaccactgactggcctcgagaggggtggatccggccatggttggcgggaggcgtggcagcgacgggtccaatgggggggaggtgctcggcggcggtgagaagtgcagcggtggcggatcccactatggggaatggggcagcaatggatccagtggggaggcacatcggtgtcggatcctgctcgccctcccgcgcggcaatggcaatgataacgagccaccggggtgatgggagggacagacccaactcccccttcctctcccgcatggatcctgccgccctcttcctcgcacgacgaccaggaggaggatgatgagaacggtggcggtggctttgagcgatgatgaggacggcggcatcaacttcgagcaacgacataagcacccacatgcaaaatctaatttatggttttgggatttatggatttttattttttccttttcgcgtgcggacaatatatgcacccacaagcaaaatcttattttcgcatgtgggtgcgccacccacatgtaaaaatcactattttcgcaaaccttcttggtcagactggcagcctaaccgcacgaaaaaaatatgttttgaccccatgaaaaatgctttctatattagctagtgttatttattctagtgtcttccattttagtttccgataacagaagtacatgttggggtccttcctcttccggagatccagaaagagttgccaacaaagcacgcgtttgtaacgtacacccaactttcttgccatatgcatcttagttgtaccatgtgcaagctatatatgtatattttgtaatacaactatgcgagaatgcatatgcatgcagaaacggacctgagcaagtcagacgttggcgcattaatcgtccctggcatacactagctcaatacattccattttccaaaaaaaaaaaaagtcatcccttcctcatgaatgcatgaggcgctgcatttgaactggtcatttgcttcttgatcaatataatttgctagatcacaaaaaataaaatagcatattcagtttttaattatctgcaagtgatcacacaaaattacatccatctgtatttatatgtttgtatctatctagctctatctactgattgggcactttttaggtaactctcacattataatcgaaagatatgacgattgattgggtggattgtattgtaataaccatagatcgtattatataactaaactagtagcgtgtccgtgctaacgccacagcaaaattttgtactgccagcaaatccctagctgaatttcaccgaattaattaacatttttctctcacatatatgagagggattggacatctctgaattttattgccaccatttgtttatctgttcacattattttcttgtgatcagtgcatcagaccttgttttagacaaaagtctttcgcccagctttaggccgagttcagttccaaactttttcttcaaacttccaactttttcatcacatcaaaactttcatacacacacaaactaataacttttccgtcacattgttccaatttcaaccaaactttcaattttggcgtcaacacacccttactaaaagcatacgagtatgatacacgttttgctggagtttcaagcttaacttgcagcagcatgggacaaaggcaaagctgctagctcagcagataggcagaacaagccagtctgagctaagcagcaaccaaatgccaagctgctaaaacaacagaaccaaagctatatctctagagaacggttcatctcgagctatctcaaaagggaacggtccatttcggcacaaaaatgacagcaacagacatcaaacagttgcagaactaccgaatacttatagctagctggaaaactgaactccacggtctcccatcttcttgatcattagttgagacttgatcctcatctcgtgaattttgacaagcagcaatccctttaaagcatccaagtaccctgccagcttcgaaggaatcaaaggtctccactgttgcaaaagggaaacaactctacaaggcaaatgcaacatatctgaaagcaattttttttaacacccaatcatttcgggttagcgaaatggcccatgttcctgcagagaacaaatacaagaaggtaatattctgattttgtttccaggctattgcagcatggacatgaccttaactctagaatttgggattctatcccggtgcacatctctaaaatagcaacctcaggaattttgctggagcacatttgaacattaagtgatcaggctatattgcataatatatttcttgtgatctgcgagtttgttggtaaaaatttctttgatgtgatttaaccacaaacgctgatgtgcagagataaagacataggtaataaggatattgacataccagcttcagatattgtgctgcattttcttgaaccaatccatacatcagttttgcacacctaggccgtcccaaattggcatttcctcaagcaggatgccagcgagaaaacatatgcaggtacctgcatacctgggcatgcttgatgtgggtggtagtcttgtcccaggtgctctgtacaacagagtttggaggatggagttgtcgagctgtgaagtccatgaagatagaggttccagatttggtctgtatagaaggattcatctcaacacagtgcaaattaggagagaaaaatacatcatgacagattacctgttcaagtggggaggtagtgtccgttgtgttcaggtagaaggcacgactggcttcgtcaatggcatgccatcaagaactgacacttgatgtgatactccgtagatcttaagtggaaaataaatagctagaaggatgcaaaggtcatctctcacaattccttattgaagcgtacattgaatgggaaatgcaatctgaatcatatttttctatacagtgcactccaagtaagaggtgaaactgtaagtaaagaaatttgctgccaaagcattatactcgtacataataataacaaatggccttgttttctcataactgcaaaacagatttaatctaaagaaaaatacagaaatcaaagatcttccattcctgttttgtaagctgaatttgagactatttgagttttccctcgggagaaaatgcaagcatacctacaaatcaacaatcatgaaaatgaattaagattagcatatgaatttattatattatgcttaaacacaatcatattcagtcgtaaatctttatctgacttttacttacatgcacaaatactccaattgataggatgattaatccaagatgctactgtactattgccacatgcttctctacatgggtcataaactcctaacacaagcgtacgacatggattaataatattctcaaattcttggttagaatccatctgtgccactaaagttacaaaataaaagctctgcattactgaccatcacccattttgacaaaagaagccttcccatgctgaacaactgaatttgggaaataataccaaggaatagtaaacaaacaaaatggacctgcataatctttttacttgcaaacatgggtgggaacatactttgacctgatctgttggagcgctagctagtgacatgtctaattgctcacatccaaacagtaagttacttttatatcatccaaggaaaaaggaatttcctactgcatcataagattttatctactaaacttatgaaccaaaacagcacaagattctacatgcattcatgtaaacagtcaggcaatggatgaatcggggaaaaaaatggagggtgtagacaaatatcgagctgtcaattcattcatataaataattatgatgcaagacatcagatcggtagataaaataaggtacacctatcatcgaaggatttttttttgccaggccatttcaacatccttacagataaaatgggattagaggattttttttctcttctgttttttgggtttgcactgaattttgtgtgggtgtgtgaaagtgcaattttactgcattagtacaggatatttattaaaaaaaaggctttaaattgtgttttatatttcaccgggcactttgtgttttgtatgaaaggtgctcttacctgaaaaattatatgaagagtgattgactgtaatagtattttggaatttcacaacacatatgtcaaccgttaaaaaaaactcacttgatattgttaatgatgttggaagtcagtaactatggaagtccaaagctgaaatattgccaattctttacaaatgcactactaatatagctatgtggagctggagatatgccctacacgttttgaaacacagaaaccatgcagttggttcaaacactgtagcatctaggaacaataatcataaacaaatactgcctgacaataacatagaaacgctgccaatcatgtgcaattaaatatgttctcatcaaggcatttcatcgagcagtacgagtgcattggaacgaagaatacctgtccagagcgagtgttgtgagcaggatgtgccacggcgtcggtcgggcggtgcgaatcggcggccgacggtgaggggagggatgacgtcggcggcggccctcgtcgacggagtctagcggcacgatgagccagcggttagaggaatcggcgggcggcgaaggtcaggggagggatgacgtcggggcagcgagggcggcggcggcggggtgtaggcgtgtcatccgacgatggcgaggggagggatgacgtcggcggtgaagctagtcgacgggtgtcgggcggtgcgagggggcggtggttagggttccggcgatggtgaggggagggacgaagtcggcaccggggaggtgacgaagttggtggaggcgggtgatgaatcccgaggtcgggcggcgagggcggcggaggtggggttggggcagcgagggcggcggatgtggggtggcggcggcgatacgagaaagaggaaaggaggagcgaaaggagagagcaggcgagcgaaaggaggagcgcggcgatacgagatgagaggaggagcgtggatcgttggatgcaatgggaggatccttcgagcaatcttagcctttagtagtagagataatatagatttaaaatttgctccctctcagtcccaaaattactataatacctacgattcagctaataaactatcaggaaagaaaaataatatttagatgttcctcattaaagaaagggtgattagaagtgtgggagggtggttggggtaattaagatgaaaataaatttaaataagatgtggttaaagagaaaaagagttgacaggtgcaacccgcctcaaagaatagaaaaaaccattctagccctagcttctttttttaagtccgatatcaatgaaacaaatcaactttttagttaattcagtgaatcttataaaaatccttctacaaaagtgcacctattaggttgggacgaaatatgaatattaggatagccctttatttaggatgtagggtgtatttaggatgaagcaagctagcttaagacgaggtcaagaaaatgtccatttcaaattaagtactcctataaggacaatgcacctgcaaaagaattttacacacttgtgggtataacaaaaagatgaattaattagctatacacatgcaggaatacaactccgagtgacacagctaggggaaatattgtcttccatgaatcaattgtgttacataactaatgttcttgctgagagtcaggagaaagcaagtatgctggtggatcacttaatcagggcatgcaccagaaaagaaagatgttgctattaaccaagatgtacctgttatatattgaagattcagattcttcaactgttgagcactcaccgaaacattctattgcaaaagataatcccaaaagaaatactagacctcctcgaaaatatattgaagaagcgaacatagttgcttatgctttgagtgtggtagaagaaattaaaggtaatgcagaaccttctatatattctgaggctattgtttctaatgattgcaatagatggataattgtgatgtatgatgagatggaatcatttgaaaagaatcgtacttggaaattggtgaaattgtcaaagtagaagaaacctatccgttgcaagtggatattcaagaaaggaaggtatatctccaagtgatgaggcaggacaaaaagcaaggttagttgctaaaagttataactagatttcaagtattgatttcaataatgtttttcccctatcgtgaagcatagttcaattcacatattactcagtattgttgcaatgcattattttgaactaaagcaaatggatgttaaaactgcattttacatggggagttagaagaggacatttatagggatcaacctgaaggttttgttgttcgtgaaaaagataacctagtatgtaggttgaagaaatctctttatgggttgaagtagtcacctagtcagtggcataagagatttgactctgtcatgctttttcagaagtttaaaatattcaattttgatagttgtgtttatctcaaagttgttcatagttcaactaaatatttgcttatttatgtcgataatatgttgattgctgcaaaagataaattagatatagcaaaattgaaggtacaattgagtagtcaatttgagatgaatgatttgggtgcagcgaagaaaattctagatatgaaaattactagagaaagacagtctgacaagttatatcttagtcataaaggttatattgaaaagttcttcatcgtttcaatatgcatgacgcaaaaccagtcagtacgcctttagctacacatttcatattatctttagatttatatccataatcaggtcgtgatgttgagtacttgtctagagttccatacttaagtgcagttggttcagttatgtatgccatggtatgttctcatcctgacttatcatatgtattgagtgttgttaatagatatatggctaattctggcaaagtgcattggaaagttgttcagtgaatcttcagatacctacttggtacttctagtactttgttcaatgaatcttcagatacctacgtcgtacttctagtgcttgtttgtagtttgggagatctagagatgggcttgttggttatgtggattcagattttgctgcagatttggacagaataagatcgctcataggttatgttttcactattggaggatgtggtgttagttggaaggcaagtttgcaagcaactgttgccttatctactattgaagcaaaatatataactatttctgaagattgtaaagaagctatttgtcttagaggtttgtacactgagcgttgtggagttatgtcttgggttgatatattttgtgatagtcatgagatattactttatttgaggtgtgattgctgaaggtgatgtcaaaatatgcaagataaatattcatgatatcctagctaatatgatgacaaagccagatcccgctacgtactaagtttgagctttgctcaagctaggttgatgttacagtatagtcctagaaactatttggcatgcgttgattttacctacataaggtattttgggtgattgatgattgatttttatgctacaagaggaaatttgttttaaggtggagattgttaaatatgtgatctgaattttaggcatacaatatattcggattcctaataggacttcacgtcttttcctattacgtgtcttttttatctcctatatatactcatgtaaaccgtatgagaaggggtgacatttcaattgtttttctcttatatttgtaatcaactcctcaatagtgatcattgccggtcggcgcccgtggctttttcccgtaagtgtttttcacgtaaaatttgtatctccattatgcatctttttaatttcataataaaataaaacatcttatgaaaactatttcatcccaacttatcctcgttaagtgaaacaataaacacatttgccaattattctatcacgaatatcacacgtgaagactaggtgaagtcaactgtcagcctgcgttaccaatagcacataatatatgatgaaatgcaagttgcaaaagaatctcacagatgcaactagcaaaacgactaactggtttccatgcatgtcggactaggacaacgggatcagctgtactcgcgtgatgctaattattgaaaggcaaagcgctccgaaatctcatatataagttatccgtgtgccatgcgatctggtaccattcgccccagacaccacatttcttggtacatagctagctaggatacactagttgccggaggatcgaggtcggtcgatcgccggctcgatcgttgagctcccttggttctctttcttgtagtggattagtggcgttcgcgaagaacccaaatacccaatggggactgaacctgatccaatccaacaagattcgcctgcacctccacgtccgaccccggcacctcaagctacgcctccacctgctattccagaatccggaccaccgccacctcctgcaccagacatgccacctccacctccgaccccggcacctcaatcttcgcctgcaccgccacctgcaccagacatgacacctccacctggacctggtccggcagcagcaccttcgccacattctcctagtcctagcaacgcaccttgggtcgcacctgcggcggatattccgcccccgcccccgccaccgccaaatccacttccggtcattatagctgtaacagtcccggtgtgcatattatttatggccatccttctctacgtatacgtcaagtgccgcagaaaaaggatggcccttagcacgaagcatcaacatatcaaagccgccgccacacacgagagcgagcctaacgagcttcgtgacgctgaagccggtgcgctcgagccagtggcgtcgtccgccggaccaaaccacggtaaagagtacggcggcgacccagcagccgccgccggaccaaggcagtacgaatatggcgagcgagtggtgtccgacggcccgaggcacggtgcagcgtacaacgagctcgttgccgctggaccgaggctgtacgagtacggcgagctcgcggccgcgacgcgtgatttcgcggaggaggagaagctcggccggggcgggtttggcagcgtctaccagggccgcctcgccggcggcgtcgaggtggccatcaagaagttctcgtcggactcgtcgtcgcagggcaggaagcagttcgaggccgaggtgaagatcatcagttccctgaggcatcgcaacctcgtgcgcttgttaggctggtgcgatagctccatggggctcttgctcgtgtacgaacttgtccagcacggtagcctagacaagcatatctacaacgccgacaagccattaacatggtcagagaggtatgcatgccacacaagatctccttaatttgaccatagagatctaggttgatcgatgatctctttggtatgttatacagatcatgcatgcataatcattggttttgtcgatatatatatataggtataagatcattcttgggttaggatcggcactacgctaccttcacgaagagtgggagcaatgcgtcgtgcacggcgacatcaagccaagcaacatcatgctcgactcgtcatacaacaccaagctaggtgacttcgggttggcaaggctcgtcgaccacgacaagggatggcagacgaccaaggccgtgctcggcactgccgggtacatagacccagagttcatcaccacgcgccggccgagcgttcagtccgacatctacagcttcggcatcgtcctcctcgagatcgtctccggccggccaccggttctcttgcaggaaggcgcgccgccgttcatgctgctgaagtgggtgtggagcctgtacggccgaaacgcgatcctggacgcggcggacgagcgcctctgggccgccggtggcggcaaagaggacgacgcgcggcagatggagcgcgttttgatcgtcgggctgtggtgcacacagcctgacatggcggatcgtccgtccattccacaggctatgcacgtcctgcagtccgatgacgcgaagctgccggatctctggccgcagatgtacatggcctcgccgtcgccggcgaagaacttcgcgatgggcgagtaccgtctctccggcgtctcgtccttcacgagcagcggcgtcccctcgtcggctaccagtggcacgacacggtcgtctggctcgtttgcgtactgattccccggccgattcgtggaatataacctgcttcgtcgacctcctggttatcgatctcgtaaaatgtgatgtactgtacgtcgtaccatgcttgcatgcatgatgtctgaggatctgtgtctcggtctctcggagatggtcgatctctctcttgtcatattgtatcaaccgtatgtgtcgtgtgttgcggtgtgagtgtggtgtgattcgattttatatttcggaaatgctatatttctggcaaagtttttccaattgatttctttcacatctttcaccagcccatcacgccgagattctcgcactaggcaggctgggacccgtgacggacacgcccgacggcttcttgttgttctgctgaaatgggtgtggaacctgtacggccggagcagtatccttgacgcagtcgacccgcggctgaggggcgacgacgatgacgaggagcacagcgatctttggcagatagagcgcgtgctggtcgtcggcctctggtgcgcgcaccctgaccggagcgagcggccgtccatcgcaccgacgacgtgacgctgctgcgcgccggcgctgccgcggcagttgtacagggccgtgccacagctcgcaatcactggacgtgcgtacgggtctcgatcggttgacgccttgacggctccgccggcgccgtcgttcccatcttcggagaccaccgatgggaccgcactgtcttccgactagctagccggcatctcgttgctggaaaaatcgatgtgtatttatagcttaatctccatttttctcatcctttttaaagatccaaatatatctgttttctactagaggagaatggatgttcataaatgtttaatgtactcagtttcggaggacggcagctaatttagctcagagcctgagattactggtgaagcaacttaattttcttgagaaatatctgctttatccataagagtacaagccaaatcccttctcttctttcaataaaaaaaaactttttctggaaaaatgctaatacaagattccacaagctattttaaccggctggaaattttcaagggtgagcaatgtcgaatgtattccctacgtttcaggttataagacgttttgattttggtcaaagtcaaatcgctttaagtttaactaagtttataaataaaaatagtaacattttcaacccaacataaatctattatattattaaaagaatagaaaaacgagcctccacgttcgctctcatggcctagaaattctcacattaatcggtgaaaaagaaaaagcagagtccatatagaaatacaatttagaaatagctgaaattcggaattaaaaaataaggaatattagaaaaggagactagagtccatatagaaatacaatttagaaatagttgaaattcggaattaaaaaataaggaatattagaagaggagggtagagtccatatagaaatacaattaggaaataactgaaattcagaattataaataaggaatattagaagtagagtatagagtccatatagaaatacaattaggaaataactgaaattcagaattaaaataagaaatattagaagtagagtatagagtccatatataaatataattaggaaatgactaaaattcggaattaaaaataagaaatattagaagtagagtatagagacattatagaaataaaattaagaaaaaaatagaaattcggaattaaaaaataaggaatattagaagtagagtatagagtccatatagaaatttaaaactaactaaaatttagaataaacataataaaattaaaagtagagtttagagtctgtataaaaatataatttacaaataactaaaattcgaaattaagaaaaacatgggaagaagagtttaaagtcaatataggaatacaatttagaagtaactgaaattcgaaattaaaaattaaagaatattgaaagatgagtttagagtccacatagaaatacaattagaaataataaaaattcataaataaaaataaataatattgaaagaagagcatagagtctatatagaaatacaatttacagaaaattaactaaaatttgatattaaaaataattaataactaacatgtatataaaatacaatatgaatattacacattagtagttttataaagttattgcaaaatttagaatcatgttgtcattttaatatatttgaataatacaataagaaaacatatatgctattatataagagaaaatataatgatgctagccgcgcaatctgtgcgggccaccatgctagtttattatgaaaacatattcaattattgatttgatgacactaatttagtattataaatattactatatttgtctataaacttagtcaaacttgaaacaatttaactttgaccaaagtcaaaacatcttataacctgaaacagaggaagtacatatcatgacacgtttagatttcactcagtctggactccaccatattataataagggcaaaatttgctacatgatactcaagagatgtggtctttgctacaagacactccaagaacgtgaattaatttgctcaagaaaaataaaagtgttaatttgctggtgcacaccatacatattattttatgatttcctattattttatgacaccatacgtcgacgggattcgcgaagatggctggcggagaggtcggggcagcgagcgacgatgcgaggtagtcatctagcaaaggagacggcgggcgacaaggcgtggccggcattaattagaggaagaagcctcccccgtccctgcagcttggtacggctgcaagcaagcgaccgccgaagaggcccatgatggcaggaacaccccttggtactaccagcagtttcgtgcgcctacagttcttgatagttgttggagaaatgggaacaggggtttccctcccccttgggtgcttagggcactacaggccccaccaagccatacaatatctgcatcttcaaggtcttaagaacagtgtcgagaccacaagaactaccctaggagtgctcggggcgctatgggctcctccgggcctatcccccgagggcgatctacatattcaaggtctcacgaagagtgtcgagacctacaagagatttagatcttcaaggtgtcaaaaagagagtccagacctacaagatctacatcttgttggtgcatcggcgggcaccagctggtacagatggcttatcttaagttatgcccatcttgaactccttacatcgagnnnnnnnnnnnnnnnnnnnnnnnnnnnnnnnnnnnnnnnnnnnnnnnn

SEQ ID NO: 18171 - DNA, 550 bp, Oryza sativa
cctgcgccccccatgtaataaagaactattcacgcttccgcttgataaactctgaaatgtatcaacttttggtgtaccttgcctcctgggacaaggaataatgcacgcacgtaaggaacgcccgttgggttatttccagtcgtgacatgcattgtggacgaaacttttaccattatgtggtcgacggcgctatcgaccgatgttggattttccgccaactcagttgatgcgcaactgctgcgtttttaggtgggacttcctaactcttcatacgcagcagcagcggcggcctgggggttctgttgctcttcttggatctcttgcctaatcttggccctcattgactcgagcttttcgtcgaattcagatgtcagctcagctcttattgacgcccggatcttggcttcaaggcgtgcatctttctccgccttgttggaagtccgcttcttgtactgccacgcgtagtctggaaatccatacttctagggaacggaagacccaacgccccgtgtccgtccacgatgttccttgttgcccaacgctttcgtga

SEQ ID NO: 18172 - DNA, 369 bp, Oryza sativa
ggggcccggccgtcagccgcccgcgccctcgggtgcggctgacgggtggggcccacggcgccggccggtgtgagccgggtgcacccggtccaccgtggaccgtgagactgccgcgtgggtcccactcccgtggacccggtccgcgcgccctctccccggctgacgcaataaatccattttctttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatacggagtttattagagtaaa

SEQ ID NO: 18173 - DNA, 978 bp, Oryza sativa
ggcagtgtctcgcggcggtggggacgcggtccggcggcgtgggggcgcggcggcggcgtaacgtagaggcctggcggcgtacgtcggcgtcggcgtcgtcggcggtggcggccgtgccgaagtcgttcgtcggcgaaagagagagagagagctttatcgagagagagagggcgggggctctcacccaagagacgtggcggcggcgtctgtggcggaggcggcgaggaccgccaggcgacggtgagagacaacggtggcgtcggcgcggggttgccctaggcagtggctgcgaaggagaagccgatgctcgatctcgatggaaaaacgtctgagtgttggtggagaagacgagtgtcacgcccagaaattcccgaatagaattccaagcagaatgtgtattaaaacccccgtccaggaccagccggggtacacaaacgacaatgttgacatacagatcctcgtcttacaaacattataaaggtcttacagaaatgcagcggaaaacaaaagaaactggagcttaagccttgactaaaccgcagcgggaacaccactccacaggcatcctcgacggcacggacgaagcctactcctcggggaaaccttcatctgacacatacccgtcctctggggttgggaaaaatagagcaagactgagtactacccactgtactcagcaagtcataccggaatgggggtatgatgcagggaattaacaaagaagagctagagtggttcatttgcataaatactggcatttataaacaggaatttaatgcgaaaacagttgtaataattaagcagtattaaacatccgctgtccaacgctaacccacgttgcgacaggcccagccatccacctgaactatccaagttcaacagattacactagggtgagactaatcacggtgaatctggttgaccgcccataaccgcgggcacggctattcgaatagttttactctgatcagaggtgta

SEQ ID NO: 18174 - DNA, 2188 bp, Oryza sativa
gaattcctgcagcccccccaattcagttagtacgtggaaatcctccaagtatttcccatttgcgtaagttcggttgtgatggatacataccgatctcaccaccacagcgtaccgctatgggcccacataggaaaatggggatctatgtgggattcaaatctctgtcgatcataaagtatttagaacccttaacaggtgatctatttactgcccggttcgctgactctatctttgatgaggaacatttcccggcattagggggagacttcaagtaccaaaaagaatgccaggaaattgattgggatgcccaaggtattcctgcctcagacccacgtactactgaaactgaacttcaagttcagaaaattatacatttgcaaagacttgcaaataacctgccatatgcatttactaattataaaggtgtgactaaatctttcattcccgctcagaatgtgccagaaagagtggaggtaccaaataaaaccactcaacttccactcactaaaaagagaggaagaagtatggccactcagcgagaaacaattgctaataagcaaagaaagatggtaaatgcaaaccaacctttagttagtacacaccaaattgacactatatatcaagcagatcgtgatagtctgcaaccttgctcggtggtgcacaatgctgagactaggaattcggaagaccatagacacattgtttcgggagatcacaatgagtttataagggttgatgaaattgccatcaactactctaaaactagagaatcttttgatagaagagctacaattgtcgacattaatttttctgaacaaattgctgattgcctccatgttgatccagaacctaggtctataaaagagtgccaaaagcgctctgactggaacaaatggaaggacgtaattgacgcagaattagcctcgctttacaaaagagatgtattctcggctgtaatgcctactcctcgtggtatctttcctgtgagatacaaatgggtttttgtccggaaacggaatgaaaacaacgaggtggtgagatataaagcaaggcttgtagcacaaggttttacgcaaaaacctggcattgatttcaacgaaacttactctccagttatgagtggtataactttccgatatttaatatcattggcagtacaaaatcgtctatttatgcaattcatggacatagtgacagcatacctttatgggtcacttgattcagatatttacatgaaggttcctgacggaatcgacatcccgaatcagaaggtaaatcgtaacatgtattgtgttaagttgcagaagtcactttatggcttaaaacaatcgggcaggatgtggtacaaccgattgagtgaattcctttcgctaaagggatacactaaaaatgatgattgcccgtgcgtctttatcaaaaagtccaccacaggattttgtattatctcggtatatgtcgatgatctcaacatcattggcaatacacaagatattaatgaagcacgccttcatttaaagacggaatttgagatgaaggatttgggtcaaaccaaattttgcttaggtctacaacttgagcatttaccttctggaatccttgtgcaccaaagtgcatatacccagaaaattttggagaaatttaatatggacaagtcatatccttccaaaacccctatggtggttcgatctctagacgtggagaaagatccatttcgaccaaaggaagatggtgaggatgtgcttggacctgattttccatatcttagtgctattggcgcacttatgtaccttgcaaatagtacgaggccagatattgctttctcggtaaatctattagcaagatacaatgctgctcctaccaaacgccattggactggagttaagaatgtctttcgatatcttaatggcacaagagatcttggacttttctttaaaaagaaccaggattcaactttaattgggtatactgatgttggctatctatctgatccccacaatgctagatcacaaacaggattcgtatttttacaaggtggaactgatatttcatggaagtcttctaaacagactctagtagccacttccacaaatcattctgaaataattgcattatatgaggcatcacgtgaatgtgtatggcttcgcagaatggttaaccacatattaacatcttgtggtattggttcatt

SEQ ID NO: 18175 - DNA, 2429 bp, Oryza sativa
aaattattttatcctcatgagtttcagcaacatggagagataaacatcttacaaactaagtcatgtgataatcttgctgatttattcacaaaatctctaccatactccacattctttaaatgtgtcaaaggaattggtatgagacgacttaaaaatttgcaggattcagggggagtatcttcctctggaaaataacctattttcgtcatattatactctttttcctttgtatgagttttaccctttaggttttctcatccaaaatttttttaatgagataatatcaacataagcttatatgtcttatcatttggcttttccccactggggtttttactaaatgataactgtagacattatactattttggatcatactatgagctttactcatagatctaaaatagtcaataatatatatcacggttctctccttatatttcccactgggttttcgaggagttttacgtgatgtatttaatatactgactataattatttctaagattatctttacagatatatggaacactaaatgagtaatgatcaaagttggattcgatcaagggggagtgttatgaaatatttgggtgatctcatccatctatatggatagaacagcaaccaattctgggacacgacggttggtcgtgccccacacctcttctcgcctcacggcgagaaccatcgcgtcttctgttgccgcctctctcccccatatatattgtaaccattgttatcaataaaggatccgctcattcattctctacattcttgtgtgcaactctctctctctctctctcgatccctctcgctcaatcaatcttatacactttcaacacgatctatgatccgattacaccgttgtgttcataacaattaaatctttataacaaaatctcacatgattatattttgatgaaaaattataatttatttttataatatatctaaattacttttaaatttcactaaattactacttagataaataaaaataaatttagtaaagtctaaaagtaatttacatgaactacaaaagtaacttaaaacaaaaagaaagtaacttttctgacgacattagaagtaaattcgttatagggataaaaatataactctatctagaaattaaatttaatcagcacaagtaagtttaacaagttttaaaagtaacatgttaattggaagtaacttttgcatggttcagaagtaactttctataaatttgtaaatttgttttaaacattgattgttttttccctttcacttttgtttttcatgtagtatgagataagaagataaaacctttgatggattgtaaataagttagaattaatcatgtataagatgtaaaagttacttccttataacatggaagttacttcctaacatgtaataaattacttttaaattaataaaatatttaaatatattaaatatggatcttgttttgtcgcatattttgactggagcacaatggtgcaaatagattttaaaaacaatatgtgatttaaaagatataagttattaaagaggttaaaaaaatacacactattgtatttatacttgatggtgtggtagctggataagacaaaccagctaccagtagttgtctagtcatgtccataattaaagtgcatttaataataaacaagtaaaaaataatattatatttttaataaaaaataaagatcaaatgtatatttaaaattcaataatatcatcaatgataagctaaagttcaaaaggaggaaaatctcgtccagactttccgacacatcaaataaggaataagtccactctgactccccgaaatctaatttgtatccctcgactacaaaaccagatataacgacacccccaaatattaaaaccatctaaaacaactaactcgatggtttttgagagcagtttcgttgacatggcgtccatgtggtaacccagtcaacaaataaattaaataacaataaagtaggacccacctatcatccccttctctctactatgcgctctcacctcaaggacacgtcgccactaatctctctcacctcaaggacgcgtcgccgcaaccaccctcaccgtgccggcgtggccatagatgacgatggcagatggtgccctgcttcgcgaagccatactcatgctcggcctcgtcgatcaactcccctaacagcgggtgtttggggtgtccgagcagcacggtgaacctccgctgctcctcaccttccacccccaccctaaccgttacacacggcttcagcaccatccccctgctgctgctgcttcccgtgcccgaagaaaaagaacaagaagcttgtgatctcttggtggaagaagccagaggaggaaaaaggatttggggtttgatggtggttagagtaggagagagaagggccacatgttggagctgagatggcgacggggctgcag

SEQ ID NO: 18176 - DNA, 4710 bp, Oryza sativa
ggccccaacagtgccaacccctatgctgccaccgcctccgccggccctttgctaccggcgcaagccgtccagaaggtgggcgggacaggggaggggggagggggggtggccggctcagcgagcgcgcgtaggcgtcggtagcgcaccggagcacatccttgatggtgggggaagaggaggccaggccagagtggagggatttagagaggaatatgtagtggcgacggagggcgaagggggagagggccgagccttgggagtgagaggagtcgaggagacagagggtagtgcagtggaaggactcgtctacgacgaggacggaaacgacagcgaggaggagcaaggcgcgctgggaatccgggtcgaggtgggcggtgtggcccgcgtgcttgtgcgctgcgcggaggcggatagcaacaaggtgaggagacggcaagctctcacgacgtcgtccgcataacaagtgggccctactttattttttaagtttatttgatgattgggctgtcacgtcaacgaaaccgccctctaaaaccaccgagggagacggtttagatggttttaatagttaggggagtcgtaggatacagattagattcagtcagttaagggaatcaaagtgaacttattcccctcaaataaacgtcaacggtatccagcaggctgcaacaggagacaatgggccggcccatgggatccggccggccagttgttggcgcatcatgcacactgtaaaccgggcctcctgtcccgccggcccactgggcggccaaaactttcaacatttttctaaacgccgtctgatgaagttgaattgaatgaaaaaaaaggaaaggcgccgttgccggggatcgaacccgggtcacccgcgtgacaggcgggaatactcaccactatactacaacgacttcattggtgattacgtgtgcggtacagctcaaagtgatattttgttaaccacgtacaaagacggaattttcttatcgaatattagatgcaggcaagtgtaatcatccctataaattttacgggatctcaagatgcaggtcgtgggttttcagtggtttcatgcttgttttgtgcttctcttttttgaacggatctgccatgacctatgaataatggagatgaatcattatagtttctaacgtaaaatttgatactttccgatattatgtaccttatctttgtatgtactttgtcaccgtaaaatttttaaatgttttcaccgttagtttatgctttcgttcggaaacgattaggctcaagcgaccggtgcctaactaaatatcgggcgtctctcaaccacctatttcttaacacctcgtaaccacctcctctctctccttaattgctctccctcctctctatctctcctttatcgctctcacacttacaagcccatggcgaccaaccagccctgctcgcgctccatggtaacggctgggccatggttgtcgtagccggcgaggactcctcacggctgcggtggcttgctagtgcacatcggcatagcttgggactagaagctgggaggaagacgatgacccccatgcagatgcttccattttgctcaagcgatgacgatgacgtagtgagctcccagtagtagcggcaacagggtggtgagggcctgaggaagcgacagctgctcacctcagggtacaaaaagggtgttgtagtatcacggcgtggatctctagcgaagactggaggagagcaccaagccggcggaccttggtaaccctgtgttcgttggaggggaagaaaatgcagtccataccaggtatattctcgtgttttttttttatgtttcagttagttagtgtactcgtgatgtttctttgtggttggatcgaatgttgcagtggatattttgatagtgtttcatattttcatctttgatgcatacgggtttcaaaacgtaaaaaaaaagatgaaaaatgaaacactattaaaatattttgacactcaattcgcatttttagctatctttataatattattgatagatggattgaccgtagagttgggctataatgtctaactagaaatgtagcgcgccatttggcgctccactgtatataacctatattattatttagggtgtgtttaaaacttcaaattttataggatttattaaaagttagttcaattttcatcgaatattctattcttgcatatcatcttatgagcataatcttttgcaatgtccagcaacaattacatgttaacatgtatctgtgcttatttgggatttcgtattttgcctcataactattttgttgatgagatatattcttcttttcgtctataaatttgttaaatttgatggtagctaaagttgttctcacgaagatggcagtgcagatcctccccaccacaaacaaactccatgatatagaatcagagtaagcatctcaagaacagttcacctagcacctctgcatgtattggttagtgcgattccctctccttacaggattcgaaaagggaagctgtaactaattcatgcaaagtgtaaatgttagtcaaggaaaggcgaatagtagcaaacatgcatgtactaactcttagatttacaggaaaatggtcatcacaaccttctttctgaaagcaaacaattaactttctagaaaagtaagtgtttgtaaatcaatgtggtatttatcaaagtttgataactatctaagcatttaataatcttattacttttgatgatttccatgcttgagaaaaactcatgcagtaagataaccgggcaagcatcctaatgagtaccactaataattttggaacaatgccaattgaaattcactctgtattactttaacaaggtaaaattacactttgttgattcatttgtattctaatcagcaaccataatggatatttacattaatatagaaacaatgaagtcaactcatattgcaatagatgactatatagcaataaactatatgaaataaaactcaaagtatacttgatgtcttgctgatcattgatgtccacattctctcacgacacattcaaaaagataaagagatattctgaaatttatttttatagcagtgggagtgtgtaagccagctgatttgcttaccattgtttaagatgacttgatactaagattaatatttacaaataaaacaaatagaaatagattatgttaaagtacgtagtctcaagtattttgtagcacatctattaaattacggcgtaacatatgaaaaacaaaaagaaaaatagtaccatgggttgcatgtcaagcaaacaatgcatggcttcattgtaacaaaaaaagagaaaattccccgtatacccttgaaagttcccccaatcctttctatacccctgagatctgctcattcccttccatacctctaaatttcagtttggatcccttctatacttctcccgtcaattgaccgttaaattcatatcataaagtccattttactcttttggtatcaagaaaatgtaaatttatgaagcatattgatggagtgtataagcttattgtacgcgaatattatatttatgagtttattttgtgagatattatttaacaaaaataatttttatctcacataaaaagatttatcttataaaaaaaattcgtactactataacaaaatatgctatatatacagtttttaatggtaaaaatatattatttttttgttttatctaaaataatttttgttttatctaaaataatttttttcatagataaattttttttccttcgcgaggtgaaactaaaatattacttttgttaaataatatctcacaaaataaactcatacatataatagtcgcgtacaataaatttatacacttcatcaatatactttataaatttatattttcttgatagcaaagggcaaaatggactttatgatagaaatttaatggtcaactaatggaagaggtatagaagggatccaaactgaaatttaagggtatggaaaaaaatgagcaaatctcaggggcatataagggattgggtgaagtttcaggggtacacatggaattttctccaaaagaaaggatttccattagttcaagcgtattagtgaagatgcatggggagtttcaaggttttctaaaacatattgaatacaattcgtaagttttcttcagcgctttcaagttttttcagcaacaaaaagacccctgatgaagtgctcgaactgaatgttcagacaattcaacccaattttcagttaagataaaaatgatttttaatatttcaatttatccatagttcagtagacttgtgggagtacctccctctgtgttctactggtgtttgatacctgtactaatggtctttgctaaattgaataagaaactgaagagactaagataaatggctatgtatcaataaatcgttgtgacttcttaacatatagggtgagacagcaaatttaatatttgttagaatttgatggaataagcttgttgactgagaactatcaaaatgatgaaatttactccattctgaagtcagaatatctttcagatgtagagaatctataagactgaaaaaaggacataaatatgggctagtgttgttgttgttgttagtcaggcagcataaaaagggtgtgaattatagatacttatgtaccactgacgtagactgatcaacattttgggttacaaggaaattaatgattaaagtgcccttagcatagataatta

SEQ ID NO: 18177 - DNA, 1570 bp, Oryza sativa
  unsure (1)..(1570): unsure at all n locations
caagaaaggtaaaccagcatgtttctttgtcacttggaccgttagtgaaatgcaggtacctttgcagctttgctgaagcaatgaacttgcagaaaacaaaaatgtcaaaatcatcgaatgcgactatttacttgaggaaacatgtaggtgaaccattattggtaggtaatacatagagagttccgaaaatggcaataacaaacgcttagtaaaaagaactttaatgaatgatatggtacgctgcatttaacccacttaggtatacacaatgatgaaattgtaaatcacaatgaatcaagaagactaaacacctagatagaaaccaaaaatcaacatgcatatgaagttctgaacatttcagtgtaattcattctcacccatgacgcgaatgtcttgtcatcctgctccctgtgggctgtggctgagagacccttgttgaacctttgcacacatcttgaaataagaatcaatcaaaaaatgaagattggagtaacaagcagcagacgcgctgagtaaatagtgacaaggtaaataatgattgattggctacaccggagtaggagcaccaagcggacggcaatgccatgaggagtaggaggatgcggcagcccaacagatgaggaggatgtgccgacaacctcaccgctggcagcaatgccagctgctggagtcggagcaccaagcggacaacggtcagcggacagcggcgctgagatctgaccgaacttgatctcatggccccattgacaccaccattggctcggccggcctcaccagacacgacgtcgcctatctctactaccgcgccgcgggaagccacggtggggcgccacctcgcgcagcaccgggcggggatcgaggcgcgcgcgcgacgtcttcgccatgtcgggggactttaacctcacgctattcaacgagctcgaggtcgagctcgtcgggggagagcctagtcgtaggtgcttgctgcaaggagctcaacgccgcggatggagggatcggcgatttctctagaatactcgattattttgccacaccttttcttcgggagagggcagggccgtgaggctgtggaagggcgaaggcgaggcttgattcttgaccctgaaatcgtatatagagatatctataatcaatctgtaaaccgaaattactgtttactggccacgcacggcattttaactcaaacttttgtaaccgaaagcacaaatacgtacgttaccgcgcatcaagcgtggtgatattgtctacaatctactatacagtgcggttatgaaaatgtcaaaaaaaacacaagactaaaactgaattatttgaatttagttcaaaaaagaaaaggaaaatcttagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18178 - DNA, 671 bp, Oryza sativa
atcgggaataaagcgtacgcaccagcccacgcacaagcgcatgcgtagcccatccttatctctttttcttctccttccttatcttcatcctctccccttcctcttctctcaccccctctcctcctccccgacggcggcggcgggatgggggatgggcgcgggctggcggcggccggccggcgggggcgggatggaggcggccgggcgcgggctggcggcggccaggcgcgggctggggctggcggcggccggccggcggcggcgggattgcggccaggcgcgggccagcgggatggaggacgggcggcggcggcccggcgtgggccggcgggatggaggccggtcgccggcagcctcgccctcccctcctccagatccggccagaggggaagcggcgggatggaggacggccggcggcggcccggcgcaggccggcgggatggaggccggtcgccggcggcctcgccctcccctcccccagatccggccggaggggaagcggcgagatgggtggccggccggcggcgggatgggaggccggccggtgagtcgatttttttttttgattttttttaatttgtggtttggatgttttgatctgtgaatgaatctatgaatcgatattgtgaatgaatctgtgatgttgtgaatgagtatgcgactcgatgttg

SEQ ID NO: 18179 - DNA, 654 bp, Oryza sativa
tgttcaagctaagagttctattgttctgcaccattaatgactaccctgcactcggtgatctttccagacaaactataaaaggaaagaaggcatgctccgattgcaagtaacatacacaaagccagtggctgaagaaatcacgaaagatggtatacatgggtcatcggaggtgggtcccgccacgtcacgcatttagaagaaagaagaaatattttaacggtaagagagaacttcagcctactcccaaagatttgttcggagatgaggtccacaatatggtcaaggacataagcaatgagtgtgggaagaaaagaaaacgtaacaacacaaaggagaagggtatgtggaagaaaaaatccatattttggcggctaccttactggaaagatcctgatgtccatcattgcattgatctcatgcatatagaaaagaatgtgtgtgagagtttggttggcctgatgttgaatattctcgggaagacaaaggatgggttgaacacgcgccttgatctacaggacatgaatattcgcagtgaactccagcccatatgagatgcaaagacaggtagagtgtacctccctccagcctgccacacattgtcgaaagatgagaaaatcgcaatgttatcatgcttgaagggggctgcaggaattc

SEQ ID NO: 18180 - DNA, 992 bp, Oryza sativa
attcctgcagcccgcaaatgggaaatacttggaggatttccacgtactaactgaattggggaagtttcatgatatgcagttggtcgtagttggacaaggtcagcagcgtgcagaactgcatgaccccaacatgacgaaggtaatttgcaattcatcaataatggtcgagcaataagcttaattcttttgatcaatgattcagccaaaccattttgtgtgtggacatatggaacagagtgctgaacctgaattcccaatgccatacaataatcatcgaaagcatgggatgtaaattcggcagcattgtccatacggattgattgaatcctatgttcagggtaatttgcctttagccttataatttgagacattaatttggcaaaggcatggtttcatgtcgatagaagacacacatgagaccatctagtagatgcgtcaatcaaaactataaagtacctgaacggtccagatcttggcacaatagggccacaaatatctccttgaatgcgttcaaggaatttaagtggttcggctctgattttgagataagatggtctcaaaatcagtttcccagtagcacatgcagtgcatacgaaattagaggatttgggaaatttatcagtgatcaaatgatgaccaatagagttgccaataatttttctcatcatcccgataccggggtgcccaagtcgatcatgccaagtgtggaatgcatcaacattttgaaaaattactttatacgcaacatgtgcaatgggcttaatgtatgtatagtacaatcccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataat

SEQ ID NO: 18181 - DNA, 7463 bp, Oryza sativa
catatagttttacatatttcacaaaagtttttgaataagacgaacagtcaaacatgtgctaaaaagtcaacggtgtcaaataaaacgaaacggagggagtatatacatagtagcatcctatgagctgtaatcatgcaaggcatgttcaatgtgtttgcttaccatatatgcacataaagaaggggccatatgtgtacatatattggctagtcatcatttttttatttggtttgatagagctcggttgtgcttaaccagattgaccagagaaagaaagcgacgaccatatttacgttcgaccatatgagacagacccattaatacacctatagggaaaaggcaagataagagacatactgacacaacaaaaggtctaacactcatctagcgcactactataactatagtggagaagccatcaatgtgcttgtcgtaattaaaatctcagttgtattgtactttgtacatatatacatgattaaattattgtactttttgatagacatgattcgatcaataagatacatcatttatatatatatcgaataaggtcatgatctgttcttttttaattaacgtgaaattttctagatgttttatattaatattggaatttcgagctaattaaattattgacctagaatcaatgtggggactttaaaagggcctccaaagagtatagaaaaattatatcaataagatacactatttaaatatatagatcggatagtcaggcatatggtctttctttctttttattaatgctagaatttctagatattttatattaatattggaatttccatctaatttattgacctagaattaatgtgggaactttaaaagagcctccaaagagtataaacaagattagtgctaaggctccatctagatctactacatatatatatgtttgcaccattgtccactggacgtatgtatatacaatcagcagcatatgtttgcacaagaataaatatgcataaccaaagcatgctatattctataaattgcatgcaaggcagcatttcatatagaaccaaagaaggggaccatgtgtacatatattacagttgtatacgtacgtgtaccaatataagccggtggaatattgaaatatcaatcgtatattgtaaatgcatagttacacataattagccctcggtgaccatgatctgaaagatacttcatatcgtgttgggttttgtgctgatcctatacgtgcgatacatcatttgtagagattaaatggtcacgatagatttttctttttcttgattgatgtatgcgagaataataaatttttagataaatatagcttatatatatttacttggaattaatgtagggacccttaaaacaatctcgaattaataatatagaaaatacaattacagctaaaattcatacttactttagaagaggaagatctgagagagcgtacttggaactatccactagacagtcaataaatgtggctccagaggagtaatattatacatagccatagcatcctatgagcaaaaaacatgtaaggcatgttcaatttgttttcttacaatatgttcacataaataaaggagggaccatgcgtacataggctgtacgtgtttagttgccctgaaaattagaagtttggttgaaattgaaacgatgtgatagaaaagttgaatgtttgtatgtacgaaaattcgatgtgacgaaaaagttagaagtttgaagaaaaaagtttgaatctaaacccggccatatatttgctagacatcaaattgttttggtttgatctagctcgattgtgcttgcccgattgactagaaaaagaaagcatggctcatatttacattcgatcttgcgagataggcccattaatatcttaatagagagtaggcagacaagagctagagatactgacacaacatttaagggtctagcactcgtctagccaataggcccactgggtctagcactcattagaagttttttccttcaaaacgtgtaacaaaatttcaccctaacctactggcacattatttttttttcccaaatctaagtccgagcaggcaacgtacaacaagtcagcaacgtcgtctcggctgaagtgacggctccttcttacgacgcgtgacggaaagtgtcggctgaccaaacggcgccgtgcacgtcgtgcgtccgtccgcatctacagtccgtgatacagtaaatgaacagtagtaactcgttaccaaccccaactgcacgctcccaacgggcgctgtcaaacgcaggttaactagagtagagaagccatcggtatgctaggtggaatcaaaatatgagtactttggattccgatcagctgcagtcactataacttaagcagcagtagtgcatgtcattagatgcaaatcggatggtccagattgcatgctgtactgcacgtagtactgtagcacaatactgtagcataaagtactgtatatatatatacgtatacgtatatatatacacgtatatacgtatgtatgtatgtgtgtgtgtgtatatatatatatatatatatataaaagcctgtatactactcccaggagtagctactcctattgtaaccatcggacacctgtccacctcacatgaaggtttcaggtgtcaacacactaacagagagaaaatatccactaatccaccgatgcagaaaatggattttctttttttttgaaaaatcggatcactgcactgtatgttctgcatgctgaggcatttgaatgttctacatgcacggcttgtcgatccgcacgcatgcaaggccgtgcgaccaggagagtagttagtgtggaggttgctacggagactccatataagtttacggtgggcaagcagatcatttctgcagatatttgatggagcagaaacactccggtggaaagggcagaacatcgtcggtgagttctgttccgtcgccttctgtggaaccagaagacgtcgacgcgtgatgtcgagcggcagaagccggtcgtggccgtaggcgtgtcatcgccggtgagttctagcaagcagcacaatctggcagaggcagaagatggaaccgtttcagctaatggtgttatgcagcagaagcctgccgcagattggtacacatcggagattaatttttgtttatgttctattgaaatttttttctcttgtttgtttgtttggttctgactatttgttgcgttctttggtcaggaatggttttgtgcattgcatggatactgcttcccggagtgaagagatgaatcactctctccagaaatatgacattcatttggatggcatatagccagaaatatatatgacatgtagccagtagtgaaatgatcaaaaaatttgtaatatacctcaaaagaaaatagcagaacatcaattggaagaaattcataggaaaaaactggccggcagaaaatatatgttagccggtcaatttgaaaaactggcagaacgtcagctaaagaaattggcagaacatcatcgccgttaaaaaattgttggcagaacaaccacctaatttttctctatacccagtttttaagagcagtacatattctgcctattgaaagctgacagaagtacatattctgcctattgaaaattaatggaagaaaatcttctgctcagaatttaatcacatccgcatagaagaagtatgcaagttcgtgtaacagaaagctaattaatcttccattccaaaatcaacggataggatagcagaatagagtctgtgagctgtgaaaggagcagaacatcggatggaaatggagtagaagattaatttcaaagaagaaccttctactcctgttcctgtaactaaatcccatcgtgtaatatataaagcagtttctgctcgtcagtgtatgagtaccatatatatgcatcaccgtaggacagaagctctagtctggaatgtgtgcagaaaacaattttctggtctctagatccatagctcaacttctgctcgtataattgaatctcatcattgatatgttctgctcctcaaaacgttttaaaaaatgagcagaaaatagaaaaggtggacagtaggtaaccggaaaaggagcagaatatcggttaggaagggagcagaaaatcggaagtttggaacagaacaaacgaaaatagcggtggcttgtgctcttcgtttccattcgatccggtcatctaaaaaggtgaagaatatcttctacccctataactaaatatcatcacctaatatgaagcctggcaagaatattggcaaaataatttctgttcgtccagcgtgtatgtgtaccatatagtatatacatcatcgtatgacagaaacttgggtttgaatgcatcgagaaaacagaccttcaaatcacagttgctcattttttaaaaaaaaatcatgaacctatatccccgttataggacagaacaaagttgcaataaagctaaggcacaatatatctacataaaaacctcatctgctcatttttactagctgattgaattgacatgcattcaaaacaatttgtatcccgtgaaaagagcagctggcttccttaatggattggattacaaatctgattagtcattaacccgttaacaaggactccaaattagcaccaagctgcacagatcgtgtaacaaaccgcatggtggatgagacgggagtaactactcccggtagtagtatataattttcctatatatatatatatatataggacaattgtgttcctaccgttgctttacaattcaattgtgattttacctctgttttttagggtttgtgattatgctcctgctttttttaagcgaagcagccgtctgccctggttttgacggtagttaggtgggcccggaatttccaaatttaacgaagaaagaaaatgatattataatttgcgaatgaccctcttacccttggttcactgaaagggccaacctactgaaacgatttccccaaatcaaaaatatccagaaccctagcgagaagcggcggcgcaagcaggggcggcgcgcgaaggccagcgcgcggcggccccgcgtgccagcgcgcggcagggtgacgcagcggccttgtgggccaactgccgcgggccagcgcgcggcggagaggggcagcggtgttgcgcgcgggcagggaggcgcggcagcggtgtgcacgggcagggaggcgcggcggacccgcggccagcgcgcaggaggattctccatcatctcatctcatgcatgctattgcaaactgcagcagttcattgttcagaaaaggaatccactactgtatgtatggtttcttggagaatggtgtgtatgttgtcattaagcctttgttagtcatgatctctcccaggtaacacatctctaagcttccctagtattgcaatcctttcgttctctagctgtgtggagccacatggttcatgtacagtttttgttggatggaaaatatgacaggtttcaaaattcatcaggagaattcagattcagaattaagttccctggctggtgggtatggtaaattgcagttatatcaattgatcaaagttcagatccagaactttgacttcttgttccagggcttttgttggatattaatgtgtaatgttgagtattgtgctactttctgataatttgtgatgcttgcacatgttatatgtgatatgttggaaatatctattgaaattgtgtcgaaattattgctgaaattttatccatgatattgtgctgtcaacttgtacaaattgtgttcaaattattgttgaatttctatcaaaattttgtctcaatttattgctaaaattctgtcaaaattgtcctacattttttgttcagtcaacttttacaaaatttgtcaacatttaggtcccatatgaaatacgcacaaatttaacttcaaacatatatatccagtgtttatgctaaaattattgatctcaatagtagaggtatatttgtctattcatcacacatttaacaccgttaccagaccaggggtaggcggctgcttcagttaaaaaagcaagggcaaaatcacaaaccctaaaatataggggtaaaatcacaattggactgtaaagcaagggcaggaacacaattgcccctttatatatatatatatatatatatatatatatatatatatatatatatatatatatatatatatattaattgggcacttcctacgagctcccacgttaataagaaagatctggccattgattaaataaatgatattatcgtcaccgtagatcgtaaaatccatccgtgtttaattttgtgggccatatgtaaatcaatctaacaccacctcatgaaggaatagatcataagagaggatatgcgagatgcaagattgtttatgttgctatcgagcgttaagaacataattagacctatttaattgacagcacaagaagagaagaaaatcagcgaatcatatggcaacaccttgggcatcgatagggaggcatggaaaaggcgaatcagagcctgcgtacgtgacaagacgattaattcttcaagcacgccgtacgttcacgtctatggaaagcagcgatcagcaatggggttcagaacggcgttcacaatgcagcacatcaagtcgctgctcgacgccgatgtcgtcgagtcgccgcggcttccgccgctgccatgtccgcgcctgccgaagttatggcatgtcggtgcgagccttgggggcgccgctgcttcatacgccagcgacgacgtacgccgacaacacggccatgtccatgcaggctgccgctgcaggtagatgcatgtacgctccatcgtctgtaatttctccatatacccgttgattcagcacatagaaaagcaatcacagattgatcatgagaggctcagcgcaaggctgattatccgtgccagagatgcatagataaatacccttaatttgttaacaccatactttcagttaagaccattgattatcgattaaccatcatgttatatatatgtgtgtgtctatttgtttcagttcgtatccatcagccaagctaattgcctggctgaatcatatggatggactaagacacagaaacatggtacatgtataggatcaacatgatgaaggcttaatccaaaaggttaatccgtgcatttcttttataacttcatactctatttaaaaaagattattggccaatgctaacatcgatcacatagatagatcgatccatacaaagccaactcaaaacaaggagatcaagttagctatactgaatgtgtttatttgattttgactaggttataatagtttttatatgggtctgtctatttttcagtcactccaaaatgtacacaaatttcaagcactttgaatggcctagaccacgccaatattcatgaagatgcagtatatacccagcatatcttctactcttcctttcacacctgtaggacgctcgcattttcgcccatcctgctgctgctctcctccaatttagggcgat

SEQ ID NO: 18182 - DNA, 1144 bp, Oryza sativa
ataagtaaccaacatatttagagtgcgattaaaattttattatttattgtatcaataatatgagcccttgcaacgcacgggttagcgactagtatatatatgacgcgtacgtaagctccatcgatcagatgagcagagatacccaaaccattcccagcaaaatgcctgtgctgctaattgcagttacagcagcagcaggaggaggagcatcagaacgtggtgatgagtagccagtagtcttgggcacggcagccgcagccgcagccgcagccgcagccgggagaggcggctcaacgacgtccgatggtttgagcacaagtgctggtgcccgagccggccgcctggctttgtcttggagtgtttgcacgagaccgccgatttcgacagccttcatggaccgaggcttgccatctcccagacccgtacaagagttcactgccagtaaaaattaattattgatgcaaccatatccaggtttaattatagttgttaatttttttttctttccttttagctaatttatttcaacttgaaattaggtctggatatatatacatacatgcatacacacacacacacacacacacacatatatatatatatatatatatatatatattatatgacgaaccatatacataacaaataaattaaatatatatatagtataatggtactgcttacttacttttgtatcttctgactgtcttggggaaatcagttatgatgccatcaatatgaaccagagaagaacgtagttattgatttccaccgttgtttcatctgagaagaaatcccagggtgatgatacaaactcattccggaatacctgggcatacacagctaaccgccccgcagactgcagttctttcacgagattggttttccttacaatgaaaccactgctctcaacaaacacggatttcctatcaacataacagcttcagcgaatttattgatctctgccaccgatgaatcagaagcatcctcaatgtttaacgggagcgtgtaaacaagtttgtactgtgttttctgatgcttcagtttgaccagaacagcactgtgtctagactggatcataacctccttgttcgtgcactggtggagaaaccatctttggtcggtcgcccgaaatccacaatag

SEQ ID NO: 18183 - DNA, 742 bp, Oryza sativa
ttccatctttggtcatttgaatggaacagtcaataacatcggcaccatccctaactgcattctcataggccagatccgtacaacccggataatctccactaccaccattatgtgagataattaatggattccctgttaagaagaaaaaaattaattatatatagcaatccatttaatgtgactgcagcagcaccgggaggtaggttaatttgcaccgaaatgtagcataccgtgatccgttttcctacttgtgttcaaattactgaaacaatctgtgaaaaatgcggattcaaatgattaatacaaagtcaaattcttattttcgtacccaataataataaataacaagtaacacacagtgaatgatgagagcaaaagcaaatcattaagccgcaattttttctcatagtagttcacatgctagctaggataagtgtgttatctgcaaccaattaattagcacgaaataagaagctcataaacttatgactttgtgcatgtacatacagaaaaatataatggaagttccaaaagagataaccaacctcatggttcacaggctagcataattgagggaaaaaaagcaattatcctatctaccaattgggaaataaattaacttatagatgttatcatttttttatgcacaatacaaacgttgatgatatacattatatatataggagcaatgtcagtggtgaatctacgatgtaaattgaggaggggcttatgtacaaaaaat

SEQ ID NO: 18184 - DNA, 2171 bp, Oryza sativa
aattcctgcagcccagattcaccggcgactaacagaccccaaccaccgcatccggctgtatcccgttgccctcttcttccttcagccttcctgaccattgccggcaccgcctcccctctctgttgccgccactgccttctcctctaggccaccggattcagcggccacgggcatatggctgccggatctggccatcgcagtggctaggagcggctggaaacagcggcatgatgcagggagagagatagggacgagtggcgagggcgagatagggtcagtttagacatttcagaccgaaatttcggtcatttcggttccctccgatacgatattattccggccgaagtttttcaattttttaattttttcataaatttgggtaatatttatttaaattcaactaaattttgctcaaaatttcggaaatttcggaccgaaatttctgaaatttcgggatttcggtgacccccgatataaaagcacaaaccgataaagcaaaccctagatagggatgagtggcgatgtgggtgaggtcttttgtttttttttttccttttctcctttgtttttctaccgagagattggcacaaacttaatatagggtactccctccgctttaggtcacaagacattttaactttggtcaaagtgaaactatttcaaatttgactaagtttatataccaatatagtaatatttataataccaaattaatttcattaaatcaataattgaatatattttataataaatttgtcttgggttaaaaatataattttttttctacaaacttagttaatcttcaaaacgtcttataacctgaaacggagggagcagcagttacgttttgacactgatatttgttaccgtattttttaattagtataccatcggtcatattgtgcgaattctttttttaccactttgctagtaaaatatctccattatttttatgttgagaatgctaccgtgactttgaacaccaatattattctttgcatgtgataaattgtttactactatccaaataaaatctctatctctactattataaaaattaaagatgtttccttcaaaattttagtacaccatccgtgtttgagttggttttataatatttatctgaatgtctaatatatcattatacctaatacctataataaaaaataagcaaggatttagtgtatttgatttcgtatgtcatccgtacgtgtctaatccgttgccgcgcgcctccagccgttgctacaccgctcaggccaaaccctaacgccaccgccacatcgatctacctccccgtgagtttttcctctaattaattgcaaaaatcgattctccattcctccctcatccttccccatgatttcctcttttaatttggctttaattcactagatttaatatcaatttaacagtagtgaatgatgcccttccggtagtgaacttccccagctgtttttattccgggttttgtggattcgctccaattttaggaaaaattgagagaagagatcaagtggatcaaaagttctcaatcaattttggaagatcaagaaagattcaacttgatttgatagggattggcaatgtataggcacggaactatcttccgtaagttaagaggcaggcagagtgaatggaggtatgtcttccggaagttaagagaggtagacagagtgaagggatgtaggaggcaacgctttttcaattataatgtatagcgatactgatgtttgatgttttattttaagtatatttcaataaacagacgtaaaatcttgaacaaattacaagaaaaaatatcacaagaaaaacctcgcaaaaacaccacaaacaacagctgagtggatgcaatactaccacaaccaaaccttacgaaaccagctcgctaacaactaaaaccattcattcaaaggtattgcattcactgtttaggcgctgaaaaaaatattagtggatgcaatactaccacaaccaaccttacgaaaccagctcgctaacaactaaaaccattcattcaaaggttttgcatttactgtttaggcgctgagaaaatattatttctatagatcatctccactaatttaaaactactatatccgttctaaaatataagttattttcaccgtatgtgatatgtcctaaaataccaaaagtatcacatccaaata

SEQ ID NO: 18185 - DNA, 10888 bp, Oryza sativa
ttgtgtagcgccacctctcaccactactcgctatgtcatgggtttgatgctcggtcgcaagcatgagttttgaatttggcttaggacacccctagcgaaatgacctcactactacaaaaaccctcatagggaccgggcttgggaccgcgcttataggtgctggttcatttaaaaccgacaactataggcctttcccacattcgcacgccaaaaaaaaataaagaaccggcacctttaaggaagcataagtgccagttcattagctaaaaccggcaccttttctaaaagaactggaacctataatatattatatgtaccagttaattaaaaaccaacacccataatatattagaggtgccggttcttttaaaaaaccagcacatataccataccgagccgagcttacgagccgatcgtgcgccggcttatccatataatagcgcgtcgcctcgatctctcctgtcccttctcgatttctctatctctctctctcgcctctttgtctctctctcgcctctctcacttctctcagtctcagatccggccgggcgacggtggcggtggcggtggccgcgccctccggaggggaggcggcacaccacggtggagcggcggcggccgcgccctcccctccgccagatccggcaggaggggaggcggcgcacctcggtgacggtagcggcggcggccgtcgacagcaggggtggagaaggacgccggtggtgtaggcgaggtggcggcgggcggcttgagttcttgagtgtatgggtttttctatttttgagttcttgagtttttgttgagttcttcctctcttttctcctcctcgatccatgtcccaaatataatgtgaacttgttgttgattgatctattgagttcttttcggctggctgtcggtttgttattgatttggccggccagcaggggtgttctaggggatgatgtgatccgggaggcggtgatgaagggaggagtagggctgggctcgagggagacgacgggtgtatggttggtgagttcggctcgattcgagtcggctctcttttctttttttgctcgagcaaagcaaaaggcgtcggttctatattcatcataggtgccggctgttagtattggtgccgaccgataggtgccagttaggaaaccagcatgtatagccggttccaaatcggcacctatgatgatttctgtactagtgcctagattattccgagcacttcgcacatcagagaaacatataaaaatgtgtggtggagaatgcgctaacgtgcaacggcttttgcgctagttgctcaaaaaaatcgtacaaaatttaagcaatcagggttttttttaggggtgtgtgtggagaaaaaaaaggccaagaaggccatttttcagagctatacggcatgtttgggtaggtttaggtagtttcataactagaccgatttgaaacgtgaaatatcgtgttttttgagcataagtatgtctttgcctctacctgcacgcgcatgtgatgtacacatgcgtatgcgcatgtgttctattggcgcacatatgcgttaaagatacattcaaaaagtcacaagaaaatgtgaaaatcattttagatgtgcaacaccataaaaaaataaactcaaaattcgatgtgaatgcgaagaaaaaaagacaaaatcgtgctcaaaaaagtattcaaacaattaacattactattcacatcagatttgtttttttttctcaacttctacatcgaattttgagggggggtttttcgtgcgaaagtacatatcctattgcgtatcgtggttttttgtcatatttttttatgacttcttaatgtatttttttttagtttggtagcatgtatagcacaacactcttggattgcacctgagattctctccttcacgtagagcagctggccttaatttgtctggcctccgcgcgtaacacatgagcccgaaacgtatatcaatcgggtgtcgactttataaaaaaaatgtttcagcacattaaaaaaatgtctcagcagtaaagatgatgaaacataaccgaagcacacttaatcactctgctgcgatatatgaaacattgattttgaaccattgaaacatcgacaaacccgtgcacattaaagataaaaatatgaaacactatcaaaatatccactataacatttgatccaaacacaaagaaccatcacgagtacagtagctaaaacacacacaaaaaaaaaatattataccctatcttcgttgcttcttccttctctccggtgaacacagggttatcgagggccaccgactcggtgttctcctccggtcttcgcgggggccatcagcgtcgcgggagaagaggacgtagctgtcgaggatatcatcatggcgccagagatccggggacaacgggaggaaggggcaggtgaagtcgacgatgtcatgttcggcagcggagcaagggtagggcagctacacggggatgaagctgccatctatgttgaggaagccgagcagcggtggtgggtggttgacggcatggatctggcggagaaaggagagctcggtgatgatgcggcgaaagctagcgcgggtggtggcagtgcaagcgagttcaacgggggaaaggaggcgatgcggaatgggtagctgagaaggtgcatgatatttagttaggcatccaacacccgagcctaatcgctttcgactttgagccatgtatcagttcttgataggaagaagaaattttagccatttacctaaacaatatgcaatcggagaagatactgcaaaatagcgtgtacatgcatcctatatatccccattaagtgtagttaatgctaattctctcctctcataaaaccacgtcacctcaattgtttttagtatttggatgattcatcaagtatgtaaattgcatctcttgacatgacctcaactgtttttagccgttggatgattcattcagggtataaattgcatcccttcccccaaaaggcacaccatacaactagtcatttataacctttggataattgataaaagtataaaaatagataaacatataaaaaaaatcgtatagtaggtaagaaagaaaattttagaactcatatatagtatattatcacacaattctcccgtagcaacacgctgggtatccatctagtttaatagaaagcacacctcaaaggcatatgccccaattcctctcatgtttttcctattcccttgcccttcttccgtcccctctgtcccccttcttactgttttattacattctgtacacctgaaatcattattccaacatagtagatgatttgttcagactttttagcattacctcaaaaaagtatgcacataatataccgtggtatatagtccaactgacctttttctacctacatagctacataggtgttagcgtgcgcggcgtggcaccgcgctcacatttctagttacaattcaagatgtggttccagcttcatgttaagatgagggaacagaggtgaacttattaaataaaatctccaacgtcgggaaattatgtggacacacgagcgcacgacaacgaattggtcgctggaacaaacattatgcgctgcaatcctcgttttccaaacgcatctgggatcattttctacgtggatttcccctaggaaatttccacctccaattttaccaaaataaccctcagagaaattggagcccacgggggtattctccccaaatttaccctcacagaaatttgggcatattagtaaattaacaagagacggcccgacccgaccgaggagctaaccacagctcggctctggcccatataccggcccattaaacagtaacccctcgtttccatctgatcacgttctcccaccagccgccgccgccgccgccgacgaccgcctccaacacctcaaagccgccgccgacgatggctcgttcgaagcgggcctggagagccccgaaggtgccgaggagggagatggcagagaagtccttcttctgcccctactgcgtgaaacagatcaaggctgacctgatcaggggaagcgaacactccaagaggtgcaaagcgatacgagacaagcaggtcgcggagagggcgagggaggaggcggcgctccgccaagccgccgaagagctgcgcaccgccggcaagaccagcaccggcagcggcggatcgaccccggccggcccatccagccccaacatcaaaaagtgagcagaggtaataataagctactactgctggagatgattatatgatattagcaatatttttctgcatctcagtcttgagcatgtgcgaattgtttaattttgtctgccattgttaacaaccctcttcctccaaactaattgttctcaagaacaatagaattcaatacaaactcagagaatagaagagaaattgagtgagaagaagtagaggaagcttctagaaatggcagtgaagaggaacacgagagagtaagaaagagatagagatcgacgaggttcaaccgaaccaagccgccgccgtggccgaagccgctgatgcctgatctgttcgttgcttgaagttctcctgctgctgccttttgtatccctctcctttgtttgtttggcccttggcatggattagcaattgagtcagcccatgtgcagcccaatgggttcctgacaatctcctctccttgaaactgacttgtccataagttgatgacaagtaaacttcagaaatggcaaacctccactttgatttctctagtattcttgcatcgttccaaaagcttcattaatgtccaatttgttttcagcgtgccaacagaaaacttgcatctcaaaagaacagctcaagcaaatcctggcacttcgcatgtgaaagagagaactgtcttgcaatgagaatttgactgcctgaaatgtgatttgtccaagagaagagatagctagaaacttgagtaaacataaaccaccaggatcccatggcatttgtagatcaggtgcactaagacacaattcatccatttgatttacacagcctctgaacatattttgaatgaacaggccacatctttcatcttgctggatcagattcttccaagttttcatccaagatatccataggcgccgcaagcttgtttgacactgatcagaaagaccatacaacagaactgtaatttccacacagacccataattccaatactgtagtggcaatggtatagagttggtaaatgaggtacttgctgcaatggtgacaaccctgccactgcccttacttttgataaaactagtactttgataaacccaaactgtagcgaactcctctttgtggaatatcaattgttcatacaagaattcttggcccatagtattcaaccagtacacatctacttcaccatcttcaagtgttattttgtatgataatttgcagctctctgttatagtccaatccgcactaattaaataggtagcactagaagtagcttctgattgcatcaatttatagccagtgggcttctgccataattccattgagagcaaagtatacaactcgaaccaattctgagaagaatcactatatgttttttatttaaatttcctttcccagcaaacctcataggatgtcatgttcgatctccttcgctgcataaaactcaccacccaacaattctcctttaccacaaaataactgtagatacttccaaacttctctagcagaaagcagcgaacagcccgaagaccacaatattcttctcacataattccagctcatccaactaggaaccatagagaaatcttctcacataatgttctttgttatgttacccaactgtatatgattttatatgttatttgcttgcaggtaattgctaagatgatcagagggagaccatcagacagatgagaaatgatggaataaatgataaactacatactgcagttgattactttcttataatctcataatgcaatttaggaattatttgaactctcaccatgttacctataatcaatgtttctgtactccatggcattactttgcgtaattcgacgacttactttgtgtgatttgggaactatttgtgtagtttgctatatgattaaatgctagcaacattcagatgaattaacaagccttaccattgcatatctatttgtgttcttgccacgtagcatcacatgaaaaggagttccgtgatgattggacaacctggcaaaattaattaaagatatgtcattagatcatgtcaattcatataagaaagacattgcaggttaaagtaaaaacatattaggagtttgacagttcggagaccagatttaaacgaccttcaaggtaatctattgaagggaaatcatcagtgctaagggtgttttgggcaaaagaattctatagatatttcatacggattggtcaagtttgttcgacatccattttctcacacttgtataaattagtaaacccaacttaggcaaaaaaaaaactcatgtaaaccccgatcaaaaagttgtttaatttcaccataaaaatcacacatgtagatgagacgattttacataatcttgtaaaaattctcctaaaaactatactaaatttcaaacataacaaaagttttacataatcttgtaaaaattcttttaaaaactgtactaaatttcaaacataacaaaagtttgaaatttgttatttttgtaactcataaaagttgagtttagacaagatctttatacatggttatataacctcatctcatttgcatgtgtaattttttaatataaatttagacgacttgttggtcggggtttatatgagttttcatttaagttcgatttccaacgcatatttacccttcctacacttgcaggttggtgtctcgcaacttaatcaaggtcaatataatttgaccgtatgcaatcattactaccgtgatctgtgtggttcagtggtgactaattcgtcctaaatttaagctatgtacttactccaaaaagattcaaatcctaggatttaaatcttgttgataggagtagacagttctaatatggaaaactacacacgcagacagtaaaattttattgaacccattcgacaatatttcatgaaaaaaaacatgtactactttgttttatattataagtcatttgactttttctctaatcaaactagcttatatgaaaatttaacaacacctaaaatatcaaattagttttattagttctcacattgaatatattttagtaatatatttgttttgtctttgaaatagtactatatttaagaaaaaagtcacaacttataatatttaacaacatctaaaatatcaaattagttttattaaatatcacacattgaatatatttgttttgtctttaaaatagtactatattaaagaaaaaagtcaccacttataatatgaaacaaaaagagtacattataattacgaaaactctttgatctatctatttgagttgtgtttatcttacaaaatgaggcagcatagagatccgatcacttattagaactcacctccattgttaacaacgacttgtctgtgcacggtgctggcaaataatatggacatgaaaggaaaatattctccaacttgtaagatgaacatgctttcaaaatccttgtgcgcgagcaaaatccgcatgataaatacagaacaatagaatgaccatctccattttagttcactctgtaataacacttgtatattgccagtgatatgccaacaaaatataatgacaacttccaataaagtccgaacagcatgatgcttctcaagccacagaaatacggatctctggacctacaaatcacgccatataatgattataatcactttgtaattctctcgcctaatgaccatcccgactgagattcaggtcccgaaacttcaatcatcgcacgtcctcattctcttcaagtccaaatcctctcgaaaaaatagtccccttcaaatcaaatactctcgacaaaaaaaaaagagttgacctcatgaggctgcagagaacatttgcagagtgatgattagactaaaagaaaataaatcttgacgaacagagttgcccggaatcaaattaaagatcttaccatcaccaatcgcaggcggatgtcatatgcgacaagaccataccggcggaaaagccggcgcctttggccgctccaacaagcgcacggtcgctatccatcggaagaacagcatacagagcttttcctctctatcttgagaaaataaatcgtttatacatacaaggaaaaaaaagagaaaacagagacaagaatcaaataaccgtcaccggatacatccggcgaagaaaagccgccgccgccgccggccggcgaggagatcgatttccacttctccagcgcaccggccggcgccggacactctcccccacggcgagagcagaacaccatcccccgacgtcgcggatccggtgtgccagccttccagagagccgaatcgacgggggctggccggccggggagagtaccccggtggcggcggcggcggcgccgatctagggtttgccgggaggaaaaagaaaaagctttttctttcttcgcagggggagagtacgacgctatgcaaaggataggaagattagatgtggcgacaggcttttgcgatttattgcgagccacaagggcgtcatgcaccggtgcacgcggtgcacagaatcgatgcgagtgggccgagttggatccggtgacgcggtccatgagcctggtgtacgccacaaaactgccatcaatctcacaggcgaatccaatgtttgtaggcaaccacgtttgtagacaaattagaaaattaccgagagaaaaaaaaaaggtaattttggatagtactttctctctttttcttttgtgaaatgatgattagaggttttagaaacttttcctatgctacctcctctcattctaagtgcatctatgtgtccaacatttaatcatatttgaatgaattttttttattattagcaaaaatgaccgtgcgttgccacagaaagaaaaaaaagagaaaattgaattaaaacatattaaattctaattaaataaaatacaaattttctaaaatatttgggtatttttaagtaggtaggtatataattaaactaatttacaaataaagtaagcgtcagaaataaaatgatatggttggatttaatttttattaaattatccatattaattacactttttgaaattttcttggaatttacataacttaattactaattttgataatacaaacatcattttaggatttatttaaatactagcaaaaatgcccgtgcgttgctacgggtaaacaatttcatacttttaaagtatatttcatgataaaacaaattacaataaaataattaataattatatgtacttatactatatttcttgataaaacaaatcacaaaataattgaatcctaacgttcacaggtctctcacttaagcatcaaatatttctaaacaatcaagaatttttggggaaaaaaagtggcacgaactgagactagagctagacgattcattaatcgaacaatcctttccttgcatcctcttatttacctccaagcagctagccaagttcagttttgctacctcttatctcgcccagcacctcccctccctccctctcccgtgtaggcctcttggcccaagaggcccagcccgcccaagtttgtttttgtccctcccaagttgccaggtgggccctcactacagtgtcgtcttaagctcgtgaccaggctggacttcgccatcgtcaccatctcctcaagaaacataccagcgacctaccccaggcagtggcgcgtgcgtgacgaaaaaccgagcgtatcaaatacaatctgactatggacctctcaaggtccatctgttccggtgccaatgggttaggttgactggtggaggcgtaacgattgataacagtgggatgacaacggttgaccttaacaaggttggatactcggacgaaccttttgtccttgtcaatgatgtaacgcaagttttttacgtgaaggacatgtctagcaaaggaaagaagggcaaagggcctgacgagccgaagcgccacgtggttctcccaggcaaaagaaaaatcgtcggagtagagaacaagactgatgaggattacgatcagtttgatgggcaaccccctttcacggtgacggttgaccctagcatcctcctatcaaacgaagacaccccttactcacgtagcgatcacaaggaaggaacgataatgaggagaaagtatgtgcggacaaccgtcaccaccgatctattgccgtaattgttgtaacctattttggatgtattgaatatgctagttatatatgattaattacaatttttaacaatttaatatcatgcatatactaattatatacgattattagaatttttaaaagttttaaatcatgcatgtgggatttacatatgttaattacaatttttaacaatttaatatcatgcatatgctaattatatacgattattagaatttttaaaagttttaaatcatgcatgtggtatttacatatgttagttacaatttttaacaatttaatatcatgcatatgctaattatatacggttattagaatttttaaaagttttaaatcatgcatgtgggatttacatatgttagttagaatttttaacaatttaatatcatgcatatgctaattatatatgattattagaattttttaaagttttaaatcatgcatgtgggattaaatatgttaattagaatttttaatgcattattttctattttagaaacacatatgcaacgaaattcaatattcagtgctattaactttagtcccggttcttaaccctaaccgggtttaaaaaagaatttggaaatagcgggaaaatatctttactcccagttggtgag

SEQ ID NO: 18186 - DNA, 9409 bp, Oryza sativa
attcctgcacccccgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccagatggtctacaccaggactggcaaccgcacgacaggcgagggcagcaacggcgaagaacgcgctgatggtgtgcaccccaacagtgattctggcaatggtccgccaccacttcccgagaacccgaccctggcccaagttatggcgcatcagactcagatgatggcagccatgatgcagcagatgcagcagcagcaccagcagatgcaccagaggatgatgcagtacgctgaacagcagcaccagcagtttggtccccctcccccgcaatccaagttgcctgagttcctgcgagtcaggccacccaccttctccagcaccaccaaccccatggaggcaaacgactggctccatgcaatagagaagaagctgaatctcctgcagtgcaatgatcaggagaaggtcgctttcgccacacaccagcttcagggtcctgcgtccgcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaacaggacggtgacagagtacctccacgagttcaatcgcctcgcgcgatatgcaccggaggatgtccgcactgacgccgagaaacaagaaaagtttatggcaggcctggatgacgagctgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcctggacagcagggtggacctaccaccatgatcgtccgtcagcaccgcccgttccactctggcaacttccaccagggcgctagcggcagtcagaaccaccagggaggccagcccaaccgcggtgcagctccacgcccaccaatggcaccagcacagtcagcccagcccgcgcaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgtggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggacaccgtttctagccaacctcatccttctcgactccaaaggcctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcagaggtcaagaagcaagttgacgaacagctgcagaaagggtacattcgacccagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttttggacaagtttgttgtggtattcatcgacaacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttaccaagtggaccccaccgaagacagtgtcgcagattcgaagttttctaggactggctggttattaccgtcgtttcatcggaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgcgtcctaatgcaagagggcagagtggttgcatatgcctcgcggcagttgcgtccacacgaaggaaattatccaactcatgacttggaattggcagcagtggtccatgctttgaagatctggaggcactatctgatcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaagctcgggatttccacgaggatgagcatggcacaatctggatgggagaaagattgtgtgtaccggacgacaaggaattgaaggatctgatactcaccgaagctcatcagacccagtactccattcacccaggcagcaccaaaatgtaccaagaccttaaagaaaaattttggtgggtcagcatgagaagggaaatagctgaattcgtcgcactctgcgatgtttgccaacgagtgaaagcagagcaccaaagaccagcaggtttactccaacctctccaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcttgggacaaaagcttaccatatgcggaattctcgtacaacaacagctaccaggccagtctacagatggcaccgtttgaagctctatacggccggaagtgccgcacaccgcttttctgggatcagacaggcgaacgtcaactgttcggaacagaagtattagcggaagcagaagagaaagtcagaatcatcagggaaaggttgaggattgctcagtctcgacagaagagctacgcggataaccgccgaagggagctcacttttgaggcaggagattacgtgtatcttcgtgtcaccccgctccggggagtacaccgctttcagacaaaaggcaagttggcaccacgcttcgtgggaccatacaaaattttggaacgaagaggagaagttgcctatcaactagaacttccgtccaacatgatcggcatccatgacgtgttccacgtatcccaattaaagaagtgtttaagggtacctgaagaacaggctgattcggaacacattgatatccaggaggacctaacatatgtggagaagccggttcgtatacttgacactagcgaaaggagaaccagaaataaggtcaccaggttttgccgtgttcagtggagccatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctccctagtcaaaattgcaatttataattgaccccaagaaaatgcagaggaaatcaggataaaaccctaagaaaacaatgcaaataataatcggatttgacatgtggaatttttcttgaattctacatgtcgaaattcattaacaggatttttagtggaattttcagagccctagaaataattttaaccaattaaaaatcactaaagtgcaattgttaattccagggaaaatcctttttctttttctttttcctttttccccttttttccctcctttttgtccaatgggccgtcggcccatttctctttttcctccccctcctctctgttgggccggcgcaggccgaggcccagcccgacagccggccgcccgcccgcctcctctcggggtcgccgacaggtggggcccacctgtcggacccgtctccctcctcccgccgatcccgctcgtgccgccgccgccgcaaccgacgccgcgcccacgtctccgccttccccgggccacgtcgaccacgcccgcgcgtgcgccgcattccccgcgcccgttcccctctctctcccactcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagccccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggaaccccctccccacgtgcacgggtgagcgtcacctctaccgccgccttcggccatggatcccgatcgccatggtccatctctctctctctaatccctctcttctccttccttagggcacgccggagctcgtccgctagccgacgccgtcctcccgtggcttgccgtcgccgtccgccatcgccttcctccgcgccggccaccctcggtgaggcatcccctccctccttttccccttcctctcctcctagagccgctagccgccgctctccgccgccggacgatcgccgtcggtcgttgctttgcgccgctgccgcatgcgcgccgccgccgtgtgagcgccgcgccgccggcgccatggtcgccgctgtctcgcgccgcgcccgcgcgccccggccgcgaggtcccgcgccgccgtccgatctacccttgggtagatcggggccgtcggttcggccgccacgtggcgccgccgcccctcctttccccgtgccgctgaccggtgggcccgcgcgccgccacccccttcctctctctcccggtcgctgaccggtgggccccgcctgtcggcgccgagccgcgccccctcgctgacgtcagccctggttaatattgcgcaataaaatatttaaggatttcttttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgctttgtatgtcgctagattccgatctctccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaattatactatgggatggttacctattgttacagctatgccttttgataccatgctcctttgttagcttgggttataacatgattagattttggactaggaattgcttagccatgcttagttcaactagcacacattggggatctcatttaaaacctagactataggtttatatgataatgttggtttaataccaccgctctggtgttgggtaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttctgtaagacctttataatgtttgtaagacgaggatctgtatgtcaacattgtcgtttgtgtaccccggctggtcctggacgggggttttaatacacattctgcttggaattctattcgggaatttctgggtgtgacaagttggtatcagagccaggttgaccgtaggacaagccgaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgggtcagtctagggttttagtaaaggtattggcatttattcgtcagtcagttggggtttgaggggtgaaatgcattaggtcctagctcaggaatttgggttgcaaggtgtttatgcttcgtttgctattattaatatgtatctaatttctcattattttgacgttgtgtgagtctgtcttatttaatcgctctcatgcaaaatgatctatgcataaaatttcgctcttatttgattcccttatttgagtcctttattgctttatttaaatttggatttgagcatgcattgatcctactcctttgtcttctctagatggccggtcacccacccaaccaccgcggagaaggcatgatcgactttgttgcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacgacacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctcatgaggatcgtcgctctgaaggacgagatagcgcgtctgaagaaggagaacgctcagct

SEQ ID NO: 18187 - DNA, 13646 bp, Oryza sativa
cgtcggtccttcctcttctgacgtaacgcaagcgtctaagtcgtagctatagatagagagcaaatgaattgtactatacatgcatgtgtatatatatatatatatatatatatatatatatatatatatatatatatatatatatatatatatgtacgtacatttactttagtgttaatatatattttggtaacatatatgtacataaaaatgttaagtgctttaaattataaatatgtgtgtaatatatgtatttatacatatatacatacgcgcatatatatatatatatatatatatataatcaaccatgcagcaaacagggccatgcaaataaaaaaaatggtacatagatctttagtcccggttggtcacaaccgggactaaagatggattagccggccacatggctgaccgatctttagtcccggttcgtgttaccaaccgggactaaagatcgatctttagtcccggattcgtagtcctggttggacaaccgggactaaatggggttacgaaccgggactacaaacgatttctccaccggtgcatattctcgagaatttcatttatcttatagcatttattggccatgtgcttatatattgttttttatagagtgtggactgtttcatttttaaaaaaaggagggtctgttgggctgaggctgttcctgacaatggaaacgctcgaaagcggctgtattggtttatggactccaacacattcatcttgacctgcacgaggtcaggtcaacctgttatcagtccgtgttgatcagatcatcaccactgggtttcctcagctcatcggcatttttcctaacagagggttgcgaagggtacctgcgaaaatcgattgtattgtagtgtccatcctaaaatataatatagtaatatattattaaattaggcaaaacaataaaatttgaataggtctattaagattcgtagacgtttaaatttatagtactactccctccttccaaaaatctgagaaatattttattctttgatttttctaaaaatcgaagtcttatttgtagtcactatgtgctaaattaaattgttgatcggaaacaaaaagtcattctaatacttattgcttgcatgtttattggttttgccactttgttgcatgaatgagttaattgcttattgatattgatgaaaaagaaataggtgtcagattttttgaaggaaggagtatttaagatggatagagtacttgctatgtagctccaaaaacagccacaaatgaaattaaggtggcaattgacctttgagtcaacttgccatgccatttcattttctactccaccatggctctttgatattctatgttgggccacccggccaacacgacgctcctcactttgaacaaatcaaacttgtgtgcaatcactattaattattagtctatcgatcgtactccctccattcacacaacaaccctatactcaaagaccaagaaacgattattattacctctttgtttaaataatcccaactaatactatacatgcacccaataaaattaagtatcttgatttaaaaattaataatctaggtgagagaatttgctattaattgtcatacatatatgcacgccttatattatgaaacacctttaaaaagtagttgcaccctatattttgaaacggagggagtatctaatattctcaagctggaggcaatcctattagctcattggagtgagccacaccaccacagactccaatttttattattttttgatcatggcccacgtaggatctacgcggctaccaatatttctctttttttaattcggagtttcaattatttataaattgtatcctactctagactttttttcaattatttcttttttaattcagaattttagttatttataaattatatttctatatggactctaaattctatttttaattttcttatttttttaatttatgtctttcagctagttctaaattccaatatagacagtaaatttttctaccaagattcctactttttaattttgaatttccgttatttttaattgtatttttatatggcctctaaactaatcttacaatattcctttttttaattccaaattcatttattaataaattatattcatgtatggactctattcttacttttccaatattccttttctattcctaatttcagttgcttctaaattgtattcctatatgtactcaagactcttctcctaatcttgcttattttttaaatttttaattttaattatgaccaaattgtacttttatatgtactccaaactatacttttatttttcttattatttaattttgtctttctgatagttctaaattcctatattgactcatctagactcttctttcaattttctattttctattgtaattactgccaaggctttgcctcgctatgtgattttcattaaaaggaaaagtatttactaaagacaattacaaggtgagcactcaaatattacaaaggttgtaaccaatcaaaaactatttgctttaaaggatctttcattctgcatatatgcaatagaacttctttcttgaacaagattctccaggcttcaaaacatggttgctcattccgaaatatcatttcatttctctctttccaaaaatatgccaggcaacaataaatttttttatattttcagttccaaatatccgttatttctaattgtatttctatatggattctaaactcatcttttaatatttctatttttttaattttgaatattagttttttctatattattttctatatggactattgacttttcttccaataattttttttaatttttaattttatttatttataaattatatttctactagaaaagatgcccgtgcgttgcaacgggtagagccaatttaatttatacatatgtatcggtggaaaaataatcacagcccattgtttcgtctagtcatgtgcttacccgaatcacttattatcaaataaaagactatttgtgtgtaaataagttctaaaatttaaaatttagcttataggaataagcataagccaaacaataaggccttcaaacacgagctcgatttgttgtccagctttatctcaagttgggcaggaattgataatggacggaatcagcaactttgatcatccttatttcagttggcatgttctttttgaaagtaaaattgattattacagattattgtaacggcatccctggtagtacgtacgatcatgtgtggagactgacttgaaatcatgctaacatatcctagaaatcgtgtcttataatacgaatagaattggatgatctgagcaactatgtatgtgatatccacacggattctgtgagtatcattcgcttggtatccacatcacacgaactctctctcgcagttcactcacgagtccactacaagagatcttatgataggtgacgtttcatttacatcacaaacgctgaatgttacgtcatgttgtgaaatctgtgacgctcacgtgacgaaaattcattcgtcacctatcatgtgtctctaatggcgttctatgacgaaaccttatttttttgtcattaatctagtgacgattcttctatcgtcataaagttatgacgtctattttcgtcactatcaaacccaaaaatcgtcatgatattccatgtggcctgttaaggcccatgtagtgagcaacctatttttaggctaggccttgtgaaagcccatgcagtgagaaacctattaatgggctaggcctattgtaagctcaattagattttaataaattcagcccaattcatctatattgaattaaatattgaacaggccatacacattcaaaaggcccaatcattgcaatgaaattgcatctgggccatgcacactcgagaaacccatatatcaatcaaatttgaaattactcgagaaaactattaatgaaattactttgaattgaatgttacgtgtgacgggaatcagatacggacgacgtaccatagttttgaaaaaaaacatcttcagatacgggcgagggcgacacaatctcaatcgaacaagcggcaaaggcaaatcgcgcacgcgagggcgtcgcgggcctaatctggcatgcagaaaatcacgggcatgagggcattgcgtgtggcaagggacacgtgaaaagcgcaggcccaattaattcacgcatgtctcggataagagggacactttgacataagataaaaggaaaggatttgacataaacattaaattaaaactaattaaaattaaaactaaaacataaaatgaaaatcgattcaaacacaaataacgtatcaaatttttaggggaaacatttttaatttttataatagtagatatggagatagagatatggatagatgaaaaaaggtcaccacgtcatctgaaggatggaattgaaggatgacgtgggacctgggacatgggccaggatacaatcgatttggggcctgcatgcaatagatccaacgcgtgggaaggaaatcatacggaaaaaaaaatcgatctcaatgaaccgcgatatacccgtacgcggggtagaaagaaaagggaagaaaaataactgcgcgcgtggatagagtccgacaacgtacgaaatattttttttgacaaaaacatcttaaacttttataatagataaagatatggattatggcttctacttttaatttatttataattccgaatttcaattagttggaaattgtatacttgtatagactctagtctcctctttcaatatttcttatcttgaactccaaatttttattatttttgaattgtatttctatatagactctatgtttttttttctccgtattctaaattatattctatacggactatagacttttcttccaacattctttattttttaatttcaaatttatttatttataaattgtatttctatatggacttgtcttctacttttatttttcttattttttaattctgaattcaattggttgtacactgtatacttgtatggacaatatcctcttacaatattccttatatttaattccgaatttttactatttttaaattctatctctatatggattctttttttcctcttctccgattaatatgagaatttctaggccgtgggagcgaacgtagatgcttctttttctatttatttaatatgttaatagatttctagttttgaaaatctaaaattctgacgctggtggaaattctctaacttatcatatcatatcttactataaagttaatatccgctaactcctaaagctcatgtcacatcatcacccactagcaattattatttagagtattttaaatcacatgcaagtgtactatatcatcactcactagcaattattatctagagtattttaaatatcacacaaacatgacatatcatttacaaatgttgtattttagaactcaatatgcaaacaatatcaaatcattatctctacatatcattttatattatttaaacatatatatctaccatttctataacgtataatatgtatttatctatatatcccgcaacaaagtgaagggtatgatcaactagttgggggtgagccacacgaccattcgtctgatgacaggtatcatcataggtcctcgcggactccaaatttttattattttttatcattttaatttttaattttaaaaataaactatcgtaaaacttatctaaaataagaaactttgagccatgccatcccgcctgacgtggcgaaacaacactaccacgtcaaccataatggacatgacaattttgttttaccacatcagctatgatggtgcagttaattgttgtgcaggttacatcattatggtcaaataatgttgtcatggtagctagaccggtgtgacaatattgttttgtcatgctattctagctggtgttgtcatgttttgagttgaaatagattctgaaagagattgtttttaaattatataggttagaaaaattcgcaagctcccacgtacctcctagttggccacacaggcaaccgaaagcaaattacgtaggacgtcggatcttcgtcaatccaaaaaatgactccactcctgctgacaagaactcgtactactacaaaaatcagtttcgctggcggccaaaatgtattttcgctagtgagttgccgccaccggatctgccctccgcgcacctcgttgccgccggacctgcagcctcgcgagttgccgccgccggatccgccctccgcgcgcctcgttcccgccggactggctgccccatgagtcgtcaccgccagaacccccgcgtcacgagttgttgctgctggacaccacccctcgcgagtcgcattgccgccggatctgctgccccgtcttggcgaagctccgccgccacccgtggacgccgccgccaatggggaaggaggagaggggcgcgcgcctatagactccgacaggcgcatgtagggaaggaggaaggggaggaggggggggggagaaggagacttggagagggcgggggtcagtggagacttccagagggtgagggtgtgcagacttttaatattgttgtagtttttcactgcagtgctctttggtggccgctagcgaaaatcgatttttgttgacggtcacttaagtggtccacctgtaaaatagggctatttttaatggcggatctcttaagataaccacttgcgaaaatagattttcaatgacggtcactaactaggaacctcctgctgtattttcaatggtgttttctattttagccgtcagcaaattaaaacgtgtggcactaggaaaatttttttttcagtagcgtcgtctcctacatcaacttactgataaattacgtagggaacatgaattttcccttgggtgcaaaaataccacttccatcttgaaccgttagatctaggatatccgtgcaagatcaagttcctccatctgtcatcgcacattttgcaaaaagttgccagccatcaaagaatgttatgcattttactccatgtagcttatagttggccaaaatgcccgacggcctggcccatagcacgaggtttgctcccagcccaaacacgataaagcccgaccggtgggctgtaaccgggcctctgtctcggcacagtgggctggcctggcacagtccaaagatcagagaggtaaaatagatgatggagccaaaatagacttattccagccataaccaaaagagtgcggaatgtaaaatatacttattacagccatataagagatgacccaaagagatgagggatgcaaaatagaatttttcaaaggaggagcacagtgggctttcgtaccttcaagccaacgccgcacgtcttattgggccgtgcctaggccaatggttcagcaagtgggctagaacggcccggcccagcgcgtaggacgggccgtgccggccggactgatgtcgacttggccatctatagtgtagctttctcttcctccattcttctgttcgagtaaaaagaaatcacagtgctaaattaatttgggagtgtattatttactacagttgatgaaccggccttaaaaacacttggttgagtaaaagaattacctatctatctatacctatattaattgggcaatttctacgagccataattagaaatatctggctatcgattccatagattaaagcatcatgaccgtatattaggtaccgtgggctctgtacagcccaatcatatctaggttagacctaaccttacataggtttgcccatattaatgtattgatctcatcccttacgtgaggacttccttcacctcctatccgttccgctagcatggccgcgcggagatcgcgacgagcggacttatttcatcccgtcgggtccttctgctcgcaaggccggtcaaagatcgcgacacgacggaagacgtcgagcagcgcatgcacgaagacgaggtagacgtgcagccaggctcacgcacgcagcgaaggtaagctgtccaacaatttttggtatttacctcatctgatcttattataaattttatgtattgagatgttgatttacaaagtttgcttgccccaaataagtccatccgtggtcagtgactaattgcagttaaaaagttccattgtagacaccgtacatcctctagtagtattaggcacttgctttaataattatagcagcagataatattgagaaaataaaacgcgaggcacaatgatataccgtttagtctattttcttaacgtgcttttcttaatatagatctgtttttaactttttatcccatgattaattctaaccctacagaatattacttaattaggtagacaggatttaaggccactaacatgatacaaaagacaccgacacaaaatacaacttgatgcaaatcatgggaaaactatatgactgactacaaaacaaattcaactttatattcataaactaagacttctgaaattattaaaccatgaaaaagttataattgagatgaaactaattaattatcacacaatatttgtgcaattattagattatgataatctataatcaagacaacaatctacagtataaatcttggtataataattctaaagttttgaattgaataaagggggaaaatacgaattttgatatgttgttaaatcacgaaattataataattaagcctgcaaactaatggtacgttgttaaatcacgaaattataataattaagcctgcaaactaatggtatatcgggtatattagttctcaaattctaaattagactaaggaaaattgtttcataacttgatactattaaagcaagaatttgtataactgagactgcatactaaggtattccagtatattagttctaaaattttgagttaagttaataacgataacaaatagagagttcaatgtgagaataaatggtacttctgaattcggaattctaaagtttaagttaatacatatttacattttgctatgctaattgggcactccacaggagtttctacattaaacaagcagatttggatgcacaataataatagcccgtgcaacgcaagggttggtgagtaagtaaaaaaacctaccttactgtccttacgtgagtcaaaaaaaaattgcacactgttaagttcgggagtaaaaaaggtactacagctgatgagttggactaaaaatatttcacgtagatgaaacgttggagtaaaagaattacaaatatttcaatctagagagtaaaaacatacatagaggacaataaagaggaaaaggaaaaatggccaccagagggccaccgtccatgagcatggccatgtaggcatcgccgtgtcagagatgtttgcggcgagccattgacaccaaattcgatattggagatgagcgaaccaagccaccggcaccaatgggaactgctggcgtggaggatgggtgagggaagctgccggtataaggggaagtgcgaggtaggcaattccatcgatggcaatgagtgggaacaactaatctgtcgatgcaaggggacatgaccgaaggtgacagggatggtcgttaggcaacagaacgtgcgactcttgatcctctcgcacgtaggtaggcaattccatcgatggcaatgagtgggaacgactaatctgtcgatgcaaggggacatgaccgaaggtgacagggatggtcgtcaggcaacagaacgtgcaactcttgatcctctcgcacgtacgttagcgagagtaagagggacagaggaaatggaagcaagagggactaaaacgaaaatacttctagtggaggtggtggctttttgcaaaatatgtggtgggaatgaagagctcagggcttatttggttgctaccctagcctaggggctctcgctcaggcaggtcaatccacctgcagacgcacaaaatcggatgcctgagagctgcactgagtcaggcgagatttctatggcacgaagcaaacaggccctcaatctgggccatacatgataaatcgatccaacaatggagaatggtagttgcattattgcatcaattggtgctattgcacatgatactcattcttttcccttcaatcctctctcgatccgctccccgcttccctcttttctcggttagaacccgaatctccagtgggaaacatgctccacctccgggagagaatttactatttgccatcctcccatatgcacatatatccaaacatcactctccctaattttcattctcatttgtcatccggtcccacatctcatttgcccaaatagggaacgaggttgacatgtggactcggatggcaaatatctctatatatctaaatccacgcagattagcgtgcgattagcgaggccacatggtgctgcgtggttcgtgcatacgcttttcccgcgaagggctaaaatataaaatatgatcttgtgaaggagtaaaatgtaaaaacgttagcctctcgtcttctcccgaaggttcgaactcatgcctcttccccttccaatcgttctcatctcgacgcctcccttttccggtaacggtgccagcgagccgacggtagggatcccagcctacggcggagcaagagaagaacggcgacaaacatcccgtccacgctctcgtccaccgacggtggcacggtggagactcgtccgatgtcgcagacgaaggcgtggtgatcgaccgcctccgccggtaaaatggacgaagaggcacagccaagctcctcgttgatagtgtccgtgcaaagcccgcagacatacctcccctcgtaccgcgcccgaatgctagcgatatggggccgtgcaatccgccgtgaatccgcagcagtcacagctccccgccccgacgaactcccctcctgggtcaccaaagccagcaccgctgccggtgctcgcttcgccccccacgtcggtggcggcatacgagcaagagcaaaccaatgtagacgatgtcttctccaaaaccaacagctcgggtaatttattcacaggtattttgatttttgaaacttttggagaaatcactgatttttacatgccaaagctgaccaaatttggaatcattttattgacaggtacatgatgtttgattagcggctatgtattctctgtgatatcacgattaagtaccaatacaagtagagacactcttccggtgtactagttaattacatttaatttggttctgataaggacgattgtctaaactaatactaacgctagctaacattctctggactcctttggccttctctaattaggcatgcatcttataagagactggatatggaaggtgcagattgaatataagttagcacagaaaaattatttaaaataggattcttcttatttgtcacaatcagcagtaaatggaactacaatgtgtaggaacatgattggaagggccgtcgtgaaattgtgttcatcacatttcagagtgcaggtacatttgcagaaatcctccatcattctttaggctttaatattactttgttgtctgcgaagaacaatcttaacataatgaatctttatttaatataaaaatggaattgtgtcctcaatctttacttcatttctgtattctttaagcatgattgcttttccgatggtatcttatcttgaatagtctctgtgttaggcatttattctattttttggagtatttgttaccaccagaaatcatcggaaccaggatgaaaatgtcagatatcctccgagcaggacctctcagggtggttatggtgcatataatgcatacatttaagctattatcatatctatctatctatacctatactaatcgggcacttttttggagctctcacgttaaccagaaacatctaaccattgattagatggattgtaaaatcatggccgtacattgaaatctgtgttatcatgggcttttttaagcgaatccaacgtgtatagagagtccctctattatacgtattgttaactacctacattgatatggatatccaatctgttaatatatctggacgtatcctatctccagttatgtcaatagatcgggctgtgttaaccacgtacgtacgtagcctagctgatgccgatcggaattaatggcggattaggcagcacgatatgcaaccgaggcatcgtcgtgaggagcgaccattcgatggaatcgtccggcaagacggtcagccccatcatattcatgatttccaggttcgaccgctcctggccggggcttcatccatggtactaacaagttcttcacttttcaatttattttaattccgaataaaaattaacaactgagtagatgaggaacaaggcaacatgtatgtgggatgatggaactgtcaacagcagtgcaatcatacagggtaagaaaaatacagcttattccctttggttctgatctgttaatgtcactgtatacatatattttctggaacatatttttaattttgtttgaaattattacgatctttggcgtatcgatagagttattttatcacggtcgactgacagtaaaaatttattagttcaccaaagattaagttgtttcataataattttgaagcaggcaacttacatatcgatttatagtttttctgaacataaacaagcattttgttctctctatacgccaggttgtgtaatgtgcaattgaactactttaaaaaccattttcgcaggtatccctttactacgttctttttgccgtacttctgtattctttttcgttggaaaatagctttcttcgttttggtaaaaaaaagttttcgtcagattctatggaataattcaataaaatgtgaatactactatttgaagatttgcttcaattcaattagtcatgaatatttactcaggcacccatctgtattccttctaaatagattttcaagccaataatatataggaaaagatatatctatatattattgattaaaataatgtatcaagacacatcacagcttcctaattgttaaaattacattaataaataaatgaaatactaaaattcagacccctaataggaggacgatctcatattttcaattctaatttacagaattattaaataaaaaattacgactccaaggagagttcaatttcgtatgtattaactgtgagtccacattatctatgatttttctattttgagaactattaaattagaaaataaaaaaactagaaaaaggatatagaaaagcataaataatgcatttggtactccagtactttgcataaaagcgagtgtcgttgtggagtaagattttgtatatattattattatcaaaattcacaattactttaaataggaaattaaattacttggtttttattaatctatttgtcaattaaaaatatataattctatgtataaatccatttatacattatatatatatggtagttctgtgtgaaaatcaagattcttttaaagtcgatctccactcaaatccgctaatatgaaatcaactaattgcctttatgagatatttttgaaaataaataaccaatattctagcatatgattaaaatttttaaaatattaatatagcccgtgcaacattcttacaaacattctcaaacgcaggtggggtacactgtgatttaatcttaattttctttaaccttcaacttattgagtcaagtggtagaggtttagagttcttttattgcacatagtagt

SEQ ID NO: 18188 - DNA, 4016 bp, Oryza sativa
aattcctgcagccctctggacagtagttagttggatcgaattatcatggccataggtaccattaaaaattaaataacaataccataattaataataggctattgtaattaataacagactactgaaaatactttggattcttcagtttatactatccacattgtaattgacatctgatttatcttttagttaaaccgatataattaaaaaataactaatgatttttctataattagaatctaaacattataatattaataataatagccgtggaacgcacgggttggcgactagtactagtaatgttgaatagtctcacattggttgtcgaagggcaaaggacttaaagatataagtgggggagcccctcacctcaatggctagcttttggggtgggaaaggccatttacgatcctacaattggtatctgagcctagctaggttaacatctctggcctgatggaccgtgggtgcctgcggggcccgtatacctgatggaccgtgggccggtggggcctggatacggtgaaggggcggtgaaggggctgagggacaccaatgtatgaagggggagattgttgaatagtcccacattatagctagcttttagggtgggaaaggccctttacgatcctaccagtaatatgcccgtgctaaatgctacggtacatttaagctttgagtgcactaactctatcttacctatccacggtcagcttatggaagtaaggctgcgttcgtttgtgtgatatagggtgagaaagcacctcgttttccacgcgcacgcttcccaaactactaaacggtgcgttttttgcaaaaattttctttaggaaagttgctttaaaaaatcatattaatccatttttaaaatttaaaatagttaatactcaattaatcatgcgctaatggctcacctcgttttgcgtatcttcccaatctcctcaatctccttctcctcaaacacaccctaagtcttctgctatgaagtaccatatgagttaacaatataattttacaaatgtaaatgatggttctgtttggtgaatggtgtcttgctttttgcctaaatccacctggaatcaaagcgggaatcaaagcgagaatcaacacgagaggactgacaacagaggaacatagtatgaacgataaatagttccctctttaccatcaactgtataaaaaaagggctaataaagggcaacggcacgggaatacgaatgatgtggagttgtagagacacaagacccgaggtagaaaagaagtttggattttatatttaatataaatcgcaatatatatgtgtttgttcaacaggtccaattgggttgaccctctactatttcgcatggcaaagccatgcgtacttctagtgagaatgaaaattaggaagagtgacatttgggaatgtgtattttaggaggatgataaacagtaaattctctcgtacctgtaactatatctgacgacttgcaatcttccactttctagatggagtacccaccagcaacttttggaaaactattttaaatcctcgagaggacattctctcgctgtttacatgtcgtctagatgattatgaaagaattcaataagatagattaatatgtgataaattactttgcaaacatgcaagaccaaattaaatttctacaagttgtaaaaaaaataattttgactgtgaatatacgctaactagacatagattatactccctccttccctaaatgtttgacgccgttgacctttttaaacatgtttgactgttcgtcttattcaaaaacttttgtgaaatatgtaaaactacatgtatgtataaaaatatatttaataatgaatcaaatgataggaaaataattaataattatttaaattttttgaataagacgagcggttcatatatgctaaaaagtcaacgatgtcaaataagaaacagagggagtatataattacttctctggagccacattatcgactggcctgtggataatagtagcgtgtgctgtctctctcataaagtaggtatgaattttagctgtacttatatgttttatattaattcgaggttgtttgaagtgtccctacactaattctaggtcaacatatatataagctataacatttcccacatttttctaagaataactagaaattagatcaatcgacaaacagaataatcgtgaccatctgatttctatatatgaagtatcgcacagattgaatcaacaaaaaaccctacatgatgttatgtacctttgaaaccttggtcacgaaggactaaaagtaactatatatatgcattaaaaattaaagtatgatgtgaattagacttcaatattaattccaatagcatattgatggcttatataggtacaagtatgctacagagtggcaatatatatgtacacatggtctttttttttttgactggaaatactgccaggactttgcctcgcagtgtgattttataaaaagaaatttttttaaaaaattacaagaggccgagaagggaaacaaaagattacactgtttgtaaccaatcaaaaactatatgctttaggggatccttcattctgcacaaatgcagaagaacatcatctttaaataaagccctccaagaacttaatgagggaagttcatttcgaaagattttcccattcctttgcttccaaatgtgccaagcagcaatgaaggaaatttctaaaaaacacttctggctgaactgaatgcgggccgaaaccaccatctaaaaaaagttgagactagagttccacacaattcccaaatgctgccagcactgctgactgaaagggcagaagagaaaaagatgctctcttgtctctctgatattatttaggcataactcacaagtgaggtcatcgttctcctttgcacaatgccgtctatcaagcatatcctttgtgttgagtctgtccctaaataatagccaagcaaaaacttttatcttcattacgcatcttgttttcactggtggagaaaggggctttactcccggttgagagcccacctatagtcccggttatacaaccgggactacgaatccgggactaaagatgggtatctttagtcccgggtgaaataaccgggactaaaaatccatctttagccccggttggtaataccaaccgggactaaagatggtgggagcagtccggttgattttttttttgctcaaatcgatctacttccaaaatatcactaatcatatccccaaatcatccacaaatcaaagtagcatcacagatctggaagaaatgcatcacagattagaaggaaatgcatcacagattacaaatacatcacatcacaaaatctcaaacaaaaaatacatcacaaatcctaaaagaaatacatcacaactcaaatacatcacagatcagatccaatatcacatacatcacagatcaaatccaatgaatcacaaattcaaaaaaaatcacaaattaaaaaaaaatccggcagcagatgagagggcgccgccggcctcctggtctccgtcctctcggcctccgcgccagcttggcctccgccgcgcccgcccggctgccgccgcgccagcccggcctccgccccgcccgcccggctgctgccgcgccagcccggcctccgccccgcgccagctcggcctccgccgcgcacgccctcctgcccgccgcgacagccccacagccgcgccgcccgctcggcctccgccccgcacgccctcctgcccgccacgcccgccctcctgcccgcccgcccgcccggccgccgcgcccacccgcccgggcgccgccgctcccgctcagccgcagctatagaagaatacagagaggggaaggggaggaacgggaggaatacagagaggggaaggggaggggaaggggaggaacgaacagaggggaaggggagaggaagggatggaggagttaatgagaggggaggagatcgagaggtctgtgcgcggatattatcgagatggcagcggctcgggttactctttactcccggttggt

SEQ ID NO: 18189 - DNA, 5128 bp, Oryza sativa
tataccaaccggtagtaaaaataattgggatctgttttaaacctgacaacttcttgaaccgggactaaaaatgatctttagtcccggttagtgttaccaaccgggactaaagatcaaaaagtgcccttcaacttttaaaccgggacaaaagatgctttttagtcccggtttttattagaaccgggactattgtggaatttggccgaccaaccaaagatagtttctccaccagtgtttccagatccaaacaaaaggccttggcaattgcacattcgagaaagtgagcttataaaacctcttagctgtgtatttgtcagagttccagatgaagaccaatcatcacccttgtcattctgcaaagagagagagaggacaattccgcttctagaacgatgaactctccataagcttgggtgttcggaggtagcaagaagtaatcctcaagaggagtagagcatatttgattaacagagagggatctttctaaagcaaccatacacaaagatgggaattcagtgcaccttatcttatcagtccaaacatcatcccagaaaagagctgatgatcctgtcctgatgtagcattttgaaattcccctgaagacatcagacagagccactatatccctccaccaaaaagagcctttattccaaaccaaatgagacactttggagtcataataagaattccagatcagttgaacccatggcagatcctgccctttgtaaaatttgaccaggtgtttaaaataacgtggtcccttatttggttctatgaaatgttgcttcgtatatatgctatggttatgtatatttattcctcttgaaccatatatgctgctgattgtatgtccagtggacagtggtgctctttatgtggtagatgagttttagtacgctcttttaaagtccccacattaagcatcaaaggcttcctttggagcaaattgtttcttggagatctttcaggtggctacttggatcctgtggaaacaaaagaaatgatcccatcttccaaaatgtgcaaccctctctctctctctctttggaaattcttcttgaaagaggaattaagtctacatttactcagacttaaaatagacaaatacaatacattgacctttctttcaatcatggattgacaacttgtaactcctctggttgttttttctatacttaactttgccacccctcttgtttttttttttgaaacttaacttgtaactcctcttgtaaagttgtgtttctgtattttaaattaaaatcactgtgggggcttccccactctttcctggtaaaaaaatggtccatatttcagctggaaattccaacattgatataaaatatctacaaattatcacgttaattaaaagataattgatatatcttacagatcaaatcatgtctataaaaaaatataagaattaaaatataaccatgtatatataaagtataaaataactgatattttgattccatttccacctagtacattgattgcttctcgactctatcagctagatgaatgtcagaccctttgttgtgtcagtatctctcttatatatcttgcctttctccatggatgtattaattggtctgtcccatatagtcgaatgcaaatgtaggccatcgctttctttctctacggtcagtcgttctgggtaagcacaatcaagctcgatcaaaccaaaacaattaaccaaaacaatttgcatggctagccaattaactaaattgtttatggtgctactaaattattgttttgtcgatcaaaccaaaacaatcaagctcaaaccaaaacaatatggtccatgtgtgtttatgtgacatagcaccttacgtgccacttaactaaatggctcctatcgcaacacccacctcttatttaacagcttaattttttagggacaattactcattggaccctattctagactctaactactaatttgaccctacttttttaactttgcttacttgactctgcttttcaaaataagaactgccatttgacgctgttttcactgtaccgttaaggtttatttaggaaacaaaaaataaatcattttatagtctaaattgactaaaatgtccctaactaccaaatcaatcctatccctaaaattctcacccggtggtccactcatcccaggccttctcaagtctcaacgacgcggctagggttcggtggaatcggcgcatggtgggggctgcggcgcaggtggcacggcgctcggtggggctgcaatggcggcgcgtggagagggcttgggcgctcggtgggaggtgcaaaggtggcggtggtggcggcggcgcagggagagggcttcggtggcggcatgacgctcggtgggggcttcagcgaccgcggtggcgggagttgcggcggtgacacgcggcgagacggtggaggcagcgtgagctgcggaggtggcggcgtggcactcgtgggggcttcggtggcagtgcgcagagagggcttcgacgtcggcggctggcgttgcggtggcgacgacgcgcaggtgcggctgcgacaacgacgcgcgagtgctgctgctgcacggcggcacgtaggagctgcggcagccacaacatgtggatgtgggagatggccgtctacatgtgtttcttttcttgtgtacagcttgagtttgatcaatgctgtcaaaattttatcaaatcgaagacaatttgtcaaacctatgttaaatttatcaacccacgtcaaaacaaagcaagcaaaacgtcaaaatcccttatattatgggacggagggagtagtaagtatataaacagacaactaaactgtatcttgttaggaaaaaaacttttcaattagcaatcattgtaaataaggttgacttattgcatttaatgaatagctgtatgtaatttagttcgacacatgtggcaatatttgacaatatgaatataatttgttctcttttgcacttggtttaaatgaatatacccaatcatgcccaacattggtaaatattttaaattgtatattttaattaattacatgtgaaattcttgtattctctgtatttaaaaatgcgaaaaagagatgcattagctatccagctttaattattcaatgttttttttcctgtgttgaaactatgaggactgatagtgatataaataataatgattccattttcagatgaataaaaaattaagtttcgtgacaattaatgagagataaatatagaacctattatggcgttgtcaaaattaaacaaatctttttgtgagataaattgaataaactcttggtgcactgtaataactttatctattgtttgatttggatgtgcatcgatctagcattagacattagctaattatatactttgcattgcaaataaacagagtacgaatttaaaaaaatcacggattaaccctgctgcttggatcagacgaacctgcttatcaggctatcagcatgtcctacggattggaaccaaaaaaattaagacacaatcatacatatgggttaatcaattgctttgattgaaaatgttttgcataacctaatatatactctccagatcgagttactcaccacggatcgattatgcgttgtcaaagcagctacctaaggtgttgcatacttgcatatgcatccgtttggagcgatcgattggaatcatagacggcgtgcatcagatcaactgtagtagagccatctctgcactcgaagccgatcttgggtcgatatggccaccgttttgagtcttagaaaaagatgtcttcgttgttgaagccccgtgaaccattactgattggtagctagggtacgctggctaggtcatcatcgaccagattaattggatgggcttaaactggcccacaatgcgcctaattaaattttttaattaaaattattaacacaatctatggctgtgatggtccaatctaattaatggtcggatctttctaattaatgtggaagctcataaaaaatacccaataagtataggtatagaggtatagatagatagatggagacatggtgagcccccagtattaaactatagtcggcctaacatcgaaaacactcgcatgatagatatggtataaaaaacatactctaggcaaacataataaattttggatctgataatatcatatggatctgacatatacgtacgataaattgcatataaaatatttcgtacctttgtagacgcatatcggatgcatctacgaaattagtatatcagttaaaaaaccaatctaccaattaccttgttgcgtactcgttcgacatcatataatttgacatcttttggtacgtcgcgggtcttggcatttggatgatctagatagatcaatttttttacgatgatgattccgatcttgaccggggacgttctctggtcatgttagatctcccatgtccaaagtcgttgaggtgtccctcgtcgcaaaatcctcatcgatgatgactagacggagcttgagatgcgagggtcctgatccattggagaacagacttcgttcgggtcacatcaccccatagccgaagtcgtcgagtagtttgttgtcgaagaatccatctcttgaactcatctcaaccggaatcttgaagcaccaaaatccccctacttggcgcgccactgtcgacatttgatatcgtgactacggtatttagacagtatgggtatcattggtactagggtatatacgagatttaggttaaacagatggagacaagaatttttatacaggttcgagccccttatcttacaggtaatagccctactcctgctggccgaagccggtgttgcttttattcatcataatcacacaaatataatgtatagtataacctatctaaccgtcgtcgacttggcagctggatcatcaacactagtcgacggtggggtagtctcccacctcgaatacgctcttgatgagatcagagatagcgctagatctctttttactgcctccgcagacaccatattgggtttttctaggcttaactctaatatcgatatctggcgatgtgtattgatttgtcttggccttgtgtatcgtgtatctctatgttgtgtgtcccctctcctcctaggggctttgtatttataccgtagatatccccttgtccacataga

SEQ ID NO: 18190 - DNA, 9959 bp, Oryza sativa
agaacgcttcactctacgtctctacgttcgacttgaatgcttggtttgcatgcccgttcgcatggattcggtttaattgtatagaaagcgaagaaaccatactgcgccaaattccttaatttgtcttatcaaaaagttttacgcgccgaattttagctgttcctatattttcaatattataattcgatatcagaagtttatcataacagtgatgcttgataccttttgctatagctgctcatcctgaattgaacatatgatggatgaggagcctcatttcttgatgatctagctgattttactgctttactagttacaagagttctaaagaattcctctgttcttatatcagctcatcctaagataagctattaatgacaggtttgatctataaattttgtgtaaacaatgctggttttatctattgttggactgaatatatgaatttctattgaataaaagactgaaagtactaagcaggattttgtgaaagagcagagtaaaggtagtatataagtactacaaataacttaacatcaatgattacgattatattggttgagatttttcgatgtgttcaattttagtatgatgaagctattgcaatgcaagtatgccctgtgatattactttttccagaaaattctttagatcctttacgtagtttcatactctttgattatcattcttctttgctacgacatttcatcaagctgttcattatcaattttgtcaatatacagaattaatactgtgtcgaaactagatttcggcaataataaaagggggtggctatcaagctggagaagtgtatgggtttggagacaaaggatttatacaggttcaggccttcttattcaagaagtaataccctactcctgtccggggatgaatccgccgagtgtcttattaattgtatgatttggagaaaatcaacatgtgcccctagaggcatccggacctcccttatatatgggaaggagtccgtgttacaaaagataatctatatccctaacgaaatatgcagatacaaataaaatacagtcgtaaccgactaagtctcaaggtatttccttgatgtacaagttgagaaacaaacccgagacacaaataagatattctatctatattcggtatcctgtactcagtccaaataccattgccgtgtagatatgggatatccataatctccacaaatacgtttgtgctttcttcatgataaagtgtactggcatcttctcgcttccaaggtgatatcaaagcttagcaaaaaaaaaaaaaaaacttggttgccacagaattggtaagttatgatccacagcttcaccagtgtaaagggttattatacttccatttagtcctattgcttttgggccaataaaaaaagatgagtaggtagagagaagatggatcgatcgagatggcatgccaggaaactatgtcgtcgtcgtcgtccttagcagcctggctgcactagtgctgctgctgccgccgttgtttgctgctgtggatgatgggatgaggagcggcggcaagtgcaccaacagctgcggcaacgtcggcttcgagtacccgttcggcgtggaggacgggtgctaccgcggcggcggcttcaacctcacctgcaaccacacgtaccagtcgcccaggctgttcctcggcgatggcagcgtgcaggtgctcgacatctccgtgccacacgggtgggcgctgatcaacaacaccggcatggtgttcaactccaccgagacgcgggtcgtcctcaacagaacatgggatcagctggtgggaggcccctactccttatcgggctcaaacaagatagctctggtaggctgcaatgccagggttgatcttcgcgcccgggtaaaagtaaaacacggcggccgcggcggcgacgacgatactggaagtaatctgatcagctcatgcactgccgtctgcccattagacctcgaggacatgactccggttttcgccatcggttctggcggtagcagcgcagcgtgctccggggttggctgctgccaagcagacatcaacttagacatcccctcttcgtacacaatccagatccacaacttgcaggagctgggaggctccatcagtccaacggatctagtgttcatatcgaaagaggagttcagctacaccaatgacatggctttcggcaacaacatcccacaggcgctcccagccctgctagattggtatataagcagtgacccatcagagtgtacgtacgaatcagcccccgattgtctcagcgccaacagcttctgccacgcttacgaccttgggtacaagtgccactgctccgatggttaccaaggaaatccatacattcgcggtggatgccatggtaagtactagtactagtaattaataggagtaatagtttgcatgccgctttatatatactacttattaatgtctttttgttactagatatcgatgaatgcaagtccccccaagattattcatgttacggcaactgcaacaacacgccaggatcgcacatttgcgactgtcctcgtggctacgagcgcaatgcttccacaccaaatggatgcaaaggtacctaattaatggattaactctcgttcatcggattaaaaatacatatatatgtatataataaacttactagccagtactacaacggtttatatctaattactattacaaacttgttactagtacgtactgtagctagctagccatctatcaattaattgcttaatttacgctgacacatgttgatcgttgcagcacgtgtgttcgctcaattagtatatgtcaataaattgaggttgttaatttcattactagctacccctgcagtgttgaaacaagaaatagcgcgtacatagcacaaaactaattaaaaagttctccctggtgtcattattatttgtaggggagcacacggtaaaattcccatgtacgttttttcctatgttgatcccacactgaaagctactccgtcattctaacattttccatgttcatattgttgttaatgaatttagacatatatatctatctagattcattaagatcaatatgaatgtggaaaatgctagaatgacttacattgtgaaatggaggaagtagctagcttgttggaaaattaattactgcgtgtttcggcaatataggcacccgcggtgtttttacatattattaattattccctaatttacacagctcacaacaagaaaagcaaattaactaataggaaaatacatatacttttctagcatgtgatcttattgatctttccatgctgtatacaattaaccagacatcgatgagtgtgggcaccgcgaaacttaccagtgctatggagagtgcattaatttccctggaggtttcgattgcctctgctaccatggaactgacggggatcccagaaaagaagggggatgccttccggtgaagcatcatttgtcaggtaataagagatatacaaaatcgtaatatatgattaatgtagcatttctatactcaccgttaaaatcttcattgataatcattgttgatagtttccttaacttgtttgctagctcgagacttaggtctattcattgggcttggggttggcagtggcacaattcttttgctcattgcagttggtgctcccttcctatcaaggaaaatgaaggtacgcaagctgaaaaggatgagacagacatttttcaaccaaaaccacgggttgctattacagcgactgatctcacaaaatgcgcacattagtgagaggatgatcctaacattaccagtgctagaaaaggccacaaataattttgatagaactcgcgaggttggtggtggaggacatgggatcgtatacaagggaatattaaacttggaggttgttgccattaagaagtcgatgatcatagtagaaagagaaataaacgatttcataaatgaagtggcaattctctctcaaatcaaccatagaaacgtagtcaagcttataggatgttgcctagagaccgaagttccattattagtctatgaatttatttcaaatggatccctagatcaacattttcatgttgatgaaccaatttcgctttcatggaaggaccgaatgaggatagctgttgaagttgctagagctttaacttatttgcattcagctgctacagtaccggtattccatagggacattaaggcatgcaacatacttcttgacaattagttaatagcaaaggtatcggactttggagcttcacgatatgtccctatcaatcaaactgaagtgactaatgctgtccagggaacgatcggttacttagatcccgagtattattatacaggccatttaatggacaaaagtgacgtttttagctttggagttcttgtaatagaacttcttactcggaaaagacccacctataggactgatcagggtgatagtttagttttgcattttgcatcactactgagacaaggacagctggttgggatactggatcctcaagtcctgaccgagggaggtggagaagtcatggaagtagcattacttgctgggatgtgcactagaatgactggacaagatcgccctactatgagagaagtcgagatgggactggaaaacttgcgagttagtaagaaacttgcttcacatgatacagcatcaagtagccttgtatctcagatggcagagcatcgcatgatagcgacaggggacatggaggaatcaagcatacagtacagtatggaaaaatagatgctgctgttattgtcatcgatgttgtcttttaggccacaatttaataattaccgtgacatatggttattgtcctttgaacaattaatgtcatttttcgttgttttctctggtttttttatataatggcctgtattttgaaagtacaattaatgttgtgttgcttgtaatcgtgtttaatattaaatttcatgtagacgtgtttaatttagtctgtgaagccatttatgtgcaaaagtaatgactttgtcaacatctgtgttttgatgtatgtttgattgaactcagtacatgtttcatgaggaaaaggatgatgtcagcaatgtgcacgtgtcttgatgtaatctaaattagcgtagtggttagtaccgaaataaaattatatatgacgatgcaaaattatctattttttcatcttgaaatctataaaaaacattagtactgcatatagatgggcatatcacctggagatagtgtttatattgattcaattatatgctggataaggaaaataataaaaaaaaagtgactataacaattttcttatcctacaccattcaattatgattatataaaaaaagttatatttttctttagtttttggaagtcctgtcagccaccattctcctgctcgtgactactggtgttcatattatatattttgggtataatcttttattggtagacgttcttatattataaaatagagcaagtagacaacttgttgatttgggtttatggggataagagtggtgatggacaggcaaactagggtgtttggttgctggccaagtataccaagtatgtttgatcaagttatcggttctagccacatattataagtcatgccaaactttccttttaacatagccccacatttcataggcacagtataatatgtagcaaagaagctaaggtgtggcttcatttttcttggtcacaactttggtaacttagtcataaatgtttggctagcttaattaggtagtgttagacaaccaaccaatcagcctcatagattgtagaagcaatgtcgttgatgctgaggtcagatcacaagagggtaggagagatacgtgcatgggagagtgggctattacagggagtgtggtactatcacattgataatgtttgtttcactggtggagaaaccatctttactcccggtttataaccccctgtagtcccggttttctaaccgggactatgaatccgggacttaagatcgctatctttagtcccgggtgaaataaccgggagtaaagatcgatctttagtcagagggatctttagtcccggttaatgctaccaaccgggacaaaagagaggataggggcagtcatggttggtccattttctttttattttctcccaaatcaagtgggatgtatatactcagatcaaacaacaaatccccaaatcgagtgtcatgcatatacctaaatcaaaccccaaatccccaaattcaaagtaacaacacaaatcattcacatcacaaatacaaatcctaagttacttacacacaaatcaaatacatcacaaatcttaaaaaaattacacacaaatcaaatgcatcacagatcgattatacatctcagatccatgcaatgaatcacaaattctaaaaaagaaattatacgtctctcaatcacaaattataaaaaaagaaagaagagccagtgcgctgccgctccgtgcacggccccgccgcccgcaccgcgcgcagccccaccgcccgctgcgcgctgtgcctcgccaaccggccaccgcgtgagagcgtgcaaggccacctccgtcgccgcccggccgccgcgtgagggcgcgcgaggccctccgcggccgcccggccgccgccgcctgagaagtcgggtggagacgggagggggtggatccagaggaggttgagaagtggggaggagagggaaggagacggatcagaggaagagatgagaggaggaagaggaagagatgggatgagtgaggagaggaggaagaggaagagatggggtgagtgcggagaggaggaggtaaaggtcggaacttattaactgatcctcccgtgcgcctcggtcctctcgatctcgcaccgcgcatgtcgatcttttttcccgattggtaacaccaaccgggactaaaaatagatctttagtcccggttggtgtcaccaaccgtgactaaagataaaggaggagtctgacaccacctgccgtcttttaaactaggactaaaaatgatctttagtctcgattgatgttaccaacccagactaaagatcaaaaagtggctctaacctttagaactgggactaaagatcatctttagtcccggtttttagtggaaccgggactattgtggatttcggccgaccgaccaaagatggtttctccaccagtgttttcaatattttctatgtgtagtgcctggaagagatctatttgttaatacgtaatattggctcataaattttgaatatttaattattatgtattgtgcattccacgtctacgactagtagcgcatgcgttattattcaaaatatgtgtccttttggataaaaatgaacgtgaaattaatttcaaaatgtcacattccacatgttggatgtagataaaactttggagggtggtgtatgaacaaaaaaaaaagagtaatgctttacccagtaatactaataactactggagaagatcaatactgaagaagtgatctttgccggaatggcaaaaaccacattagtcctggttttaatagaaaccggaactaaaattaaaattgatctttagtcccggttcaaaaggttaggggcaccttttgatctttagtcccggttggtcccggttgatgttactaaccgggacgtttaatacagtgcaatgcggccctgtctttaccaacaagtaatcaagaattaaaaatatagagagtggagcaaagtacacgtcctcggtcaaccttggacgcatttttcactgccagcgttagcgcaagaacgacctttgtagggcttatctttcttagctttcagcttgggaagagcatcatagtttatcatctctgccttatctttcttagctttcagcttgagatgatcgtccctggcgtggggctggatgcgtcgaccgattgctggctcaccgccagcatgacgcccaataacagcagtgccaccaagcccaacctcgtgctcatcttctccatttgaaagtaggtcaccctcctgggattatgagcagctagctaccttaatttgtttctcgtatgacatgcaatcgatcacatggagtgacttttataggacacagtttgcctataatatcaatggtggagatggaatttagatgacataaggcttattttagtacaagctaatcttgccttttaaccgtatacgttcccgtaataatgttgctgcgtaaatatttttgcttaatttagccagctctattattgcaatcttgaggttaatttagtatatagagcggaatcacatggaaattaataacggcagataattaatgaggacaataatatctctccttttttttcctcttttctattcatttttatctatttgctatataaagagactagaaaggagactaacgacctatattgattcaatcattgggacttcattgggcgaagctatagctatccatcggggtccactgaccccgacgatttcttgtgtacgcttcttagcccacttaattttaccgtgtaggaccccggtcgatataaacactagaccccggtaaccatattttgttacagcccgattagcaattagaaacgacacgtttgacattagcaagcaacaaataggaattagctagttctaatgattatacgtcagcccaaatgctcaatatacattttggtaatcttagcggtgagtatttgtgcatttaatgtctactttgtttagattttaattatgtccgtttttaatataatttatagacatgtcagtgcgttgcaataatctcctatgggccaatggttgctcgtagcattatttagttttctgttgggtctgttattttttcctttttttgggtttcttttagggtggatgataaattctgtagataaatagtcgagcaaagcattatggagctattcttgaaaaaaaaaagatactcctattttaaaagatctaacaatgcatcaaacactaagagggtgtttagttcccaccagggtttcccttaccgccggtaaccgcgaggttaccaggcttaccgtagggatacggtaatataaataccgcggtaacctccttaaattcaaataaatttaaaaaataatttgtatttttgataaattttgcacggtttttcacggttttccactgttaccgcggtaaccgtgcttaccgccggggtgcggtaaccctggccccgacggtttgggaaaccctggttcccacataaaaattttacaccatatcacatcgaacgtttaaacacctttcatgaagtattaaatgtaggctaaaaataactaattgcacatattgcgactaatttgcgagacgaatcttttgagcctaattgctccatgttttgacaatgtggtgctacagtaaacatttgttaatgacggattaattaggcttaaaaaatttgtctcgcagtttacagccggaatctgtaatttgtttggttattatgctacatttaacacttcaaatatgtgtctgtatatccgatgggacacggcaaaattttacccctagatctaaacaaagtttaagttagtattgaccccgacgaccatttatcctggcttcgcccgtgcttcattcggactccgattaccgcaaacttatagtcttctttgcagtagctactttatgtgtaggttcctatcgtctattcgaataacgattcaaaagttgaaattttcaaacctcactttattttttggagtttgtaatgacatggggtattacactactagtttagattggaatccatattttcaacactttgtctgttttcacatatgtactctttctaaacatgctaaatataagttaacatgtttcccctgaatttgtgttgttttattttttctaacaagctattgatgcaaaaattgaatcaacacgcgaagacctgagagcttttcttaattctaatgcaggtcctaaaatttaggttcgtagtataccagatcatacaactaacctggatttttcatattttga

SEQ ID NO: 18191 - DNA, 12039 bp, Oryza sativa
gccagccactctggcgccccaaaaaggaccatttctgggataagttttttcagggatctatttgtgaaataagtttttcacaaggaccaaaatgtaaaaaatccaggcaactaactaggtgaatggaacaaaaattgcattaggttacagagcaaccatatttggattattctggcattataatgaagggacaacaaacttcattttattctatacttgaaatgaggcaacgtttcgagatggtgacaccttcaaaacactaccacgtagtatataaaagagataatccattatatgccactgactttgtcgcacgtctacgatttgccactgactttgtcacgttctacaacatgccatcgacttttgcttaacttctacgatttaccatcgccgtccggttagccaccgttagtactgtacaaatttgtcgaaatgaccaaaatacccctatgacaaaaacttccaaaacttggataaaattatcaaaatattatattatacacataagattgtaaacatccaaaatttgaccaaaaacttgaaatatgatattacatagtttttatccaaattttgaaaccttttctcccaggggtattttggtcatttcgacaaatttgtatagtactcacggagactaaccggacagcgatggtaaattgtagaagtttagcaaaagtcgatggcatattatagaacatgataaagtcagtggcaaatcgtagacgtgtgataaagtcagtggtatataatggattctctctatataaaaaatggtaagttgtctaatggatggagtagaggggtatttatactaggaacacccctcctagcataggtatgaacataagaagccatgttcggctaacataaatgagaatgcaaaaggttttcttgggtttgcacacatcccttaaactcatggatagtcttcagtaaaaatgctataactttgttattgaaaaatgatattgaggtggggtttgatgcgttggaaactagatttgtccctctttccaaccatgtatgccatgcaaaccatctcttgactggctgggtcacacaagccttggaagtttagcctttgtagcataaaccatattcttgttggcgtagaaagctactagttaggcatgggctgattcctcctcggagtaacccttgtcgttctcaatgtaacgcatccttcttggcgtagtgatgagtagtgatgatgtcctcaggtataaaccttaataatacaaaggtagagcatttaagtagtataaaactctcactaaaatttgggttaagttgagcaaagagcgagttcacctcttactgtattttcctcgcacggctgcacgtaattgtaccatgatatgtttcattgttcttgctgagatgtaatccatcaacttgatttacatcatcttcattttattcatgtgatgtgtgacgtgaaccatcacccttgtttacgtcaagtgtagctgggatgtccttatcaacggcacatcaaggaggaggtctggtgctaaggaggccaccgagcaaccctcgatccactggtccgtccagaagaggatcaacacattatttcctggcacgaagaaggtggacgctgcaaacatgttggagacgctccgctcgatgggagccttcaggtcagcctggtaaggatgctctaaacactgaaaccagagccagcaaagatgtagagcaaagtccgttgtccttagatcagcaatacccagtccaccaatagatctagggcggcatacattcattcaaagcacacaacactgtctcgcattggccaactccgaacccgtccacaggaaggcgcgacacttcttgtcaatgattttgacaacccagcctgtcatattgtcaagaacacatggaccgaaatagatgaaagcattgcctggactagaacagagcggtacgctagaatggtgaggtgacccttccaaggagggagccgacacatatgttgcgactatatgtgtgtggatgcggtttcagtgttcagaataggtgtttggttattccgtaggatgaatttttcaatcaaatagttgtccctgccaagaacagaaaaaggaaggatcgatttagagccataatttaatctgatgagctgaaattgtgcctgtttggatagaaattgcaggtgtgttgctttgtactgctgtgaatacctgaagcctgaactttgtttgtcagcaacgggagattatgggctgtaaagaaataaaaaaatatcggcttgcattggtttcttataattttgtttgggatccaagaggaattgagaaacagaaggatagtggaatccgtcgaataataaaaatgaatatagcttcagattgagaacataagagttaatgggttacactatttaatacttttgcagttcttaagttctgactacattttatacattagcaaagggggactgcagggactgaagactgtagagggttataagggaaagtggaaaatgagaaagatttttctagttagagccatctgaaccatttctatacatcactgtggttctatgaaccaattttagatttcttcacaaaatgctaggcaaaacttaggttttgtgcccctttaaaaacggcggtagcggccgtaatagcggtagcggccgtaatagcggtagcggccccctcccgctaccgctacgaagtagcgtcttggatgtagtggcctggaacttagcggccgcaatagcgtgtagcgcgccacaatagcggatggcgaaaacgatatagcgggccgcaatagcggatgggccacacatatatgtatacccacttaaccctagcccacctttcatcttccgtccgtctcccctcatttgcgccgccaccaacacaacagcgcttgcgtcgtgcggcggtgctcagtggattcgccggccggccagccggacgccgggcggcagctaccgtggagcgacagagcacttccacacctcgccagttcgattcgatggccaaaggttagttcgtcgtcagcgcagcgccggccgcgccagccaccggcgctccgtcgtggtggttgctccttcatttagatttgagtttgacggcttttctgtgcaggttattaggtgatggtttgacttctgagcttgctggccggttatcttctccatcgaggtggttgtttgctgttagcctgttactggttagtgcttactacttagtggttggtgctcatttctggtctccagtaagaatttacaagatttacatgtaggacttaagattatcaattttttttctagttgcacaatgtcgtcggctgcatcaactgcaattcaagccaatcaacagttgtgtctgtgtcttaaattttagttatgttggaaagacatcaactctttgagtgcaagtgtgcaaataaatgtctatattttctcaaatttacatatgattattcaatgccgctatttgaacttagcgcccgctatagcgcctgctatccacgatccgctaccaagacaccaatccgctactgacccgctatctgctatttattagcttgtttgggaagttgttctgttgtcctatccaaccaacagaggtatgcattctatgtcattaacatccattttccatttgtttgtgcctgatagaattataaaatttacattccaaatgtttattttaggatcagaacatttcttttgcttgctatacaatactaatgaatggtaacgttcttatttcaatagagaaaacgaggttcctccacagactccattggcatgtatgcagttcaatgttttaagtgtcataaatggcgcaaggttcggacgaaggattgacatcgaatatataacagccgtatatgggtccttgaaaagcctaacatacaaaagcctccagcaggaactgagagactagtgattgtaagaggtgatttgtctaaaatggatgcccattatgtcattccaaatgggaagccctattaaattgatatcaaaaatcaaaacaaataattagcaatttgctacaaacatggaaattatttgaatataataagttgctataatttagaaataactaatgtatttctcatacaactaaaatttataccattgatagaaatagctacccgatgctcagaactaatattctcccttttctgataacagataataagcaaatgtatttatacccacaaagattgtatcaaccaacaaatgatccggaggaacgcgtggttgttgtggtcgccgatgtgggaacaccactgcctgagaacgtgctacctgtactgacaccgccgtaatctacccccacggcgacatctcttggaggcggtgacgccttggacttgtacatctgcggcgagagatccggcaacctcgcgtcgtcggactgcaggacgttcatggcgcgggcgatggacgggcgctcactcaggtcagggtgcgcgcaccacagcccgacgaccagcacgcgctccatctgccgctcgtcgcgcacgacgccaacgacacgcagccgctcgtccaccgcgtcgaggatcgcgttctggctgtacaggttccatacccacctcagcagcacgaagctcggctcgttctcctgcaagaccaccggcggcttggcgcagacgatctcgaggaggacgacgccgaagctgtagacgtcggactcggtgctcggccgccgcgtgttcacgaactccgggtcgatgtagccggccgtgccgagcacggaccttgtggcctgccacgctttgccgtggtcgacgagccttgccagcccaaagtcccctagcttggtgttgtacgacgagtcaaccatgatgttgcttggtttgatgtcgccgtgcaggatgcattgctcccactcttgatgaaggtaacgtagcgcagctcctaatcccataatgatcttgtatctgtatcaattaattaaggaacacttgttaacacagtagtactccaccggttcttaattttttttatgtcatggttagttaccagttttttttttacaataaaaactttttaaataacaatttttgatgaacgcaagtagcatagttatacatatagcatgccaagtacttttcatattataagacgctctaatgttttcctagttaaacttttcaaagtttgactatgtttatcaaaaatttagcaacaatgataacatcaaattagtttcaataaatctaacattaattatattttgatagtatgtttgttttgtattgatagtgtttctatgttttttatactccctccatttctaaatgtttgataccgtagactttgtagcacatgtttgaccgttcgttttatacaaaaacttttgtgaaatatgtataactatatgtatacataaaagtatatttaacaatgaataaaaatgatagaaaaagaattaataattacttaatatttttgaataagacgaacggtcaaacatatttaaaaaagtcaacatcgtcaaatatttagaaacacggagagtataaacttagtcaatttaaaaaagtttgattagaaaaaaatcaaaatgacttataatatgaaacgtaaacggagggggttttttttccagaaagacgagctatcaaagtttatgtattaataatatctaatgtcaacgaaaaggaacaaatttcctaggaatgaagggagttagatttaatatattgatttcaggtgcataaattttttaaaaaaattctggtcatttttttttatcgcttaacttaatgatagtccaatggttctcatcattcctatttctttgtcaaaggatatggcaaaatcaatagaggacatacaattcaccaaaaggatctctaaataactagaatattttttttattttgaaggaaggatccaaataactagatcaataataactaaaaaaagaacaatcggtcatgggacgaattgttacctctctggccaggtgagtatcctgtcggtgttatagatgtgcttatctaggcttcctcctgccacaagctcgtagacgagcaagagccccttgcggctatcacaccaaccatgcagctgcaccaggtttcgatgcctcagctggcttatgatcctcacctcggcctcgaactccctccttccctgagacatggagtccatcgagaacttcttcacggccacctcctggtggtcctcgccgccgccagtgccgacggcgaggcggcccaggtagacgttgccgaaccctccttgcccgagcttctcctcctcggcgaagtcgcgcgtcgcggcggcgagctcgtggaactggtaccgccgcggcccgccgccggtcacggctctctccaggtcggcggtgccgtgctgccgctgcccgtcggaggagtactggtcgctgtcattgtttgccggcggcggtgagttcttgcggcggcgcttccgctggcgccacagccatagaagcgccgcggcgaccacgcacaccgcgagcgtaggaactactactgccatggcgatcgtcttcgtcgaggagttggtcttgggttgtgctagtggcagtgcttgcgcaggtagtggtggcgccgtcagaatttgtggtggtggtgcttgtggcgatggcggtgatgaccatggagatgaaaatggatatggtggtggtggcgatggcagtggcggtggcggtggagatggaggtggttgtgatggacctggtgctggtgtcggagatgatagattatcgtcaagtacatatcgataagaacgatattctgctggcgaaggtggcgaggccatgggagtatacccggtgatgataactgatgatatatcaggagtggcgatggaaggcaacggaggcagccgcgacagccaccacccctctctctctctcctcaaattgttgaggatgatcgatctgaagttaaggttgagatctttcttggtgttgcgaagaatgttatatacgagtgtttaggcaagatagcaagagaaatggacgatgaatcctagctacaaggatcaagaggttatggttccgcgagctacccaaccatatatgtgatgggaattgaatgccttttatcgccgctgtcacgcctcacgcacgacccagtctgtccaactccggctgttttcaccttgactgtttgttaacactaaacagtatcatccggagaaaaggagaaaagtgaaattaagcgtgtaggatggagaggacgtgcaataaccgacacaattctctgcatcgattttaatgattccattatttcaacaattcaaagctaatgagatgtttgtagaaacaatctaagaaattcaaaactcaaaaattgacaactaaagtcactaaaatggaatatttaacttgactttatttgactttattactccgaacgtctcaaaatgtaactattaactattaatcgggacagagccctatattttagaatgaaaagatctatatgctaaacaatcttatattttggatcgaagagggtatgtgatacaaaagtataatcataaatatatataaacctaataaattcaatttttgtcataaatagtatatccaaataataaagtgagtttttattaaactattatcctactaaggaaacaaaatacaaccaagggagtatggcctggtttagttcctaaattttttttcccaaaaacgtcatatcgaatctctagagtattaaatatagataaaaacaaaaattaattgcacattgcatggaaatcgtgagacgaatcttttaagcctaattagtccatgattaggcataagtgctacagtattccacttgtactaatgacggcttaattaggctcgaaagattcgtctcgcggtttccagatgagttatgaaattagttttttcattcgtgtataaaaacaccttccaacatccggtatgacatccaaaaattttcttttcgcgaaccctatatattacaagttggagcaaaatgattaatgaaatcacgtacatttcactcaactggactgggacgactagacgaggtcaagtcaactgtcaagtactcccaataatatcccgatcgatgtgcagactgcagactgcagactgcgatagctaggatttcgaattaaatatgttccaataatcaaataatagtatatatggagctaaataagtacgagcctgacttcacattttgtaggtatgtgtactgtaattatcttgccttgatatgtgaaccggatattaaatttgacggtccaatctttcgaaagtgttcatagcgatgagtgcgtatgtattgtgggcgtaatagatagaagaaaatgacgaagaaaataacagaggagcgacgaccactcccaaacggccaaactgaacctctacttgcacggagatgtgtatatatcaacgtcaacggaacttgcatataaatttcccgtacgttgtgctaaaatcacgtccaatatttggagtctatgcaatttgatccactactttgcagttggaaagcacagacatagcaaaataataaattatttaaagtatttcgtgaaacaaggggtacaatatgaccgagcaccaaacaaaaattaattaagtttcctgctatgacacatatgttcgcatttctttgcaaaaacaagctattcacctgcgcagttgaagtgagatattattacggagttgctaaatattggcgacatattttgtagaaataatatgacaattcctagactgtccgatacacctcaagattcgtgcagaacacgtaaaaaattcaggcgacccaacggatgggtatatgatcgaactcgtaacatgagccttgcaagccaaggcgcttactgcgagcaaccaactcattttgtttcaagtacacaacacttacgtacaatataattatatataatataattatagtgtaattacaatatagttacataatatttatacaataattatatctaacatgttttcacccaaaaatatatcgacatcaactgttacccttggttaccaattttaaaacatcaattgtttttaactttttactcccttaattcaaaagtattgagactattttatttcataacatttccaaatgaaattggtgtacttgtagtctccatgcatctaagagttaacgaagaagttattcttttattttacagtactaaattaaattattgaccggaacctgagtaaccacaatgctagaatgactcatctctgacggcccaccaatgacaagccgaaatacttgtcacggatggcctcacctttgaggctttgactggtccatcgggaggccataacaggtaaggccaccggctacggcccatcacagacattaggtcacctgtgacaggctggaattagcatacgacatagggatacctttgttggatgatagttctggcccgttataggtgacctaatgcttgcgatgggccgcgcggttccggccatcaaagatgagatttacttatctctaacgggttttagccctaacccgtccgagatatcttatggcctataaatacccccaaactagggcaacagtttttcattccaaccctgcgtaccgttcacatttcgggtggaagagtaaggggggtgaatttttgctggaaattggaggtaaagaaactttgataattattattatttaacatatatcatatattgtgtcgtattgagtcatatagcgtacattacatatattatacaggggcttgtggagactctcagctctgatgagccggaaaatactggcccatcagagatgaccaaactttatacggagggaatactacatgttagtcacactagccagaagggcagaaagcctgcagccatgaaccccccaagtaatgtcctcatgtcatgtgtcctagaccgttcctgcagctgattttagcaagtttattttaattcttttttagcattttattggtcgattttgtagattgattcctggccggttgctactgtaagtgatttgccgaaaggtgacggtcgttgaccttgagtcaactcgtcaatgccatcgtattcttgtcgatcagcctgctgcgcgtctgctctacgctgggtcacgctcaaacagggatcctctctccattgaacaaatcaaagtttggtgcaattaattgatgttgttgcccatggcaccgaacaccgttacaccggacaggcacgtaggtttttcacgaggatcaaatcctgaaatccttgactatgggcatagacagatttttatgcagatttataggtacgtagtaacctttttttttcctaattaaccgttgatgaactagccgctcgtaaataattcgatctttgctcctttaatttgtttgggtggggggggggggggctgtgttgtgtcatgtcacgcagtaatatggtacatttcactaataagaatgcataagatgtgaggtgaagtatagtacattgaaaagtatgacatttcaaaatatattctcaagagtagtacgcccggcctagataacaccgttaacttttggctatattcatgtgtatttgtttattcattgtattcaatatttttatattcaatatttttatacaaatatattaaattataatgcataattaaacataaaatgtaaatcgcgcgcgctctcgattttgccctatccagcgacgcatagcgatccatccgatcggccgagaatgctccagatatgacgtcgctctctgtgttaatcaactgaaaatatatactaatagtccatcaaacaaataggaaccatctatgcgtcaaataaattttctcttaaactactcatccgatctgttatgaaatatttgagtgatctcatccatctatatggatagagcagcaaccaattctgggacacgacggttggtcatgccccacacctcttctcgcctcacggcgattctagcaacggaaaccatcgcgtcttctgatgccgcctctctcccccctatatattataaccattgttatcaataaaggattcgctcattcattctctacattcttgtgtgcaattctctctctctctcgattcctctcgctcaatcaatcttatacactttcaacacgttatcagcactttcgctctcgcgaaggagatcgcgaagtgaaagaagaactccatcgcttttgatctaacagaaaagcgaacagaagaatcattagagaaggtacgatgcctacctttcattggatcatggatgccattctcggcctccctcgccatcagcgcgcacgccggcttcgccatcttcttcgtcgatcgatgaggaggacgcgctggggaacccgcagaggcagggctagggttggtggccgccgccactaccctcgctgtcgtgtgcctgcaactccggttgtggtccccccgcccgtccctttcgcacctcctcctccgcctccggttgccgaagcacctcgccggatccttgtgcaaggggtacagtactgtgcccaccatggatggatggcggtggtgacaatgcccggcgagccgtgtgatctcccactagagatggagtcgctgccagccccgttcgtcaccactctgtcaccaccaaccgctccttccccacctccatcaacgtcgcagccgacgccaagctttcgacgctcccccactcccgcgccaccaggattcggccgtaccggaaccatcggcgcgcacgggggagccgcctctctttacaccgtctccaacacgtcgccacactggagccgccactgcacgccgtcccggcctccgccatacgttcatcgccgttccccatggctcctggagccgcacgataccaaatggcgtgggggaacggtattcgggtccggccggtctccgactccgatgaggagtcgggatcgtcggcctaaagccggccggcatgccgccggccgatgagggggacgcggcggcggcagatggtggatggcggcggtggaggtggtggtggatggcgacggcggtgggcggcgaagggtggatgcaggtggtatcggcgtgtggcggcggtggaaatggaggcagcggcggcgaactcagcg

SEQ ID NO: 18192 - DNA, 1376 bp, Oryza sativa
cacccaatttaccatttaaatttagtttttaattttattttcaacagcaattacattttagtccctatgttttctgtaatttagtggaaacagttcatcagttcttcacattattatgtaatggtcctatagaccactgatgttatgtgttaattaacataggtgtttattcaaataccctgtttcactaaatttatttgttgtcttaataacatgccttttgcatattatttcaagacatgctctactttctcgctttattaatttacaaaattctataaattttgtactttgatttagcaaattctcttaattatgtacaacataattaatggaggatttaatgcatgttccacttcacattttgacttggaaattaatcacatgtcgatggagtcctatactttggtcatatcgaccataacttaggcagcgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttatttttcgacaatatgttttgaaaaatgagattatttgaaatttggttgaacacaaggtagtggagtcctaaacattggctgcggtatattcaccagaatatatttgcctggagactgtgttttaggcaacaagtataacttgcccactattaagagatctactccactgtttaattacttggagattatccacattgtgccacctaatttcgaattctaactcaaaattgccaggtctattacctgcatttttttcgaaacattacaaaatatgaagttttacattacgcattgagattacaatcttaatatcatatttttattaatttacctctgtaaattgataatgttaaccatgattatagggacatggcaacaaaagagttcgacgaactcgccctcaatgggactaactatcccatctgggcttctgatatcaaaatcatgggcttctgatatcaaaatcaattttgcctcttgggggattttaaatacaattgaggaacccaatgatggggacccggcagttgagcccaggaagctcaatacaaccctttttcttttgacactctacattcacaaggatctcaaacatgaatacatgttagagacgagccctctcaacctttggaaagctctaaaagagcgttatgatcaacaaaaggaactcatttggcctgaggctaattatgagtgggttcatttacgcctacaggactttaaaactgtggcagaatacaaccatgctgttcataacatttgttccaggttgaagttttgcgaacaagagc

SEQ ID NO: 18193 - DNA, 877 bp, Oryza sativa
taacattaattacaagagttaatttatttctgccagcaatatatgcttcaaggccccaaccaaaaagtaaataacatgaattcattttaaagcacgtttaatatatacaccaattgcatccccgcaaaaaaaaaacaccatttgcaagcatctaaaaaaatcgtttattattattgattgcttgatatcagaaaatttaatctagttttggtacagcttggaagcatattatttattttgagtttgtctccagtacaattgacagcattcagctgtcaaataaaattacactagtacggaaactaaatttaaatctacaaagtacaacgacataccaatagcctctgatgcagtaagtgggaaatctgttaatacaccatcaacactaaagccaccgtcgctgacaaatgacagatattcccccaaaggatcataactgtagttgtagggaaaaattccatcgtttgaaaaatcagacgcatatatttctaaacctgcattgtgagcttcttggacaatctgtgtgtgaagctgaatataattatcacttgttactggccatatatagtttttgggaaccattatacctgaagcaattgtcttaataaatgtcaagttactcaacatatagttatatgttttatttgttgaaggatcagacagggctttatcaagaaagcagaacactagattcacttcacgattaatgcctcccgataaactttgcaggaaacctagttcaggtgatgagatgtacttcacagagccaagcttctgtattgaaagaatgtaatttgtcatgttcaaaccatgctctctgtagaaaatgtcatgctgcagaaagaaatgaaaagagagttatcttctgaaggacaaa

SEQ ID NO: 18194 - DNA, 12544 bp, Oryza sativa
caagaaaacaaaaggcactaggataacatccatttttggtcgctctagccggccggcaactgcagagacaagataggaatgcagtacgtatccatcattttttccctttttttaaaggaaagggaatacatatatatatatatatatatatatatattggtcagatgcaagaggatattatttcacgatcacattgacatgcatggcggtagtatccattcatgcatttaatggcaatgcagcgagcaagcagcatgatcgagtttctaataaaaaggagttgaaactatatatatggtataaggcaaagttattgcaagccttcctttcaaaaaaagaaaaaagaaaaacaaagggttgattaaactgatttgttgcaactcacaagtaacgtttctcagcgaagccatgttatagtccacaggtaaccatccggttttctgtgcaccattgattagatatgccttcatcccctctggataaatttcagtgatatcggtgcagttctgcataagtaaatctcggaggcaaataccaacgccatctttcgtcagttgcacgtcacaccacaagcttatgtggagcgaggaggcaaaagcgaaggcatattcactggaatcaggaaaaactcccgaaaatccacctttagcaataacaagaggagcattacctgcacacaaccaacaaattaaattttaatttcgggcggccatgcatatgctactgcaagtactgatgcatgggacgaaaaaattgactgtatgtaattcccgtcaagatttccaataaaaccgatcgaacgactcgctgcaagaactaacccaaactaaactagagctggttcagaaatcagaaattcagaattcaggtcagtcctgacatgaacagagccgggaaatactcctttcctctctctcctctatctctctctctatatatatatacacataacgattaagaggagctagatcgagcttgccgttcaaggttttgaaggtggttggcgccggggggagctcctccgcggcaacggcgacggtgacggcgacgatggttgagagtagcaggaggcagaagcagtaggaccgcaccatggggagggagccggtaatcctcgacaacatctcctccaagggccaaggctcgatcggagaaagaacagcacgcacgcacgcactttgtttggctgtaaagaggcgcatgaacgaacagaacggagcagtactgtggtctgcgtttttatagctgtctgtcagacacagtggccaaaaaaactccctaattgcgttctagtaatgtattatcagtaaacacaagcatctatcatgctaattaacaattactcaatcaacttgaaattaataaaacaacaggggttgtcggtggagtatatatgaatatgagtgggatatgaggattgaagggtgagcagtagagtgtgtttttctctgcaattaatagctagccattaattagtagtaggggtgctacaaatttatctgttttttttaacggatcggccgagtaagaggggtggatcgaggcttgaaggccagctagcaagagaatgatcagttttggtaggaggaatccgaatcttatctcatcagttcttgcttcggttgagcctttacctagctaagctacctctgtattctctgctgcgttaattagggaccatcgagcaatgctatgctcgctccggcgagtacgggggaggccggtgccattaaagctgttgttcttcaagtacagactacagagtggcgactggcgagccgctcactagtgaagaactgatttttaccaccggttcggaaccggttatagcaactggttgtagcaaatcaggactaaaatctcgattttagtaccagccatttaaccggtactaaagatgcatataaagtaaaaaaaaaatttgtaggatgcgggattcaaactcaagatctctcacctcagccctcacgcgtattactatcccacctagtacacatatctaacttggatagagatactttatttttaaactaatcctgcagacatctttcataccacttggtaacaccaatcggtactaaaaatatctttagtcccggttggtgttaccaaccagtattaataacaaccgggactaaagatcctccagcattagtctcggttggtgttaacaaccaggactaaagatgtatttttaataccggttggtataacatcaatcggaactaaagattcggttataaatctaatcgaatatttgtgttttgggtaccacgataaaagatcactggtggttggtctggagcttgttcaactccggcgagacagtgtcacccttcgtccttcgatgcacgcggttgtggtacaaatcgagatccactgtagaaactgaagagaacccctccggtaccatgtcggctcaactggccacctagtttgccccatcttctgctttttttaaacaaaacacaccaaacaatgcgatggtttgtattgatatagcatgaaaaaaaattacaagattacaaccctagaagattgtaaccaggaaaaacaaaataaacacgccacactggaagtttgcagcttctcacacaacctaggaaaagacactaccaccaagtcgatcgcaggcctacaagggtgtcgcaaaacgccccgccaaaaactgactccacacagttgattgttaacgagctttcagtcatcctcacgtacagaggttgggaagagggaaagggcaagagagaagaaaatccacttgtccctcgctccaacctgatgaggggggaatcatggcgctcgaagatgtcttcgttgccaactcgaggaaccctgacctaggctttcgacttcaacaccctcacccacttgtcgtcgccatcctagagctccacataccaagcaacttctactatccacagctccaccgcactggcgccccaccaccggtgagcgcagacccacctttgtcgggtctctcatgtggccatcgccgctcctacaatggttgccctcccactcaccgtcactgcaactggccaccaccaggtgcctctcccgctcacgtcgacctcccactgctgccgagctagtacagctggccgccgctagatgcctgttgatgaaaaatctgcgctcggccgatggtgctagatctgtgttagcgcgaaccaagtcgacgagcacaatggcctaagagatctacttagctccagtgtaggtccaaaacttgatgagatgtgggcgtgccagtcagtttgattctacaactgacaagatagataaatatgttgatcagcaaagagtcgatcggctgacaagccgatagagcgattccagccgatgtcgatagggttttatgcaatcggctatatgtccaatgtagataataatataaagacaatcggttgatcataatgtaatataacaataatataatccagtagaaattaatcggctaaaataagtgatccaatggttaaagcatacatcgattgaaggttcgatgtcattaaatccaaatgattaaataaacaatgaaacctttgttgccatcggctaaatccaacttgtatctaatccttgtgagccgatacaacgtccagataactcatcggttgaaaccacgatgaaacccttatgggcaatcaaaatgcaggctagagattatggttctaaacacgactagtgctgatgtagcgcaaagtttgaaaagaaacataatatctagacaatcaagcccttgactgatttttaagagttgtggataccttagctaatctaatctggcaaaacaatttagccgataccggcaaaaaccctaaagcagatcctaaccgatacaagtaaatcgagctaccaaactagattaactaagatatatgatatgtaggtaggcaaacatatcaaccgaatcaaagcaatccaagagattgaagcgatgcagccttaaacaacaccaatgtagccgatacgaagcaaagcaatccaaggaacatagcaggagaggcccccactgttaataaaactttattagtaagaaggcaggaatacaaagaaaattacaaagaggaaatccaactaatgactactaatttgtctctctcatttaatctaaacaataaaaggagtatatcatccttatggagctgcctccaggaagacaaagaaggaagcttattatcaaaaataaaaccatttctttacttccaaatattccaagaccctaacagaaacttttccatgaaacaaagaccatgatatcttcttttagcatccatcagcattaactccaaactgagagaggtattccaagatatgcccacattattccaacaattttgagcaaaagggcataggaaaacgaggtgaagcagagattcaattgaggtagatgaacaaagcacgcagttcaggtcacaatttggaggggcacaatgcttatggtctatcatatatttagtgttcaatctgcccattaaaagcaaccaaccaaaaactttaattttggaacttttccatagccaaatgaaatgctgacgcaatcttgtcttgattttgattacatggaaaatgctgaggttgtgcctgttgattgtcctgtctctctcctttagcaaattggagctgatatgtttggtgcttcactggaagaggtgatcccaggaggcggacaagcatgtttcctgctgaagatttaggctcttgcttgggggggggggtggggttggggttgtggagagtggaaagagaatgaaatatcaggtgcaatagcaccattcggtgtaataatgcaacttccattcctccttattggatctagctaggacgtatggcctagatcaaactcctcattcccactgcacattttgcaaaaaagccagtcgtctctattaaaagtattttctttagtccctgtagcttcctcttcttttgtctccttattctcgagacatatgtgtgagaggattgagagtcacacgtctcgccgtccgatggccatccttatctctttcaaccctatcctctggctccacttgttgccacaccagatcagccattcctacttgtcgccactgtcggatttgccctcctcgtgcatccttgaagacgtgtgttgcctcgcacttccttggcattggcagctcgccttgcccatcctctacgctggaggctctcacattggtgttgtaacaaatagcaaattaaactgaaactagtatatattttttatttttgttacaacatatagaaatcaaatttgaacatgcatattttagatagtgatatattttatattaaattatcttgttattttttttctaatttttttgttattattttagttggcatgcaaaaacctctcctctggagtggtgaaaagacttctggcctaagtgtagcatactactacaaattttgatacctctcagaatctcgagtatcaggaggttaccaaattacacgaaagtttttctacctctcggtactactcaaatgtcgaaaatttttctcttgagcatatatccaggtgtaaattacttgtgtacattttgaggtgaggagttgacaaataaaacaattttattgtacgtatttaggtggaaaagaaaaactgaataataaaatgtgccgaattttcttatgtatcacacatcataggtacaacatcgcgcttgggctgggctccgcattagattgcaatacctccaagactgcaaccggtgcgtcgtgcacgggtacatcaaaccggcgaatataatgctcgacgcgtcacgcaacgccaagctcggtgacttcgggctagctcgtctcgtcgaccacggagctgaacgccgaacgaccgtgggattacatcgatccggagttcgtcaacagccacaggccctgcgtcgagtcggacgtgtacagcttcggcgtggtgctactggagatcgcccgtacgtggccgacggccaactttgtcgtcgaggcgagcccccgcgctgctgagctttgtccgtggcatgtatgaccgtggcaacgtgctggacgcggcggatgagaggcgcaatggcgtgttcgacgagcggcagatgcagcgcgtgctggtgatcggcctctggtgagcgtgccacgacgcgacacgtcggccctcacgtctcgcaagctgtggaagctctgcgtgcggtcgacggggagctgccggtgctagctccggcgaggactggtgcagagcgttccttggtggaattacgtacgtgctgcttacggtgatctgtccgtcgaattctccacgccacatgcaacagcgtaccttacttccagtgattcaactaatctactagctgcagaagaatgaagaatcttaatgcacgcctcatggcatgtacaactctgttttcactggatgtctaggtttgaactgctgtgataaacgtcttacgtacttacgtgtgagagatgtccatttactcgcattgtgatcttctttaattttaaccttacgagtcattccatctataactgggactacctatacatttgtttaaaaaatttcttctaaaaatatcaaatataatatagtagaaatgtacaattatactgtaattatattgtaactcacatgtaactgtaatgtttttctagaaaaagaggggggcctctcccatttcattaataaaatgacagtagatttttatagagtcttgttacaaccatgtaactacaatgtaactcatacgtataacactggatagctctgcagttgatggtgcccttcagaagcagcaggaacaggaggaattgctcaagaacaagccaggcttcggctttctttgccaatatatatgaacagctggtcgatgaatggggcttcagggcccatgatcccaaccattttcttaccaaagcattctgatgctaccttcctcctaaaatttataacattgtttagttcatatttacactaaccaaaatcataaaaaagaaacaaagggagtctattctgccgaaaaaggaaagaacttgactcctctgttcctcctgcaaaaagaatgttagctcaagtggaatagtaccctaccttgcaatatgtttgaggaagaaatcatacagccaatgcctctacctgtcctgccaccagttctaccagaaaacccattcgaaagagaaactggaagtttgttcctgaaagtaatcctcctactttgatcaaggcaaagaagaagtattagagttagattagacttgtatagcctagatatttgttgtatccgtatatgtctcttatttaagagtttgttgtaatatctactgtattggatatataaatataaatcgccctccacattgggttggtgtggcgtctcataattctctacatggtatcagataccggtttccctctcctttcctaattcgccggcttctctccacgcgttgcccgtgatctcgcgacttctgctcctgccgcgatttgtttttccctcgacgagattttcgtcgccctcgacgcgtcccacccagcgtcgtgttttttcgttgtccccaccccacgccgcgccgtgccctatcaacgcgtttttgccgctcccacgccgcgcccagtccaccgcaccgtgccctgcccactctgctcgcgccgcgccttgccctctccacgccacgccgcgccgcgctctgctcgcgccgcacccctgcccgctccttgccgcgccgcatcctgctctacgcgtcgcgtcgtgactccctcttctctaagccatgtctaccgagtcttcttcctcctccacaacctcgggaacaatggcatctacgtcttccggttccttttcaacctctgccgctagcagtggggagtctgccagtgcaatctttgtcaatccttatgccaccgtcaacgtaaagactcatattccaatcaccctggagttcaagcaccccaatttcaacaagtggaaggctttcttcaccgcaatgtgtggcaaatttggtcttcttcctcacatcgatggtactgctcctcctcgacccgacgagtcggcttgggctcaagccgattgctgcgttcggggttggctcttcggctctgtttccgatgcaatcctcgatgtcgccatggaacctgaccaaacagctcgcgatctctgggtcgccatcgacgaactctttcaagcaaacaaggaaccccgcgccatctatctgagtcatgaattccactcacacacacagggtaatttgtccattgctgactactgccagaaggtgaagactgccgccgatgctctccgcgacgtcggccatcctgtcactgaatcgcagcttgtcctcaacctcctcagcggcctcaatccgcatttctccagcactgccgacaacatcgccggcgcccctgtcctgccatcctttgcatcggcgcgcaacactctgttgctcaaggaactacgcatcgccaacgacaccaaagttcagaatgagacagccatggtagcggctgcctctcctgccaacaacagcacctccggcacatgtgctgcctcctcgtcgcaacctcgcggtggtagcggtggcggtggtggctccaacaatggtggacggcgcaaccaacgccgcaacagcggccggaacaacggtggtggcggcaatggaggtcgacagaactacggtggtggtggctatgggaactctggaggcggcggtggctatggaaattctggaggtggctatcctccgcaccaagctaggcctcggcctggcggcccgtgggtctgcttcaatccatggcccgtgcaacaacaggctccatggcggcctactggaaccggcgctggcttgcttgggccctatcctcaggctcacactgctttcaccggcccatatgtttctccaccaactctaggctggcctcctgtgcagtcagtgcagcccacttgggatcaacaaggtctggttgctgcccttaatcagctgtctgtaaacagtccgaatccctgggtgcttgacactggtgctacatcacatatgtcctccaccgacggtattctcgtcactcgcctccctaattctcatactttcattactgttggtaatggtcatactattcccgttctatgtcgtggcacttcttttctacctataggaaccactaagtttgctctcaaaaacattcttgtcgccccttctttggttcgaaatttactttcagtttgacaattcactcgagacaataaatgttctattgagtttgatgagtttggtttttctgttaaggaccttcggacccggcgcgtgattcttcgctgcaatagtcgcggtgatctctacacttcacctactgccgtccctagcattgctgctcacagcttccttgccgaatcctctacattgtggcatcgtcgacttggtcatcctagctcagctgctattcagactcttcacaaattagctattcttccttgtaacaagatagatcataagttgtgtcatgcctgtcagttagggaaacacactcgtttaccgttctctcggtctcagtctagtacttcttctccttttgagcttgttcactgtgatgtgtggacctctcctgtcttgagtacttctggctttaagtattacttagttgtgcttgatgattttagtcatttttgttggacttttcctcttcgccacaaatctgatgtccatcagcatattgttgagtttgttgcctttgctaaaacccagtttggccttcccattaaatgttttcaggcggataatggcaccgaattttttaaccagaacacaacctcctttttagccatcctcggtaccatccttcgcctatcttgtccatacacttccccacaaaatggtaaagccgaacgcatgcttcgcaccatcaacaattctattcgcactcttctcatccaagcatcaatgcctccgtcttactgggccgaagcactagccactgccacatatttactaaactgacgaccatccacttcagtccacaactccattccttttcaaattttgcatcacaaagttcctgactattctcatcttcgggttttcagttgtctttgctatcctaatcttagtgccacgactcctcataaactctctcctcggtcagctgcctatgttttgacatctcacaaaggctatcggtgtttggacatctctactcgtcgtgtcttcatatctcgtcatgtggtttttgatgaacaaaccttcccgtttgcggctactgccccggctgcctcttcttttgattttcttctacagggatcacccaccgcggtcgctccatcctctttggatgttgagcatccatgccctctcccggctcccattcttaagtcgccggccactgatgatttggccgaccctgatttatatcagctggtccgtcacagaagaccgatgccatcatcatgtgctttggatccggttgtctcggtggagcacgtttcctctggtgccgatgctggtactacgggcaggagtgctgacacatcttccccaaccgaacaatcatcatcgcatgctgcacaaccaactgttttgcgtgatgttctttctgctcagcagattgtttctccgtatcggcatacttatgtgcgtcgagctccacctgttgctgttcatgggccaatccgtactactagggctttccgagctcaacaagcacaagatcagcagcgacactctatggtaactcgttctcaaagtggtacacttcgtcctgttcagcggtttaattatacagctgtgcatactgctgtttcgccggtcccttctaattaccgcagtgctttggctgatccaaactggcgagcagcaatggtcgacgagtacaaggctcttgttgataacaatacatggcgtttggtccctcgtcctcctggtgctaatatcgttacaggcaaatggattttcaagcataaatatcattccgatgggactcttgctcgacataaggcacgatgggttgttcggggttattctcaacaacatggcattgattatgatgagacgtttagcctggttgttaagccagctactattcgtgttgttctcagtattgcagcttctcggtcgtggcctattcatcaacttgatgttaagaacgcttttctacatggcaatcttgaggagactatgtattgtcagcaaccatctggcttcgttgatccttctacgcccaatgcagtatgtttgttacagaaatcgctctatggattaaagcaagctcctcgagcctggtaccagcgttttgctacatatattcgtcagttgggtttcgtctcttctgtttcagacacttctctctttatttataaagatggagaaaatattgcatattgttgctatacgttgatgacatccttcttactgcttcatcatctgcacttcttcagcacattactgctcgtctacattcggagtttgccatgactgatcttggtgacttgcatttctttccgggcatttctgtcactcaatctccagatggtttattcctttctcagcgacagtatgcggttgatttattgcgacgagctggtatgtctgaatgtcatccaactacgactcctgttgattctcgctgtaagttatctgcgacagatggagctcctatttcagatcctacggagtacaggagtcttgctggtgctcttcagtatcttactctcacacggcctgagatcgcttatgcagtacaacaggtgtgtttgtttatgcatgatcctcgtgagcctcatcttgctcttgtcaaacggattttacgttacatcaagggcacactacatattggtcttcacattggaatttcgcatcttgactcactgactgcttattctgatgctgagtgggctggttgtcctgattctcgttgttccacttcgggatattgtgtttttcttggtgacaacctagtttcttggtcttccaagctacaaactacagtctctcgctcaagtgctgaagctgaatatcgtgcagtagcacatgttgttgctgagtgttgttggcttcgtcaactacttctcgaactacatatatctcttgcttcgtctactgttgtttattgtgacaatgttagcgctgtctatatgaccgctaatccgatgcatcatcgtcaaacgaagcatattgagattgatattcattttgttcgagagaaggttgctttaggacaggttcgtgttttacacgttccgtcttctcatcagtttgctgatatcatgaccaaaggtttgccagttcagttagtcactgaatttcggtccagtctttgcgtccgtgatactacttctcccgctttgactgcgggcgggtattagagttagattagatttgtatagcctagatatttgttgtatccgtatatgtctcttatttaagggtttgttgtaatatctactgtattggatatataaatataaatcgccctccacattgggtcagtgtggcgtctcataattctctacaagaagttgcgggaggggtttgtaaactctcaagaaaacatctcctcgttatttgcatgtcatccaaattattatga

SEQ ID NO: 18195 - DNA, 683 bp, Oryza sativa
aattcctgcagcccatctgccggtgtggcttgctgagtactgtggttgtactcattcttgctctatctttctccccccccgttcagtaagagaagctttggagaagatgtcttaggaggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactccttttcttccttcttcaaatttcaactagtactagatggtcaggtcagtgaagaagaagacatcgtcagttgtttgccgaagctccggaagactgcaggatccgctagcgaagcaaaggaagcagtgaagccagctgtgaagcaggagtgaagatcttggagaacccgtcgcagaacctaagccaccctatagggt

SEQ ID NO: 18196 - DNA, 678 bp, Oryza sativa
cccacggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgactctgcaataaatcataacaataataccttcagcaccaaccattctctgcacctacggcctcagcaaagaattgtcgtcgatggaagaagttgtttctctccccgacctactccaggccaagcaaagggcaatcaacctcaggagggcgataccaagcagaagaccgtcatccgcttcaaacagcaatcagaaggaagcttctcctgtgaatgatagcaatatgcagtcctatcacatcatcacagaaccaatcaaggatgatgcagtcactagaacaatgccagctatatctctccagaatcaaaatgagcagccacgcttgtggttttcagttcactacttatcattgtgtaatcgaaagtttgcagcaatcatgtagtaaataaatatattcatgtctataaacagtgagcttgctatgtttatggatgattcctgttgaggatacaatgtaccgatgttaagcaccttccctttttgtttaaggcagggctttgtattcatgtaataagggagacatgtgtaataaaa

SEQ ID NO: 18197 - DNA, 5452 bp, Oryza sativa
  unsure (1)..(5452): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactatctattctcacatattttactttttactgagaggactttcaagttacttaagtattcctatgcaattacaggggctgacctggactaagtaatctaagccaaaaaggcacgtggtacattttggtgttgtttggataatgagaaatggattaatttcccacctatctgtaactttttaatcctaatcattcattctttccacctcatttcatccaaacctttattcatttcctaagcccattccacatctcatatcctgttattcgaacgggcccttctgagttttcaccatactagtggcccaagctataataaacatggcccaccatggcccacggactagtttttgatcttcattggatgaacagtgatgtcatttcgaaaagttcacttcagatccctctcttgattggatctcatccctcaaccgtaaaatcgggtacatcgcatctctcattttttttttcaaaatcattgcaaatatagtctcaaggaggttttggatggtggtttgccggtttcaagtgacgtggtacctacgtggcgtgttggcttggtatttatctaacatgacacctaaaaataaataaaacataatgccacccatgtgtcaatcacaagaaaaccatctatattcaatgaaatcggcagctcgccgattcgttcaaaaaaaatcataagaaaaaaagagaaaccacaagctcacatatcagttggcattttctagccatacttcagctagtttcgcagcctcggcttctcttcctcctcctccgacatggctagctagctccaacctcgtcctcccagatggcatgcaagagtggcatttggggttgttcattttcgaaggatggcatatagtaaattctcctcgaaaccccttctcttcttaatttctcgtttcattgacatataatccccactcaaccatgtagtacaaaacaaccgtcgaacccacttgagaaaacaaaatggaccagtattgataattgaggaacattgtatacccggtttcacggttaagagacaccgattgaaactgatcctcaaatcgagggatgcaatatagaattttttccatatcatttttgcatttccttggatcctgggttctacttctacgggtcaaaaacaattgtcctgaaaacgcagcaagtttcttgtactccgtgcaacaaaaaaccacacgcatatgtctcacgttgctgatccacctaaagtctcttgccacttttaaacatcacacacttggagttgagcagttgactctctgacaggtgcgccccccgacgcaatccaagtccaaaaataatactacctccgttttttaatagatgacgccattgactttttctcacatatttgtccattcgtcttattaaaaaaattacgtaattataatttattttgttatgagttgttttatcacttatagtactttaagtgtgatttatatcttatatatttacataaaatttttgaataaggcgaatagtcaaatatgtgagaaaaagtcaacggcgttatctattaaaaaacggagggagtactaacaataacccaatggtggaatattgaatacgtactttccttttccacccacggaaatattctacgcacgaaagccgcacacgtgtttcccgcgaccgcgccacgtcaccgcaaaaacaaaaccggggggagccacgtgtgcccacttccggatagattcacgccgacccccctacgtcacccccgcgggccccaccacagccactgacacgtgggccccacgagtaaccacctgttccgctactagaagtatagtaggcttcgcggcggtggtgggtaaaagcatagtgagctctcccgtgccaccgacaggtgggccccacccgcgcggcggaaggttctaggctctccggcgaaggttctggaaggttcgggaggaggggggagatgattctgtcggcgctcgcgacttcggtggggatcaacctggggctgacggtgctcctcgcggcggcgtacacgctgctccggcggcgcccgccgtacgtcgccgtgtactcgccgcggcggccgtacgcgccgccggagccgtggctgcccgcggcgtggcgccgcaccgaggccgacgtccacgccgccgccgggctcgacggcgtcgtcttcctccgcatcttcgtcttcaggtcccgcttccccgctctcctctcctccaatctcggcatacacgctgctcgctttactatgggggatggagattgacgaggtgatgggggattttggtgttgtgcagcattagggtgttcgcggcggcggcggtggtgggggtgggagtgctgatgccggtgaacttcatgggggaccagctgcggcagattgacttctccgatctgcccaacaagtccgtcgatctcttcagcgtctccaacgtgcaggatggctccaacaagtgagctatttcgagcttcctgatgcctaatttttgttcgcggatttagggggttttagtgggttttgtgtgattgttagtgcttcaaggtggatacaattgtttaataataataaattacgtgccagttatagattaaattctcgttttcgtattaggaggatgaatctcttggattgttttaatgaggttgagtattttgtttatgctagtggctattgagatgttcagagtatgcttcactgcacagttttagcttaggattgctcagtttggtgagcactttgatggttttcttttcctggccactagtctatttataaagcatgatttgtttttctcattggttccttatttttctgaaattctaatttgtattttctttgttttgaaggggcaaagtgctaactgcatgaaaaaaaacacagagattcactaattcacctatttgatgctgtctcgagaaaatgcgttgaatctctctcataaaagaaaaatatttcttttagtagtatttagaatttgatgtcggtcatttaaaatccaacggtttcaaacatgggcctgcatgcttaggccttctccatggctccaggctgatgcgaccattttgctagagtgttaagttgatttctgtctggaatttatcttcattattgggctagcaatgcatagcatactcattaccggtggtaatgtggtgaacagattgtggctccacttttcggctgtgtacatcataactggaattacatgctacctcctttattatgtaagtaattgagtattttgcttctttttggctacctactcactgttttcaaactaattcaacattttacttccctctcttatatttgtgctagacctaataatttgatctattttcttgattggatacttcttcagtcaaactcatttgatatttcagttaccataccatgcatgcttgtcagatctggcattcatttatcaaattcttctcgttgaagttctgctttgctgctttcctgttttcacatctttatgtacacaatggtttatgttagctctttgcaggaatacaaatatatttctggcaagaggctcgaatattttatgacatcaaaaccactacctcagcatttcacagttctagttcgagctatacctgtaaccaatggtgtgtctgtgagtgatgctgttgataagttcttcaaagagtaccattcatctacctacttgtcacacactgttgttcatcaaactggcaaactccgccgccttcttgtaagattcgattgttttgctactttctattgcttcagtatggttaacatcctatattttatccatggttccaacaacacttactatatggggtgtctatagattgacttattgcattgggtacatgttgttgtattgaaagtagatagtgataggtttgcaaggcttgcattttgtttcagttataatcaatatgttttgacaacttattagtcctttacttaatttcttgtgactaaaacaactcaccatactggaagttgctattttactttcaacatgtcacttctaactctatgttattagtctgatatatacatctagtgattatgtcgaaaagtagattttagattaaacgtggagtcacagaattgctcctttccattgtttcataaataaaatacagaaagtatctaatatgtttctgcctagacatgtcaaaaaattcaaggggagaatatatacatcagttgtgatcctcatttgaaagttgtccgtatcttatttcacctttcaacacgcagatttattccctttttttttgtcatgcgaacaattttgtttatcctaaatgtatcttaagaaatggtacaccagtagattttcttcatcagctggaaaactaaacagttccatctctacatttagatcaactttataatgtctttgttctatattgcttaatgtaatctccagttccattttgatagttaactccatctctgtccagaatgacgctgagaatatttgcacaaagcttgccaacttgaagtctgtacggcgtacttctggagatcctccaggaaaatttcttggaatatttggcagaaatgatcttgttgggaaatatcagaaaaggctggaggacctagaagaaaatgttagaatggaacaatcagacactactaggagcagacaggtgcatatttctaccaattttggtcttgctcaaaccatgatgtttcaatatctccctatctgtttgttatactgcattggaattagtatttggctctggtgctcatctttcagaaaatttatttataaacatttcaatattttgtcatctgttctgattttctttacatctctttaggaagttcccgctgcttttgtgtcattcagatctcgatatggtgctgcaaatgctatttacataagacaatcagacaagcctactgagtggcagactgagcatgctcctgatccccatgacgtttattggcctttcttttcaacatcattcatggacagatggatatccaagtttgtagtctctgtagcttctattctcctgatactcgtctttctcctagtttcggcatttgttcaaggactcacctatatggaacagctagagacatggttgcctttcctgagaaatatactggaaatgttagtgtttatccatcta

SEQ ID NO: 18198 - DNA, 5367 bp, Oryza sativa
tctttgcaaatgttcttactggctcagtacttggtcaactcgagatattccttgatccgaaggaaatccctaaaaggcttgcagttgttgtaccagcacaggtacagcttgcatttattgttgcctttaaaactgcttagtgagtgaaaaagctctttgttttgtagatattactgtgggcatttcaatgtaaaatctgctttcttaaacaactgtctcttgtgtagtattgtattgatctcttcctcaaccgtgcattgctaaactgtcctttgtttatgctttgctctacaggcctctttctttattacatatgttgtgacatcttggacaagtatagcatcagaacttactcaaactgctgcccttttattccatttgtggggtagctgtgcaaaatgctgcaagagggatgagtccaaacctccatcaatgcattaccatagtgaaattcctcgggttctcctgtttggacttcttgggctcacatacttcattgtatccccacttatcctcccatttgtactggtttacttctgccttggctacttcatatatcgtaatcaggtgagagtgttgcagttcatttatcagtactttataattttctgttcttctactcatggagtctttatgctgtaatatacctggttggaatttggaaggacatattagtacctaaacctgttcgaaatttggatagggactgaccaatttgtttgacacttgcatagtaatttactgaacttggttttgcagactgccagacttggtacttaaaattcacttacaccacaaggtgtagatggaatcaggataacgtgggtccaactataaataactttttcttagaatgtttagcacataatcgtagtgttgtttcctgaaagatgatctagataatctagtgatgtaatttgtaacactcagtctgaaaggcatccaacagttcaagtgttataatgaggactttcttgtgtgcaatgattgcctggtagaacagtagaaattgctttcccgcaagtatttgtcttctttcacatcttgcaaataagattaagtttggttttttaatctcagtgagatataagagaacaaagaacgccctttatatgttcttaagaatttcgagaacttccacagttgatttcatgcgtttgcaacggtcacatcatctataataggtgttgtaaatacttcaggcgtcctatttatccatgcatttggaagctggtatcagtataccatgtattctggttacactggtcctgcaaagattaaacgatgtattatttgttatatgaaaaattgccaaatcaacaccatgcattctaaaagtggattgtttagctggataaatgtgccataccagagaaccatgacacagttaaagtgatatttttccatccatatagtagttaataaggcaccaataattctacattgcatcatagtaatactttaggcccctttagtccgaccaatctggaatttgcacgtgtttaactctgtaaagcattagtttatccgtgtacacttcttaactttgcatagtacaaatgcagctttttaatgtatattcacccaagtatgacactggtggaagattctggcccattgtgcacgggggaacaatattttctctggtgctgatgcatgttattgcaattggagtatttggattgaagaaacttccccttgcatcaagtttgctggtacctcttccagtgctgacccttctgttcaatgaatactgccggaacagatttttaccgatcttcgaagcatattctactgaggtaatgtgtttttcattttgtccaagggtgcaatgtaattctctttgtgcaactatgtatcaaaacgaacaacgcatcattctggtccttttagcttatcacttcgatagttcgattagatataatgtgtattcacgttctacctttcgtgctgcagtcattgataaagaaagacagagaagaagagagcaaaccagaaatggcagaattcttcagcaatcttgtaaatgcgtactgtgacccggcgatgaaacctatccaacactcctcgaattcagatgaacgcactacacctctattgtcttagatccagataagtaatagcttgcagccttactgtcatggcgtgaattttggtttgacaccgataatcaggcatacaacaatacacctgtgcttcttcttgtgatgttactgttgtaaagcattactacatacttgactgtggagttgttgtgcatatttgatttgtacatcttaatttgtgcttactgcgtagagatgaataatgcattgctccttaatgaagtgctgtcaatgcaaacctgtgtgggttgtacttctagatatgtcaaatcacctttatttgttcccttcaaattttgtgtatatggatgttcttttgcttcaacctattcagtaatgagattatttggcagttggaatgatgtgatattagtactgatacattattatcagtttatttgagttatacttgtcctttttttgtgcccctctgagactattatcatatacaatttgatgccaaaattcagttttctaaatacaaaaggtttcaaaccgtgttgaacagaacataatttgttagcctgtttcctatagtttgctatcacccaattaattatatgctgagattatttgacaagttcatactatacagtcactgtggttttgaaaatgtcatgctatccttggatttggagcatactgttctaatatataaatagacatccattttcttttgtccctttttgtgtatgattctcaacatgctactccaacaaagatttgcttgcatcagattgagcatatatatacatgatcacaaacaatgtgaatatgggccccaaaaaaaatcagtcaattaaagatcagcaatattgacgtattcctaatcgattgttctattatttggcttccatggaaaggaaatgttcatgtgattgcctgccacttggagagagaacagaggtgtagtgttgtggtaatctatcttaagcaagcctgtaattagactcgtactgaggcttaagtcaccattaacaaagattatgtgattaatgttccatttggctcccatgttgtctgttgtagtagattgttgaatgctgatgaatcctaatgtggcaagtagaaggccatgtcaatgtaagccataggccttaaaaaaaagggtaggagtaaaagccatagcatattgtgccatttgtcttgattgttcaaaggaaatcttatgtagaaacatgctatgatgctgataatattttcctattggcaagttgcatggacaaaatgatatcacattcataccaagttggtatccctgttagtagtttaatccttttactttgtcctaaagtctctgtcatttgtgcctcacaacttgtagacatctgctggattcttggtcacaaagcatgaaaaggcattgtgatgtgaacatgatgacatatctaattggaatgtagggtatattgttagaggtccttttctaatttgtatgtcctcagccaagacccatggaactctaatttgcaactgattgcagccttgaccttttcatataccctatgtaagaccattagctagacttgaccaagagactgtgaaggagatgatgatgagaggctaggtcaagcagtcaataacagcaatataagcacgtcatgtttgatctcacaaccattaaaaggaagagttagtgactaaatcatgtacatatacaaaaccgattacatgtttgataaaaaaaaatcatgccaaaataaaaaataaaaatatgttgttatagtagaactcgaaccatgcatgctactcaactctcatcgaggttttaccaaaatgaaaattacaagctaaaatttaccaaataaccactactatgaaacacgttttgcagatggccaaaacacgtttttacatgtggccgggcctacgaccaaaggcaagtgaaatatcgcgtaggattttgtgggggaaatagttgttttgtgagcaatattgtttcatgataagaacatatgtgttccatacttgtagcatttctgatcatttttatatgccgataatttttgttttgaattcaccaatgggaatgaactatcctttaaaagctggcagcagatggatacatgacatatatgaaaagaatatgaatggtatattctataccacgaactactttagtttgtaagatttttttacccattagaaaccagtgatagagttacaatcattggttgaagaaagggcgtgtaaagggacattggatagaccgtcatcgtcatccatgacaaacacaaaaggataacaagaaaaaaattatatcgaagctgtttagattactcagttcaactggggatgaagtaagaaagcatagaattaaccacactcgttgcagttacttccaacaagcaaatatcatacacaatttacagtacacctttgccttgagaatcgtgatatataatttggcaatatgtgcgtattttttatactccctctatcccataatataaggcgtggttaaagttggcaaggtctccaaaactaatcttttacttataatttctcatatagtataagatttgtagcaacaaaattataaccatatgaaagtaaatttaaatgtcaatctaatgatataatttttaataaataaaattcatttcatattatattaagtattggacaaatgttttaaatcttgaaatgtgtgcacgccttatattatgggatggagggagtatatgagtatttcatgtatgactttgtcttgtatgccgtacagcttagaggacaaaactaacatttacaaagtataaagtatgaatctgatgaattgttccatgatttttaatgagtgaaggggacatagttattgtggtgtatttggtgaaactctgaacccttagcttggcaaaaaaatggactaattaaccacagttaatctcgatttactatgttgatcaaatgcttcatgctaattaaattttattcacaattataatctcacctgctagctaagtagatctttgatacttgctctcatgctatgctttgtttgagaccttaatttcaatgaactttgcattaacaaaactaagctggatcactaattaacttccctagctttttggttgtccttggacgacgttataatccaagttatgtgcattgccagtaataaaattaatggtgcaagttgcatagaatgtacaatgaaaacatactactagctatgtagctatagttgatcaattcaatcccataattcaccaaatataatataagccaagcttgcatcactctaaaaaggttcttgatt

SEQ ID NO: 18199 - DNA, 7993 bp, Oryza sativa
gtccatgtgtcgagtatgtgcgtacttatgtgagaaaccaatagcttaaatgtacacgcgattgtaaaaatcgcttaccatgttgcatatattaatttcttggcctttaggatcacatataatttggtgtggtggttccaatttgcatgttataaatttgatatgcggatgatcaaaagcccttgcaagaaaaaaccgcaaacattaaccaatcgcggagtgtctgtaaatgcatgggaactatattataataaggcaacaactcttctggtgcggtttacgaaataacaaagaggtagaatgacttagagttgtaatagaaaagtattcaacaatatggcacagtccatctctatgggcactccactccactcctactgttataatccaacatatattaattgttatagattgaaaatcatgtttctctagtatgatatgtgtcttcccaacaattttcttgagaaaaaaaaacataactttgaatgctgattacagatggggagtatagagcgtgagctgcaaattgatcgttctcttttgcctaactatatatacaatgtatggaaaccacaaaagtcttagcatataaaaagtgaggtaacaatgtctgcactactgcaatctcaatgtcatgtccacctgtcaatgactaggcctacacaaccttacactcatatcattagctaagcaataacatcaactgaattaactaagtatccaatctctctcactagattaccttgtccccctccacaatctatatgttcatcacaaacttaaaccacatctcaatccatcatcatcaacaacaacataagcacaatagattatatatacatgcatgcaatgattttccaaaacaatactaataatttggtctaataataatgatactacccatattctttacttgacatcctaaaatctccgccgtcaaactttctagagtttaactacaactataatacattactagttagcaaattaagggtctgttcacattgtagccaaaataaaccttaccaaattttggcaagatagcaatattgtcaaaattgtagcaggatttcttatgtatttaccaaatttggcaacaaactaaacgtagacatttttttggcaactttaccaaaaaaatggtatggttgaaaatggcatcaaagtgaacatgccctaaatacttccgcttggccgttacacaactcttgacgttttggacaatgttaagatcaaacttttatatctttgcctctaaacaattctaaaactgtttaaaggtactggaacaaaatatatgtaaatttttcttacaaaatattataataaaagtaaaagtttgtttttatttatttattgtatataatatagtgaaaaaacatagtcacagatataatcatttcatttttaatataaaattacaaaatgtaagtctaattgtcatctcaatgactgcaaaatactaaagaaaaaataattaatcaaaacttatgcacaagcggttgcactttcaataggtttttattactaaagctagggatttatcactggactccatctcttcgagcatgtgtcatgaacgtatttgcaggtgtgagtgtaatgtgcatacatgatggtgtagacgtatgcgtattctgacagggaaaaaaactacaaaggtagtatacacaacctctctcctaaaatgtacgatgtcgttaacttttcgcatactatttaaccattcgtcttattaaaaaaactacatcaatattatttatttatttgttgtgaccatcaaataaattataatcttaacctatatttttatatatctatactaatttttttaataacacgaatggtcgaacgttatgtgaaaagtcaacgtcgtcgtacattctgaaatggagatagtactcgttagctaacttagcagttagcacaacataattatcagcttgtgaaagcttctccaccatctccatgtccccccttatatatactcctcgatgatcgccatggccttccacctccaacctcactcactcactcaagccaagctagcaatcgatcgatcgagctcaatgcctccatccatggcgacggcgagggtggcgtcaccgtccacggacaggaagcgcaaggccagcagcgaggacgacatagacgccgccgccgccgccgccgctctcacctcgccgctggcgccggcgagggggaggaagcggttcgtcggcgtgcggcagcggccgtcggggaggtgggtggcggagatcaaggacaccatccagaagatccgcgtgtggctcggcaccttcgacaccgccgaggaggccgcccgcgcctacgacgaggccgcctgcctcctccgcggcgccaacacccgcaccaacttttggccccgcccctcgccgccgcccgccgccgtcgcgccaccggagacgacgacgacgccggcgctgccgtccaaggtcaccaacttgctactgctccgcctcaaggctcgcaaccagcagtcgtcgacgccggcgccgcggcgccgcaagaagccgctctgttgcagctgcagcagcagacgccggcgtcgtgccaggaggtgttcgtccgtagccacggcgaggagtacggcttccacgtcgacgacttcctcagcgacgcgtgcagcaacgagcagtactccggcgacagctcgctgggattggacgacgacgacggcgaggtggaagacgaggaggaggaggagctcgacttccagttcatggacgtcgcgcccggggcgtcgtcggcggcggcggaggcggggctaggcggcgagggcgcgctgtgctcgccgttcgagatggtcgccgcggagctcggcggcgcggtggacgtggccgcgcacgacgcgatgaggcagatggactacgagaggaagatctccgcgtcgctctacgcgctcaccggcgtctccgagtgcctccggatccgcgccgccgccggcgccaccgccgctgcgcgggaccacctcaccggcctgagagaggcttgccggaagaagcagaaattcgccgccgccgcggcggcgccgccacagcagcaagaaccatctcctcctccacagcagcctgagacgccggcgagctcaggcggcggcatgtcggagacggcgagcggcggcggcggcgacggcgacgtgctgatgtggagctcactggacttggctccgatttgccacatggcatagttattattagtagtaaacaccatacttaattagggctgtggaatttcttggtgatgacatgcatgcatggctgatggctcagacgagagctctggaaattattagctttgcttagctttgccccaattgttttgttcaacagcaaaaaataaagtttagttatcctctctgatcatctcatataaaccacaaattatagataatgaagtgtttgatgtgtttgttcatgattttcagatgagcactgtccctgtatacattgcagtttctcctctttcccttgatgttattttttttttcttttgtgatttgtattcagttgaattggtcatcaggtgtcaaatataatactactcccttcgtttttttaatatatgacgctattgacatttggcacgacgtttgactatttatcttattattttataaaaaaatataaatatcatttgttttgttgtgacttattttattatcaaagaaactagccttagcttatattttatatatttacactaaatttttaaataagacatacataaacgttatgcgaaaaatcaacggcgtcatataaaaaacgaggtagtactagacatgaactgtgatattctttgtattcatgacagtggatgatccactgataaaatggagccaaggaactccttaattagtccacttgactacatgagaagagctgaccaatatctgctgatattttttatcagtttaaattccaagtatagcacaggccttcatttgaaaagaaaaaaaagaaggcatataaaaaacatgaggcataacaaactgaaacattgacaggacaactaagcaaatccaaacggtagataaagccaaacaaagtcatcaatctatcatttttgtggtttgtagtctgtactgtacatgatgcacctctatgtaagtaatacagagaaaaggaaactcaagcaaaactcgcactttaaacggatgccgcatgcaagacccagtaattggccagttagcttcatagtcaccatatcatgtgaaacttgttagtgtttcagacagttaagaggagactccttagcttgtcaagctcatgttgctgacaaaattgggcgaactgcatcggtgaaatcttcatggaacctatgctcagaaaatctttgagcgcgttttcgtgctgctgttgccatctcatgcctctctgcctccggcatccgcaagaccttgacaattgcctcggcatattcttccttctcggaggctagaaatcctgtctgttggccatcctcatctagcacaatgtccatcattggtcctgccgatttatgggctgcagaaagcatggaacattatggctttgtttacaaatcaatggaatgacttatgacccaggcattttggttggtggcatcagaaaattcaacttctacttatgtatttcagtggcgtttgcttcatgccttaagaaattcatcctgcccttggtattgaacccctctgaccccccccccccccaacgcgcgcacacacacccaaagcacaaaaaagctaataataacaacaataatatgaaatacggaatgcagtcatatttggacttattcaaaccattgttatgtgcgtaccagacgaactagaggcacttatcctgtataccattagcagtcttggaaaatggtattaatccaaattttaccaagtcaataggcccagataggccattcttgacgaaaataaagtgctatgaactgaaaagatggatagggcaatctggaagttacttaccaattggaatagcaccagcagccatgtattcaacaacacttatcccaaaatgctcatctgtcattgaatggagcccagcaacagcaccacctagaagctgtaccaagtccctgatatatccatatgaatatcctgtaagtttactgaaagaacctgcatggtgagaatttcttagtgctaggttgaccacactacctgtaagagatatccttgtggaactccacaagctcatctatgtgtagttcagtggatctgtctttaagcttttgcaatctttccagatcctctttattccgacagcttccaacaaattgaagctttggcttaggaaattctggacttagctttttaagagcaattgcaaatgcctcaagctgaagtccatgggcctgggagaaataaatgggtacacataatttttctggaatgagtgaacagtaagctcttgcgctaagaatttgatccagttatagtaagttggcataccttttctggccgaaactgtgcaactgatataagaataggaggtgtagttgatctttccagtggaagcatctgttttatgcaacaagtgtttctgatgagtaccaatttaatcatcttcatttgattaaaaaaataatgcagtagtaatttatatcaatgccttgcttggttagtgtgtccacatggctatgagatagagctaattaggattgacaaccaacagtttagaaatatagatgtctagaatttggatatacctgcagggcagaagtatcacatggagggtataccctcctagtacgctctggtatcctccaaatattttcaatatgggatcttgtccacgatgaatttaccatcacaagatgtgcgcatgaaccgaccagaccatataaccaactgaatatgctatagtagaggatttgcatcgggacaaccatatgctgcatccaaaagaatactctgttattctttgcagctgagaccattgtatacaatattaaagatcatatgtaaggcacagagaaaagagaacatatggcatatgaaaagcacttttaggttgccatgatcaagttgggttgaccaatgattaggtacaaagaaagaagtttacataaatatataatctgttaatgcatgatcatgttcatcttgatatatctaataagagaggactgaacaagtcatatgttaaaaacataaatgatagatgaagaatgagaaaaagggatgactatgacctatatgattctgatccctaagaaacaagaatgcacccatgaattaaacatatcgattctccaataagaagaattagagttactctgtgaagtgcccaccttccagcaatacgagagtcgttattgtacatagaactgcgttgcttaacacgttcaaccatgtcagaactgattgtcggataatgagtgtagcagatgaccttacagccaaatagccgagccagtggatatgtaaaagcatagccgctcgtatcaaaatagaactgcggggtgaatttgttaagagcttcccatgcaagataaactgagccaagactttgcccaatcatcgtgaagtggggatacgtgcttgcttcaatccactttctcctattcaagtgaacaacctgaaaatgaagcccagacattttttatgctagtgcgccataatgtatctgattatgctaagagaaaacaccagataatgctttattttatctataaaagatagtactcaactttgatctccaaatatagatcagacaactcctttaaaattaaaattcgtcatcatttttgctcccttttactgtgtttttagcctataaaccaccaaggattctgactaggaagacaatcgtattctcctattaccagtgttagccttcagctacccgtccgaattgtataaaatcaacgaaatcttgtaataatggcattatttctttcatatatgggaacagagcatctctgagactacgtttctgagatcatcaagcaattccaccaaccagtgactagtgagatcccaccgaatttcaccctaacttaaatgaactatatcagaccaaatatttacaagaacaacttaataaacttctcagaatatccatcatttgagttaaaaaaaactaatttgcagaaagacgagcagctaggactgagatccagttttcaggaaggaaggggcacatctttctgaaggcccgatcgatcgggggacacaggaaggaaggaattgaaaccgaacctgcggcgggcggaggaggcggaccccgaagcggtcgagcgcgcgggcggcgaggccgtcgggggaggcgtcggcgtcgccggtgaagacggcgcaggggaggcccgggcggagctcctgcgcggcgcgcaccgcgcaccagagcacccgctccccgccgccgccgtcgttggtgtacgggtggaagaaccccgcggcgggcgcggggtgggggtggcggcggatgcggcggaaggcggcggcgaggagcgcggcgaggagggcggcgaggccggcgaggaaagccatggatggattttgcgacgcagatggtggggtttgggttttttgggtttttgggtaagtgggttgatgggttcggcccattgggccgagttatgggcctaggcgactgtagcatggggtgccttctgttgggaaaaagtacaccaaatgtccctcaacttgttatcgggatacgaaaacgtcctcgaaccgcaaaccacgggtcccttaactatacaaaaccggtcacaataggtccctcggcggttttgatcccggttttgtcctacatggctgctgagtcagcgtgggatccacgtgtgccctacatgtcatcgtgccatgtcagcctaccctctctttccccctcttctcatctctctcatctctctcttctctcagggcagcgaggaaaggagcggaggccatgccggtgtcgcacggcctctcgcggccatcctctcacaccgccagcgccgccggggaaggagctgaggggctgcaggaatt

SEQ ID NO: 18200 - DNA, 9996 bp, Oryza sativa
tcccccgctgccctgagattagagagagtgagagaaatgagaagaggggaaaagagagggtaggctgacatggcacgatgacatgtggagcccaggtgggtcccacgctgacttagcggccacgtaggacaaaactgggatcaaaatcgtcgagggacctatcgtgaccggtttttgtatagttaagggacccgcggtatctggttttacggttcgaggacgtttttgtatctcgatgataagttgagggaccttcggtgtactttttcccttctgttggaatgagttcgctttaagttcctcgtcttgaactccgggtttgaatcgtgtccttgaaccgtagcaccatatataatgcgttcttgaacttgccataccgaggtatccaaggtcctagaacagtattgtcgcgatttcgactaacgtagtagtgagtggccctatgtggtgtcccaggacagtattgtcgtgatttcgactaacgtggcactgagtcaacatggaccctatgtggtccccgcaggttagtggtcagtcttcctcctctagatctcctcttgtttctcttcctcctaggccccaagtggtcatcgacagggcagaagtgcaatgtctgataggatagcagctggacggtggcaccacgctaccgagctggactagtcgtcagactgcagtttttcaatatttgttggttttcctcgcttttttttagcgatttttttatgggggaggaggcaagaggaggaaaaaggacgaccatgctttttaagtaattaatatatgaaaaatcgctatgccgcttactcattgcgcagaggaagatcacggatgttgcataattacttccatagcaaccaaatggcaagaactttgtagctactggatactgtgtgtgagctactggattaagaaaaaaacggatggatccagtacttgcttgatccacttcgtcgacccattctcggtcatatggtccacgaaaatttttaatctccattgaaatgcacaggcaatctaaagtttgcaacgggacaaacaattgactaaggatagactttcaaatttgccaccaagctaactttcaaaaaaaaaatgttaccatcaagatatatgttgccggcttcgacacatatatagacataacattatgttttcaaaaaataagaaaaaaaaacataacattatcacaaatcaatgaatatggacgtcaaaattcaccatatataagcatcgatcctggctttttttttatggtggaaatctagctacttggcaagtcaatattctggctcgatcgtcctcgatcttactggctacgtacggtaatttccactggtcacaaaaatatgttatactattctggatatgattcaaatcaaacttgttgttttttacgtggtttatatgccgcagcttgagtatatctcacccaatgacccaaacacttgataatgttacgaatttattgtctacttttacaaaagaaaaggaaagaaatttagtgctgaaagttacaattttggcactaaaatatccaaaaatggtatgtttttctgtggtaagagaaaatgacccccttttttttaagaacggtataagggcatgtacaaaggtagagtcggatatgagctctacgttatctagagactagcatcctacaacagttagagacaatatggtctctaatcattaatgtatcaaaatattttttcttacttttctttcctttgtttcaccatcatgcaaaaaaatttgctctaataaatgctaagagtcgactctgagccgttgtcatgtataacaaccatactcctttctctttcttctatgtcaccaaatttacttgcatggcaatagagagagaccactaataaacaccgttgtatatgccctaacacatgaagatgcttctatatatgcatgttttcgttgatgccggtgcgaatctagctgagaatatcatctggatcagcaccattacatacacgatgaaccttgaactgaaaaaaataatgttttaccacaaaacatttggaaatttcaattcatgcggtaggctgaccccagaatctagttagtttcatcctgagcagagctagcattcactagcggatctagaaacattttaagtcccatgcaaaacccactagcatagataatctgcattgtacaatactctactaaacaaaagatttttctggacaagcatcttaataggttgcagtcgagcgataagtgtctgaatctgaccagttgactggccgcaagcgatatacattatcgtgtgtggtcgcttaagagatccgcacataataatgcagccgcatcacatgtggtcctcttaaacgatcgcttaaaagacctgcatgcgatcatggaccatatatccatcccctagaccgagctactaccggttgaacctgacgtttctctctctaaaacgaagcacaaaaagatgatgttttcaactcgaaatctttgcttgcctgcgaagatatatcttcgcgtgagaggttgggccgtccacaagcgaaaaatggtgatcttcacatacacctgggagcagacggaccggccaactgcacatgaaaatgtttttcggccatctagagaaaaccctttctataatagtgataccagcaacatgccattttcatttcttgccttgtgtaagccagttagggccactatctaggatagtcacattggctctatcagggtctagcatggcaagtggcgacatctttgatagtagctcttcgagtcaacttgccgtcaactgttcgtctgttgccacccatttcttacccacatgattttcttggatatgtgagttcatctgaaccgttaaatctcaatcggacggaggaaaaaaaataaaaatcaacagtgaatattttgaagttttctcacataagaagatttatatgctttatatatgggggaagatgaggtatagctttacgtgcataaaacataaacgtttaattattcaagttcgctcaacaaggcgcgaaaaaatggcgcgaaagctgttcgttctcgtgctcatcatgtgttcgaccaccgccctaattacttgcaccaatggcggcgccggcgacggaggcgaagggctccacatgaagctcacccacgtcgacgccaagggtaactacaccgcggaggagctcgtgcggcgcgccgtcgccgccggcaagcagcggctggccttcctggacgccgcgatggccggcggcggcgacggcggcggcgtgggcgcgcccgtccgctgggcgacgctgcagtacgtcgccgagtacctcatcggcgacccgccgcagcgcgcggaggcgctcatcgacaccggcagcgacctcgtctggacgcagtgctccacctgcctccgcaaggtgtgtgccaggcaggcgctgccgtactacaactcgtcggcgtcgagcaccttcgcgccggtgccgtgcgcggcgaggatctgcgccgccaacgacgacatcatccacttctgcgatctcgccgccggctgctcggtcatcgccggctacggcgccggcgtcgtcgccggcacgctcggcaccgaggcgttcgcgttccagtcgggaacggcggagctcgccttcgggtgcgtgaccttcacgcggatcgtccagggcgcgctccatggcgcctccggcctcatcggcctcggccgcggccgcctctcgctggtgtcgcagaccggcgccaccaagttctcctactgcctcaccccttacttccacaacaacggagccaccggccacctgttcgtcggcgcgtcggcgagcttgggcggccatggcgacgtgatgaccacgcagttcgtgaagggccccaagggctccccgttctactacctccccctcatcggcctcaccgtcggggagacgaggctgccgatcccggccacggtgttcgacctccgggaggtcgccccggggctcttctccggcggcgtcatcatcgactccggctcgccgttcacgtcgctcgtccacgacgcgtacgacgcgctggcgtccgagctggcggcgcggctgaacggcagcctcgtggcgccgccgccggacgccgacgatggcgcgctgtgcgtggcgcggcgcgacgtgggcagggtggtgccggcggtggtgttccacttccgcggcggcgcggacatggcggtgccggcggagagctactgggcgccggtggacaaggcggcggcgtgcatggcgatcgccagcgcggggccgtaccggaggcagagcgtgatcggcaactaccagcagcagaacatgcgcgtgctctacgacctcgccaatggcgacttctccttccagcctgccgactgcagcgcgctctgatcatccaagccgccccgtgtcataatttcgtaaataaaaccatacaaactttttattaatcaatcatgatataatcattcacaagtaattaatttgtggttaaaaataaggcagttaatactgtccgttattcgagaatggaggtggtaatttgcctagatgtttcttcagttacgtaccctaagacaaatcttgatcgatcgagatgtaatacataattgaagaaacatccactgtctcgatggtgatctagcggggtagggggaactcaagtcctcccaacaccccacgctggatccgtccctgagtagggcagagagggagcgacagtagtccaagctaccgtggcaatggcggaggggtgtgatgtcgccagatctgcctctccccaaccctatcgcatgcagatatatcctttgtcacaatcctccatgattgcatcctcattgagctctatcggttgccaccgctgcctcattaagcttgtagccctagactaccccttgagctctatcaccgcctcctcgtcgagcatgatgacaatgatgagcggtcaccgccagctcagcctccccctctggccctctttctcattctctcaaatctctagccttttctctcattctctcaaatctctagccttctctctcattctctcattctatctcggctcattgagaggaagtggatagctagactcttggagttggagcttagtcaaacaatttcagttccactcaaaataatagtgaagctaactggagtgctataacaaatgaactaaagagatggagttgggtttaggctgctcctcaactttactccagacctagctgttggaattatattaggagttggagtcctactaaataggcccaaagaaaagcggatttactatttcacttacgacaatttttttgtggctcttatatttcactttttcattcataggatgttacatcaagatctgtgttcttgtatctaacttgcagttacatttagttccagtgcacttacactcagttacagtgcgccaaaaatagatttacagtagttttttctttagatttatgattcttgacatgtttgtcttttttgttattggttgaaaatagatatattagccgaaactgtcacgtggacgacatattagccgaaaccaccctcaaaacaactatgagagtcgttttgcaccgatttaaatacttgacggggaggggatgatataccctttttacggttaagagatacgaatcagattagattaggtagaatggactttctgcacgtctttgtaataaaaaaaacaagtaggcatgtgggccatgttctatgggccgtttcttacgggagatagcttcgatgggctctatcttttgggcctcctgtgacctacatgggccgcacttctttctatgatgggccgggggcccacatggcggcatcctctctctctctctctgtgcaccttatcccctccaactccgatggtgggcagtggaatctgctcccctcaaaatcacctccccaccccccacctcctcgccgccgccgccggccaccgccgccgccgccgccggaggggggagggggacgacgacggaggcgcacatgctgggcacgacggccgcgcagccgacgagcaggcggggcgggctctccacacctcgtacgttccccccctctcgttcgtatgcttgttcataaaagctttttgcgctcgcgtttctcatccgcgcggtgggctgtcgtcgaaaggcacgaggcatggatttgggtgcggcgtcgacaagatgaatcgtctgcggttggcgattccctccgcttcaaagaatgtgagccgctgtgggaagcttgctatctgcagagcacaaaggtctttaacttctaatctatgatgtttgtattcttcaggcaaagtattttttgagtctggatgtagagctaagctactcctagttttatagtctctagatagatatagcatttcatggtagagactagagaatgaatgacaggagtgccctcttaacataataataatagtattattacctaagtggatttgcagtatagttgaattggagtcataaactcaagtgattctatatccccatgtcctatttctaatcacagttgagtcgaacaccgccacaatggaacagaattactgtgatctttatcgaagatggatatggccattggtttgatgcatcatattcttcagtagaaaatgattgctgcaactctaccattgcaagtaggctgattggttactttgtaacttttagatagtggagtctggggagctgcttcattaaatggcatattctccttcatgcacttctttggataggtcttgttacatttggacaatcttgtaatcaaatattcttctataatatgttttcagctgcatgattatagtatttgtcagaatgtcctgtgacagttgatgtgatttgcttgtacagtgaagattctaaaggtgggggaggattcttgactggatttcttatagggggcgcaatcttcggaacattgggatatgtctttgctcctcaggttttgtcaaacctttttaaaaaaattatgcgtggcatcggcacatgtgaagtagataaagaaacccctcatatcaaatgttgattcatcatgtttattttacaatacactgccttactctctagtgctgtagcgaatagccaatgtcttgttgagcaatttagaagattatgaatttctgattttaacaacctaacatatccatgctcgagttgactaggtggagtgctaagtgctaactaaaagttatgcatctgatatactattcaccgataataatgttgttcataagcaatgctttgtgttagtcttctatggtcatgctcggcgctattgttatctggtttgcaaagattgttaatttggaattggttgttaacaacatagcgttcttgagcagatcagcaagacgctagattctttattagatgaaaatggacaagacagtgaatctgatgaacatggccttgtaaagccacggtatggtcgatattatgatgaaggtttagaggtaagaaatcaaaaatatcgctggactattctacttgtaacatgctttttctggcaactaaaactatgaattggatccagaaaacccgtcaaacactgggcgacaagataagccaactaaacttggcaattgacaaagctgcctcccggttgaagcgcgttgctggcaatgtggaaaaggaagctattaatgatgaatcagaagtagagacttcttagaacttgtaccttttcaggagttctgtttgctgagtaacaaatctttttgtaaattattcgtttcctttacactgtatgtatatgttaatacacaaacccttcatatgcataatttcacagacttgcatagtatattctagattattgccacaaaaatttgctcccaagattcaactatacaaatttgttgtgactgctattttctttaagcctccgtatgtgaaattaatgactactaatttttcttgagtctccatatgttaactatattaccatcaatttttctaaagcttccctatgtgaactgattgagtattcactgaatttgcagatcgaaatatcttcattcaacgataatgagcttgtggcggaaaacttgaacgagcaaggatttgtgcaaggtgaaacagcaacgtagtgtatgtttaaaacaggcagcagagcagccgagtaaagccatcagcgcctttggaacagtaagtagactgcagaatcccaaattgaaaaaatgttgtagccaatccatttatattgtggctaattttggggacattttttctgcaaacatgtagctgaactggatggcctgtccaaccgattggcagcatgaaatgaatgaaacattttcgtatttgtgcccttttccctgatactccttcagtgtttttgtgatccaagcagatattgtgatttgcgaggtagatctatctctgttaatcgtaaggtacggagaattaactcgaaatcctaggcctaacccctagatagctgctgattaagggcttggttgacagctacagatcctatctccaaatccttcatgatcccaaagactaaacaaaaacgtttggctggataccaagctccaaaactccatgcatgcttaaacaagtatgaaaacacttcatttatgaacatgaaaacacttctggtgatgctcgttacccaattttgctgttcaaatttaaattttatttgagatttgctcccccctttccgataggatgactttgaaatcgtataggtaggagaacgctatttgagaaaaccgtatttttacaagcgttgagaaaataataattttatgaaatacaagaaatttcatctacacaactacacaagaaactccaggatgtttttttttcttttcgctgttgaataattgattgtataggaaacacatataacaatgatataaataacagctgtacaatggaaatgcaagtgtgtgtgtacacaacttggcggatgaaacctacttcaattcttccccattttgaaacatacattaattctcctttatattgccaccaaaaattttacaaaacctatccctaataataaccaagccatcacactaagtagatcaactgttagggctcaagattaaccagaagatgatgatgattttgccagtaattaccactccctccgtcccataaaaaaccaacactcgatgcgacacatcctagtactacgaatctagacatatttctatccagattcgttgtactataatgtgtcacatacagagctagattcactttttggacggagggagtagaccatatccatggcgtcgtcgcgtacagcgtgtacttctcccaagagcgagaggaggaagaagaaggagagatggtcagctaggacaccgaatgcctcgtgttccgcgacggcgtcgacctcgtctcctcgccggggctctccgacgtgtcggagctgctgttctcgccgctgctcgccttgccagaccacagcttgctcagtatcttcttcggcatcagcccgccgccgccgctccccttcgctgacgccgacgacggcggcggcttcttgcaggcggcctgatcgccgccgccgccggagacgccgccgttcttgttgttggcgaggctcatcgaccggaaggaggtgacgtcgacggacgtcgtcgtcggcggcggcgcccactggtcgtcctcggtcgccgtcgacctcgagctgccgtacgagttgccgtcctgctccctggggaggagggagcgcgctgccggcggcatgtcggcggccgccgccgccgacgccgacgacgccgcccggacctgctcgaagaagaggacctgcacgacgacgcggagcgggaggcgctcgttctgcacggcgtgcatgctcgcctccggcgacagcttcttgcagtccatcagcccgcacagcctcttcttctcccccttcgttaaacccggatgctcctgcaaaaatgtcacaagctgacaattagctcaaaagttttagactgtttgaccaaatctcgtgctaaatgttactccccccgtcccaaaatatgagggtttttaggtga

SEQ ID NO: 18201 - DNA, 3617 bp, Oryza sativa
ctgcagcccgtttttaggtgaatgtgacacattctagtacaacaaatttggatataaagcatatccaaattcgttatactaggatgtgtcacatccacccaaaatcccttatattttgggacggagggagtagatatctataaccgggggtgtagttcaaaggtttcgagcttcttggatcatgtgccatgttactctatctgatcataaatatttcacaaatatttgacgtttatgacagattttgtcaaatttggaagtttcttaaaagtttgatcaaatcttggtctaaacgtcaaatatctataaccggaggggagtagttcaaaaattttgatcttttcgaagcatgtgtcatgtcgtcaatgggggggatgtggtgaaacataccttgagatacatgtcgatggcgcggtatagcccgtcgtgcacgggccgagttgcgaggggaaccatctcagtgagggcgatgaacttcgagagtgggaggttggggtccttcgcaatctcagccagatacccatcaaccagcttcgcgatcgcgagcttcgagctgcgggagacaccattcaggttgtcatcatcaccatccatggcttcctgatcatcatcctcttgtagcttggcgccatcatcgtcctcgcggtgctgcgccatgaactcctccagcatcgccgagatcatgtccacattgtacatggcggcctcgtcggagttagcggggataaggaggtccgagaccgaagcctcatccagcttcgcgccgatcctcttcgtaagattgtcgcggcacgcctcatctgatcccaacaagcatgaggctctgagaagcttaaggaggaaagagcatgggactgaaccttcctcagatggaagcagggagatgatggtctcaagagctgcagagtgccttgtgcagtcaagcccattgctgacagcactttccagtgagctgaacagcctcctgtgagcataagccctcagtgcctcaccaatcacctcactgctgattctccccttggccttgatggccatgatgaccttcttgtacaggcacatctcaaggtcacagagatcctctacccaccagtctctgggcaccatctgctgcttccttacgccgttccagtgcgagtcgaggccgttctccgacggtagcttcctcctgttgtaggtgtatgaccactcaacctctgacggatcgatggaggccttcgtcgcgatcgaatcgacgcagtggttgatcaccttgaggttctccgaccatggcagcagtgacttggttgtctgaagaacgatgatggagtccttccaggttctgaatatgcttgaggacaggaacacatcgatcttgtagatgaggttccccttgtcgatcgtctcgaacatctcaagatactcggctgcgcagcgggctgcgaggacgttgtacgcgttgagggtgacgatcatgccatagcagaacttggcacagatctcgaatgctgcaggtccccccgggatgtcggagatgtctatttcgtcgttgctctcttcgtttgtcgatgccaccaatgtttgcaatcgcgaactcttcgacaaaagagggaactgcatttgatttcagcaagagtatgagtaatcattatattagtcacaagaaaactgctgataagctaaattaaatatatttaatcatgggaagaactgcactgaatatggatcagctatcactaactccattaaccatatgccaatagaggactgaaacaaaatattttattttaaatagaatgttatggcatcaagaggagtacatgataaaagaaaatagtatcagagatacagaagttttgaatcagttccaaaattcaagtggaattgtatttgtgttcaagaggttaaaatagtggaggggagagctcaaagaagtaacaaaaacgttcagtcaaagggacttgagttcagataaatgaaaaatcatgtatgctcaacagttcaaggctgtacttggccatttgctaaaacacagagtgttaagacttaaagacagtaaacttgtaagatagtagagttggtgtgtaccttgtgaagataaaacttcacttcccctacaatgattacgatgtccgttgccaactcagttgcgacaaacctgaaaaatacattttcatcaaggacacattcaacattagcatcacagagatgcattacaagcagagttaggacaaaataaataggtgtaaagcaccaaagataagcaaataagtatcatttttttttctttttgaaaaaaagaagtgatcagtagttaaagcaccgattttctgaagattgttttgttatgttttttaggggcatgtttgcggtctcacagctgcttaattgctatatatgaatatcttgaagatcatttttgagagagaaatggctgttgattattttgtggagtaattgagagactaataatcatgttgcacaatgaggactcccacaaaactacattagaaatggcaatggaggaaataatagtgaatagctgataaattgtgtgcttttatttatatgactgactacaatgattgcaggggcaaatggtcacacaacagtggatggtgaaaaggttgtcttggaaaaaaaagaacattgaaacaaaaggtccctggaatctaaacaatctaataatgcatcttcatgataaagatgaaatgacatatgaaatcaaatctccagccccactgaaaccgctaagtgtaacaaaaggagagacagagtgttagcctagaaaaagtgccatgggcaaaatgataaagcaaagaaagcagcaaattcatagaaattaactctatgcatgacagatataactaatcaaactgctcagtggtccaaggaaaatgatgacaacaaattcattgtacaaaaggttagggaattgtagaagtttcattttcaaaatggaccacagctccacctaccaaaccctatgtctgctagatgaacattaaacaggctagtggaaaagatgcaatgaaaatggcacatgctccgaagcacacaaatcgctcaagaagagatgccattggcaaagaatcaacgatgatgcatcctataaagatgatcaattgtatagatagccttttgcaagctatcatgagaaccactgctaacaccacaagtgctcactttcacaaaggtcttttgggtgccaatcattgtcaaatgaaaaaataatgtgaacttcactacaattttcctttttagattcagcctagttactagatataccatcaccagaaactacaaaagagggtgttatagtctagcttttaattaaggtcacattcattcaaatttctctgatataaatagtgtgaaaaccctcccaaacaaaaaccagaaccatagtttcttgggagacaaatacaacagtctatctttcagtggatcatttaaaaaagctcacaagcatttccctactcaagattacagggaaacaacatgaattcagtaccttcacttatttaactacactaacataactgcacagttaggcatcactttgcgcccacatagctaaaggccatgcttccatgtgaccagctaacgatacggttggcccctcctactgactacattaa

SEQ ID NO: 18202 - DNA, 22038 bp, Oryza sativa
gtgaatttttattccattatctgaaacttaagagcacttcaattcatggactactgatccacaaaataaaagctagagctcaagtgtatcaattcaaaagtcaaaagttactaattgtgaagtgaaaaaaaaatcatctttataacctgaaaaaattatggacagaactagttaaggactatctcacctgatattgtttccctctgtctgaaacacatctggctttgatccaagcttcatatacttcatcttgacacactaagaacaacctcaatctgtcacctttttttcttcttatttcccttctttttttcaccctttactttactcctccaagtctccaacaatcaccagaaaatcagaaccacaagaccaagatgaagcaagagaccactggcacacaactatttactcctcagtccagagggcaagagcaactattaactacaaagatctatgccctggtgtcccccttgccaagaaaccaagtattctctctctctctctagattggcaaactattgacccaatcttgtcaagctctgggtccaagaaagcacaatgccaggaaaccaagaactcctccaagttggaaattggatcacacaaacacagaggaggaggcagcacctgcaaagcacaagagcagcatcttggggtgaggagacagtgagaataattgggtgagacaatgggggatgggttgtagggagaccatgggtacaagcactagtgaggctggaatcttatcaggttgcagtggggaggaaaaaccacatgaaggggtgcaaataaaaatccaatcttgagctctttttttaaggaatttgcacatgtaaggcagtcaaacagtgagtaaacaaagaactgcatgctgcagaccacaggtttgagcaaacagttgctttccttggaccaagatgagattggagtgtactgaaaaaaaaggaggtggttctgattaactgatttccaaccagattttttagtggagaaaaaaagggagattttttttaccctcaagactaacctaattcaagaaaaggaacagaactaggaaattaatgttcatagagatgaacttggaataaagtgtgtatacaaaaactggaaatggctgcactgcagaaccatcaatccaagaaaaaaaatccagtagactggtaagattttttttcctctcaagataagtagtgaaccaaccaaacaaaaatgtacagactgatgaatccctaaacaccaatcccacacactgctccaaagctagataacaccatctctctgaattgagtcacatttccaatggaagaacaacttcatgagatgaggtctgaacaacttcaacacaacctaacagagaaaacataaaggaaagatgaacttacaagaaactgaagctcaggcaagatccttttctctccctttgaagatcaaaagatccttagccacaggcaagaactgatgctgatgcaggagagctagggagaaaaatacaagaagattgcagagaggagagggagaaggaagagaagcagtgaagtgaagcaggaggcaatcaagcagacatcttgcacctcagctcctgtgtgtttttcccgggagggacagcttgttcagcttgctttgctgctactccaatgcaagaagggagggaggtggtaatggagttagtttggcttaaaagatagtgcccgtagggtggggggcaagtggatggacttctctgtcctcacaaataaaatctctcattttttcccctctttaccttaatttttttaaaagaaaatggcaataatattttccgttggatggaagacgcatacatcgtacgtacatatttcctccgtctcataaaagacaaacctagtaaataatacgtctgttcagattcataatattatgatgtatcaaatctcgtattagttctgtttttcatgggacagaagaagcaaacaactatgcatgcatttcctatacatacacaaccatggatacacccctaacatatgctaaagagacccacaccttaagcatactcgcaatttcgtaaatgcagagtctcctaacatatgttcaagttgtcgaaatctctagcctttttaaatttatgttgaaaacccataaatatcgcacacatatagataggatataattatgtacccacgacgtaatacgacaccatattactggtgctttctagatgataaattattatcctcttaagaaaggaagaaaaagaagaataaatgtcctataatgtctcagacaatggaatggagaggggaaaaaaatgtagcaaaatatacacgcacatatcgcatcagttcctttcagacaaaatcaaggcccatgctgtgacctctgaggttccatgtcggggatgagcagcatctctcaccttcaattgacagtgaaggttaggagccgtgacactgcatccataattgcgtattttgcatgagagatgtgagattatattccacagtgtcatataatgaaagccgtccattctctgtcaggagttaatgcccaagagtgacagcattgtatacatggtccctctaattatcaattttgggaccccaaattaggccaatttggtacacgcgttgctgatcaatcatcaacttgtgcaattatggagataagcagagagcaaatggagagctttcattgatgacgatcttgatatgaaatccaaacacctcgcctcttaaaatatggctatttccagtgtttaaattttatgctgaaatataactactttgaagtactaagtactaattaaggggtcttcatagggatgaaatgtccaaaatacccaccatcccacacctatctggctacctccatcaactgacatttagtgaagggcaatctaatctttttacctccctttttattttgggaaaatttataatggcatggttccaatttacctttttatttttcatgagaaacttcaaaagtagctactatatttttatatggatggagtatttgatttcagagagagggaagctgtgaagggaggattaacagtggaaatgaagtatagaatatcagtcaaagtacctgatgtaatgttcaagaattttctttcaaaagatcatgttgggtcagttctgttctctcttttgaccaaacttcatttgtttacatcttcagtacgttgctttggtcttctccatggccatctgaagcaccggcctttccttcttttgacccaaatttgtgtcagtgtgcaggtttgactacaaacttcactaacttaaacttctgaagtaaaagtattaagcaaaatctaatgtaaacagagtgcatacaaatatatagataacttgaatgtatatacttatattaacatcctagcatcatggatgatccttaattgtgatgtcaggtaggatcacactacttgacctcagaaaaatagatgaaaaataacccccaactgtgcttaagaaggtctcatcatatccatcgtctccttaaacgtttcccaatgatggcgctccccttttcaaagtatattaacaacacttgtggtctactcttgcctgaaggcaagctaatctcacttcatctttcttggccccctccccaaaatctaatatacttttctctcttgctttctttgcatgattaattttcaagtcatatgcattgttgcacctgaagttttacaatatcatggtagcatacaaatgagaggtgacatacatgatacattggaaatcagcacttacaatcttattttagtccatgtttataatgtaggattttttttctttaacaatattaggagcttctcctacattagaaaattgtttactacctctttagtttttttttacttgatgatttgggcattgaaacggtttagaaattttggttgtgtacgtccgatttggatgcagaggccgagttttaatccactttctaacaattgtttttaaggaaattctactgcattggaaaactgtttatatttggatatttccgacaaattatactccacatcaccttgaaaatgtactagcaaatatgcacactgaggcctgcagctacatggtgcagtgccaaatagaaatagtgaaaacgtgaggtggctatggtgaaatggaacaaaacacaaagtacaagctttgctctttctctttatactatttatgttaggcttcaaactttttatctgtcacactggtgagccttgacacatggtgctgactccccacattgtgatcaggaatctgctcattgttatgagggcatgcctgtactacccttcttttctcctacacatctgcccctatctctctctctctctctcctttcattaaattttttgttgcaagatttgggggatcaattgtgcaggtattaatagttaagtacttaagtccattgcattggtgtaatagtgctgtgatctaggatcctggcatgggatttggattggctcacaagtcccaatggccaatattttgtctgccctacatatcagctcatagatctgaagatccatcagcatattttttgcaggttagctggcctgcattgcatcccctaccgaccaaagcaagggattcacatcccctgtcattactccaaacatttgctcccttttagacactgttactattaatcattccagtacaacatctcaattacataactgtttgctcgtgcacataatttgtatgatgagggaaaaaaattaataatgaaaacggtttacatcttcagcttttgacataagacacttaaccacaagttttgttcaagagagcaaaacgaaacatgagaaaaaaaagtttactaccttttttgttttgtccttgaaagatatcatgagttacaacagcaaaattgttccatgacaaatgtggcttgataacttatgtggcaacaaaatttagtgataagagaaattgtttagcttggcaaagctagcttcaaaataaacaagtaaacaaaccatatgaccaagagtgacatcttcagagagtatatgtatacatttcagtcagcttcaagaatctccatcctctgcctcatcagttgtaatcttcttctagaggacatgaatctccagcaaaagagggtgtcctatgatcctatgagggagaaagcataagctatggcctacactatcactgactactgatgtgagctgatttaccaccctaattcatcatagtgctgcacagaggatgtgtccatgttcagcatggcaaccattccctacccactttcttgtgtccatccaaccatggctccatcagattaatttgtcctccaaaagaaagactgatatcatctaagcaaaagctggttaacacaaaaaccatccttttgtcaattaatgactccatcagagagagattgagatgatggcaagaaagagactggagaactgatgatcatagtagtagtagtacagtacatacagtgtgtggttaggtgacaggacattggcatgcatggattggcagctttttaagtcaaagtgagatttggatccctctgtgtgtcattgtgtttcattgggaccctgtgttaggcaactaataaagctgtgattgtgctttgtgcatgctcttgtttggccaagaacatgatgacttggcaaaagaccctactagtagcatcatcactgattaactcttttgtggttgtttgcagtcagatgcaaaattgaactgtgcaaactctttctgaaatcctctaaagaaaacttttctgaaatcatttttttttggttgaataggagtactactatctagttgtcacaggttcacatgcccatatgcctgatgcttggaagttagaactcagagagaacaatcaactgaactgatcaccatgcccatgacttgccaagttggcatgtgttatatattctttctctcatccatgcttgctaggttcatgcatgggcatggatgtaatcattttcatcagtaattcatcatccacaaccatataagcatgcattgaactctcttgagaagtgagaaaaaaatattatgatctgattctctctcatattttcttgtcaacccattcaaagatgcatggcactaattaagttcatggctacctaattactcagagcatgaacctaataccaccaataactactgctacagcagagcttatgcaataactttgatctatgtagtaatgaacaccacatggcatatctagctagggacattaggaaagattcacatcaaatcttccatcatgaattcatgatatatatatcctcttgcaattgcaagggtctggtgtttcatttgccttcagcctggcccctactctgctgagtctgaacaggcacactactgtgcaagcatgttaatagtatggaaaaagtccagtgagaacagtgcccagattggattttgctggggctctccttgaagcaattaattaatcaagatttgattagtattccaagagtaaaacataaataaataaactttgatcttagctagaatctagatacatgcatgcatgtgtggctgaattggtccttggccctacatagagagaggtgaacatcgatcatgtcacacatccaacacttattcccctcctcttttatctttttcagctaaccaatccacatgcatttcagattctaacaagacattaggcccatttcttcatgtgcatctcaaactaggattattggatgattccacaaccttttttactttattgcccatgaaccatcagctactttgtttctctttccctttccttctctttaatttcggttgtcacactacttaattatccagatatgttgaagagtccatttcaaggattttaattggagagaataaagaaaatggatttttgaatggatagatatggagagattatcaatgtggtgaccctcttttgatgcaactattgctttcactgatccagtccaaatagtagtcaatgtactctatatgtggtccatatatatatcatatatatttgaagctttctaaactaatctgacatgttaaccgacaggttaagcatcaggccaaaagaaagtgttataccctgttagatactttaatttgcaaatatttgacataatgtgatcctttcattggttgagtttttcaaatcttaacatttgtataagtaactactgtccattatatatgtttcaacatcaaccaaagactatagtgtctaccaagtttgacatgtggtgtgatttgtctagctatattcccctgcaaattacgtgtctatgtacactattataagattctttattaaatatttccttaaccacacatttttttttggtttttgaaattaaatatggtcaaaaggaaatgtttttagttcctcggaaaagcaatgatttgctgaaaaagaaaccataggcaagctggcatgtttttttttttttgcaaaagaaaattgtttagcagccctccttctatatgttaaaagagagagaataatttgttttgttaattaacttgctgaccatacagttaacacagtacctgttactcataactacctttcaattagcaaaagaaggagcatccaaagagcacccaagatcacccctttgaaatggttccacataggatgccaatgccagtgccactaggcaattaattacaaaattaatcacatttaagaccaacaaaagccatctctctgtacttgggattccataattataattgatagttaacatgaccatcaggggagatgggtttagtttaggctagttgacatcatgtgatagaaggcaatgtggtgtactattcaagtgtacaatatgtagttgattaattaaactaatgagggtttgctccctgttaagtagtggcctgcaacaaggccgttggtaaaggtgacccatggaacgtgcatgccggtgtactgcctctcatgcaggccaccattaagtggtttccaagggttttatgtctctagaagttggactaagtcaagttataggttagcatcatcttaatccgtcttcaacgtctcgtgaagaatctcgtcatcgaaccataacaggtaaaatataggaggtgagaaattgaagatgccatatatgtaccacgagaaaatataaacaccgaaatattatgataaatagaatatgatatttgtactagaagaaaatataaacaagaaaacctacataagagagatgggggctgggtgcatgggtttgagggatgaaaacatagagggtccttagtgcaacccttatgtgttacaagcttcatcgattagatgatgccatagacatcataaggaagaggagttatattcacattaagtttgacttgcatatataattaaccttttaaaaactctacgtaatgagttcatgttatcctttactatggtcgtcaccgctctaggtgtttgtgtgttggtatagtgaagatggccacttcaaggaggcattcctactaatcaccatcatcatcatcatcattattgttgtaattattttccatttacatctcaatatatttgaccggcattttgtcgaaaaataaaaaatctatctaactaaattgagcataggtatacctaacggacggattgagatcctctgacttacttccctatgacgtgggtcactgacatatggaccctctactcaatgggcccatatatcagtgactcaaagttagaggattctcttcccaaacggacaaaaacatttttgttagcaattttggattagtgtggtgtgcgtccatcgtagcaacaaaatcactcagaagtgagagaatttttttcatttttaattttttttcttttaatatttacagaaataatctatcggcgcaaaaaattataaaaatagaccctgccaccctagtggagggcggcaagctgacgtggcagacggcggctcgacggcgccgtctgccgtcgtctacgaaaattgcatttagcccctttgccgcctaaatgcaattttcgcggccctaaagagcatttggctggtactttttacatcggcggcaagggacccagatgcaaaaagtaccagccaaaaagtactaggcctgggctggcttttttgcatgaaggccccttgccgcggcaagggttttcgtgcaaaaaaaaaccctccctctcccgtctgccgtcaccgcccgtccctcccccgtttgccacgtcagcttgccgccctagtagagggcggcagggtctatttttgtaattttttgcgccgatggattatttctgtaaatattaaaagaaaaaaattgaaaaatgaaaaaaattcgaagtgagaagccagcacaaatgcaggcccattgaaattaggcctgcagaacaagcccctgtccgactagtggcccagtccacccagagaggatccgcgaattcggcccggcccataaacccaacagtgttactggatcggatatcttacctctgttgggccaagcgggcccacagcgttaacgccattgtttttgccgggttaggattatgagcagaaacgaaaagaaaaaaaatatttttttactccgtttaatattacaatagagtagtccgtactaattacagcgatgaaaagtcgcctcggacgtccgatcggagcgctaacatcggacgcgtaattagccgtaagatatccatccaataactgatagcaaatcaacaaattcagggggaaatgggaaaacaattctccatgtgttgagaatgtacagtacatgttcgggttggagatgtagcagactgatcgaactatttgatgcaagtgcaaggctagactgattaattagctagactgattgcaaggctagtatattaattagttagttagttaattaattatgctggccaagaaacgcaggccatgcatttctgcaggctgttctaattaattagccagtgcaacagcccaatcattccaaatgacgaccaatagttaatcaaatccaatcccaacttaatcaacgaattgatttcatacaagtgcctacccgtccatccacatccacaccatgttatgtagtattgaagtattctagtattttagataagcctatctatgagcatattaaagtcacataagttctttttttaataatatatcgaaatggtttatatatgtgacctatgccgttaagcggacaaccaataaattctaacagaaaagaaagcataaggtgttaggatatccatcttcctctaaattataacccagttaaaataacaataaaaagactacatagatttatttaagccacacttgattttatctcgtttttcgttaacacgtttttaaattgctaaacggtgtatttcgtgtaaaaaaattatatagaagttgctttaaactactatataactctatttaatttcataccctaattaaaactcaattaaaattaattagttatatgttaatggtttttgttttccgtactttgattctatctttatattggtagaaactagcacgcgttgattaagggtgtgtttggatggaggatatgcatgggtggatagaacatggcggcccattttctgtgggtgtttggttgctgggcaggggtgggatagggcggcccagagaggaatattccccccagatgctggagcggctgggcgagctgggtgagcgagtcgtgtcaccccgggcgagcgagcgagggaggcggtcgcctgggcccgacgacgacgacgacgacggtgcgggcggcgtcggcgggaggaggcggcggcgcctacagccggcgggaggcggcggctggcaggaggaggcggtggccggcgggaggaggcggccgccggcgacgcctgccggtgacaacgacgatgcggactcgacgatgacgcggactcgacgacgacgacggtgcgggcggcgtcggcgggaggaggcggcggtgcctacagccggcgggaggcggcggctggcaggaggaggcggcggccggcaggaggaggcggctggcgggaggaggcggccgccggcgacgcctgccggtgccaacgacgatgcggactcgacgatgacgcggactcgatgacgacgacggtgcgggcggcgtcggcgggaggaggcggcggcggcagtgagccctagatctattgctttttttctttttttatatgtgtatttataatatggagaggaagtggtgtaaaattgctacagaatttataaaatgcatgcattatgcattaatttgatgggggtatattcactatctcaagtgagaggtgtccacacctacaaatccaacctactccctccaaccaaacaaaaaattggatcaccaaatccaccttcatccctacaaccaaacaaaaaactggatcgccatattcattctaccaaacaaaaaactggatcgccatatccaacaaaatatagaccgccatatcccatccaacattgaccgtgaaccaaacacaccctaattgattcaccaatcgatctagataactatagtagctggaataataagtttcagttaatcgatctagataactgattcaccaatcgatcatcagtacggcatgtgtgtgtacgtgtacctgcatatatcttctagatggatcaacgttcagttcgaaagaaagaagaaacttcctgaaaaagatacgtgttccatgaccaaaccaaagctagctagaagcctagaagcaactgatcatcgagcaagatcagatatctgatatgatgagaagtaagaacacgtaaaacttaattttacccaaaaaaaaactacgtagattggttttcaattacttaaaatctaaaaaatagattcatatgatatattaaagcaatttctgtatgaaaagtattcatgtactagcaaacataaaagaacagtataattcatacacgtacgttaattattactcggaggtgtgaacaggagtgaagacacgcgtgcacaccagggacttccatgcatgcatggagaattatatttgagtggattttgaccttaattttagacctgattaactagtgctaattcatgacttcgttcatccacattgccggatccagaaaattaatttgtcggtgtcataacgtgtttattgatatcatattatgattaatattatgattagatcatagtgttactccctccttccctaaatttgacgccattgacttttttaaatatgtttgaccattcttcttattcaaaaacttttttaaaatgtgtaaaactatatgtatacataaaagtatatttaacaataaatcaaatgataaaaaaattaataattatttaaatttttttaataagacgaacggtcaaatatttttaaaaaagtcaacggcgtcaaacattttaggatggagaaagtataatatatggataaatagttttgctataggttttgtcaaaaattaccggtgtcaggtgacaccggtcgtagatccgcccctgttcatctagcattccagctcatgagcaatatgagtagtagctagctagctagctagccttttaaatttcatgagaagtttagcagagtactagcaagcttcgtagattgttccttgtttaaatttgttcatattatcacgagacttccatgcacgtacgcacggagaatcccttagctatccagtgctcaactgctcatgtttgagtggattttgacttaattttagacagattactgctgacttaattacgtgttttgactcgccaccgatccacagattgagcaagctaagcccagctaattaactagtggctttttactactgctaatttctttacgagagcaggtacaataagtagactattggccagctgtaaacatattttagcgagataaaagatgagagagaaaagcagcagactacagatctatatagccagctacagcgcgggctccaagacacaatgtgtgtatgacaggtgggaccatatataatagtatagtaagcaactattgtatgaattaactattagattgtctataaatgaattggagctggtagtgggctatactattaaacttgctctgagagccatgctagcaagcttcccagagtgttcctagagtctttaatttttcttcagttaattcaggtgttgaccacgttacctaggagaagtaatttaattagtgccataacttactaaccaagcatatgcttatagataatgtctttttcaactcgtgacagttgttagttacctagagttttcctgcaacctagccaacaggttggtcaaacaacaaccacgttttgatcaactaaattctcctccacgtcacacccaaattctacatgataaaaagtgtatagtaaagcacatgtacacataacatgcattatcccgctaattataaagtataactttattctataggtgataaaaacgtgcacactaactgtacagcaattaattagtattgtgacaacagtattaattcagtacttgatcatcgatcgacttaattagaacaaatatcataattctgttgctgtactgacacgtacacggcctctgaatttaatcatctcaagcaagcaacctagccagccagctattaatcgtttccttccaagttacagtatctcaagaggttgtaggtaattaagctacgaaaccagttaacctataatgactagtattatcaagacactttgtatatcgatcataaaacatacacgtgctaaaaatgatttggtcagtcttagagtagataagatgtgcacacaagctagctaagtgatcactgattggtagtagcatcacacggcaagcaacagctatctctgatcgatctcttaactccaactactacctatcacagaattaactatagctatttaattatttagctatagctgagcaaccaagaattaattaacaaaaaaattaaatacatatgcgtatttttcttatacatgtattttacatattgtatatatatacataaattaaaccaattcaaccaatgaaagaattgatctgtaactcctatatccaattaaaccaaatctagctaacaggggattaattacaagatacaaatgatagatgaacaaacaatggctatatacacaaactaatcatcattcctaagactaatcaccaaattaagaaagtaattaacagaaaaaactatgggtttaatttaatggaattttatggctaaaattaaacaaatcttgtgggcttggctagctatgccgggatcatgagcctgggcttcttgaaggcgagagggctgagcacctcgtcgtcctccgccgcgcaccgctggtcggcggcggcggcgacgtccggcagcgccggcaggttgaggtcgaagccccggctcgccgccaccgccacggtcgtcttcgccgccggcttggacgcgccggcgccggcggcgctgccgatcgtgccgtcgtagtggcatcgcttgtggccgcccagcgcctgccccgtcgggaacgccttgccgcacacgttgcactcgtgcgccctcccgccgccgccgccggagacgcccgacgccgacgaggacggcgtcgcgatagccgccggtttcgtctccaccaccacctcgtcgtcgtcgaccatggcgggcggcggcggcttccggtggctggccttgtggccgccgagagcctggtaggacgcgaacgccttgccgcagacggagcaccggtgctccaccgccgccgccgccgccgacgccgacgccgccacgtcgtcgccgtcgcgtcgcccgcgcgccagcatgaggaggcagagcgcgaggtactcctcctcggagggcggcagctgcggtcgccgccgccgcgaccgcttccgcttcccccacccctccacctgtcctcctcctcctccgccgccgccgccgccgccgtgcgtgacgatcacctccgcctcctcctcactactacttctcgacgcctcaagaaccgcctccaccgccatggccactagtagcttaattagctaagcttggagatgatcacaactatcttaattaattgggtttcttgagcttgcaagggaaagagaagtgcacaagaaaaatggaaggagaagagagaaatggagaagaggagtggtgagtagaattgaagagtaggggaagagtgtggggtttatatgaggaggacaagtactcctactagaaacatatactcctacatggagagagatggagtggagtcttggggtcaaacaccgagaaaaatatatggatcaacatggatgaattagagatttataatcaagtctgtggatgattgattatgtgttgctaaataccctactaagctagcttgcttagtactacatgcatggttgggattcattagttattgattattctactagcaagattattctagaagagaagagagtgtagtactgtagtgtgtgcatggtgcaaaatactcccccgtctttaatatagtaatctagtaccggatggaacacttcatagtacaatgaatctggataggaagcatgtctaaattcgttgtactatgaaatgtctcgtcctgtattagattgctatattataggaccggatggagtatttattacttgttgtattaattaattaattaattgtgttggtgtagaggagctaattgagctagtccacaggatggaaaattaagcgtggaatgatccaatggaatggtctgggcagcagaggcggcgaccggtgccaactgccaaactgtattgtacttgtgctactgtactagtgtgatccatgtagtagtagtagcttccaaatggatatggctgtcaggctggagtgacgtgtacactacgtgcatgctgatccatcagaaattctattttcacaaggcaattttcctaccttagttttggttcttgttttccatgcttacgtcacacttcaaaactgctaaacgatacgttttcttaaaaaaaaattataggaaaagttgttttaaaaatcgtaatattttattttctatataaaattagctaatacttaattaatatcctaataaatcactttgttttacgtgcgagagattagtttcaactcatcggaccaaacacagccttaattttgcgtaccaccggtgtgcatgtgttaaataaaggtgattaactagttatgctatgagattgaataaaaattattatactaactaatctactttctccgtcataaaatattctatctagacgatggccaaaacatcttacgacgaaggtagatactacctccgtcccgatataagtgcagttgtaggtttctatatccaacgtttgatcgttcgtcttattttaaataatataatttttttaaaaaagtcacacataaagtactattcagttttatcatctaataacaataaaaatattaaccacacatactccctctgtcaaaaaaaaattaaatataggatttgatgtggcatattatagtacaatgaatttagacagatgtatgttcagattcattatactagaatgtgtcacatccagtattagttggttttttatggacggagggagtaaagtagtgcatatcactgcagtacacattgaccatagtgtccacgtggagggtaacgatcgataagccaggcgccacggcagcatgcaacgtcagcaaagtggccagctcacacctaacagctgacgtcagcaagaatgcccggccggcgccttctccggtctccacctgcggcctccgctagccgccacctggagtcaacctgtgccagccacctcagcatttcatggctgggtaatatacaggactccctctgtcccaaaaaaacgaatctagtgctagatgtaatatattccattataataaatctgaacaaaggtatatctaaatttgttgtattaggatgtgtcatatctagtactaaaataattttttataggacggagggagtagggcatagctacacgcctaagtaaaaatagaattataactactcccttctcttcaaattagtcatagttctagatttatcctaagtcaaattatgattatctttaaacaaaatatgaattatatattatagaagtattttttcctataaatcctacgaggtagttaagctatatgaatttatgaaaattgataatcaaagattacctaaaacgatagctaatttgaaacggagggagtaacatgtatgatatactagtttctctattttttctcctcctctctctctaaactatgtagtatatttagtgtacttatcttagagtactatgtgtagatctagctttgtatatttttcctctctctctaaactagctagtactctatccgtttctaaatatttgataccgttgactttttagcacatgtttgaccattcctcttattcgaaaacttttgtgaaatatctaaaactatatgtatacatataagtatatttaacaatgaatcaaatgataggaaaagaattaataattacttaaattttttgaataatacgaacggtcaaacaaaattaaaaaaagtcaatagtgtcaaatatttagaaacggatggagtatgtatttagtatatttagcttgggggatgtgtaaatctagctattgtacgaaaaccaacaattcttttacttggtctcttctccaaatatgcttgcagccctggaatatgtgcatcgtttaaatgctatatacacacaacaaactatataaaaagtatagaaaatgaaaaaattggtgtagcaactgatgagtacatgtccacacgtatacgcgtacatgtacttattattcttcgcggccaagcaactgagctcacttgagtatacgtacacatgacgaagctcgctagaattgtctacatctcagtacgtaaaagtcatgaaaaatatttctcgaatacgagtctaatggataagcaactctcttaattcaattgtcaatgaaaagttgcaaagtttaatcttaaaccccatcattggtgtggtcgttgtagatttgtaatcttaaacccgaaagaaaggtctaaattaatcatgatctcccataaatatgctttgtttgcgtttttaattagtgacacatgctttgtagctaataaataaacataatgcgcgagttgaacctagcttagcttacatccacttcaagttttgaacctaaaacgagttttcacattacgattaattgttttttaatggtaggcaacgatgtatcaacgagatgtacatctatcacagatatatgtctatgatgattttattaagtttaagatatgtcggtttagttttcggaagatattcataagttagcgttggatgagtgcgcttatacaagtaccgtgtttcgaagaaaaagatgcgcttaatcagcgtcagttcttgcctcggtgcaaaatgtaggtagcggataaccgtggcccatttctaaagaaaaaagagagaaaactgtggcccaggaacagattgtaaaggaacttaacaagcccaaaccgttagagaaaacccaatgggccggatcagataccaatcaggcctccactagatcacggcccatcagtccagcccaaatttccgggctttataaattgggataagttcattctaggcccctcaatttgtcacccagtctgattttcatccttagtccgaaaaaccggatgcaacgcatccctcagcttataaagccatgcaaacagtattgacccggttttggccgacttgattaggtcttcgtcccatgtggcattaacgtggtgcttacgttgttagagtgcgcagcccgacccaccaaccgtgggccacctaggtcacattgggcctgctccaccacaggcccaaccggagccacaactttaggtcctgggcctacacaaccaaaaagactagtctgatgggtgagaaccgcctccaccttttaagtcgtgctcccccatcaccaattaccgatgtgggactaaacccaacatatgtggcaattctatccggaaaaataataacccgtggggcccatatgtcagttacacacacaaaataataaaaaaatggtggggcccatttagccccacatgccatccctcttctctctatcctatctctctcacttgggcagagcatggtggagcggggcggccaaagcacacgacgggcaagccggagcggccgactggcggagcaaagcggcagcacccggagcaagccggcataggcgagggtcaaggcggcggaggatgacgacaacaacgcaagcgccgcagacaacgtcgacccagacagagtggagaaggtgaccctatcgccgtcactgccagagtcaagggcgtgccaggtaaggtcgtcgtccgttgtacacctcttgtgtcgtcgtcgccgcctagggaggagtccttggccatgtggtcctcctcgccacacttgtagcacgcacagcagcctccttgccgtcgtaccagcctccgcctccatagccgcagtcaccccaaccgtagctgtggtccccgccgttgctgggacggaatccgccgatgacgtcgaaccacatcaccatccctttcaccctctccgacgccatctcacgctctccacctgttggccatggagcgcgcgagctcagcggtgaagatgagcgttgcgtgtgggagaggagcagcgcgaggcgtggccacgggagagaaatgagaggagtggtgcacgatgtagcggcggaagagagaggagcatgcgcgcggcggtggcgggggagagagcgtcgtgcggcagcaagcgggagagaggagaggagcgtgggtggcgcggcggcgggggagagagcgccgtgagggttgccagcctccccacttctccctctctgccatccggtggagagaaggagataaggtagatgtggggtccactattttattttattttatttgactgacatgtgggtcccctatattttgtttaactttttagtttttcaattttgcttttttatttttttcccggatcacattgccacgtaagcgccatgtcaatgccacatgggacgaagaccaagtcaaaaggagacacgtaggcgccacttcatccaaaaccggtgacaataccgtcgagggattttgtttgcaccagttttgtaagttacaggatgagttgtatctggtttttggttaaaggatgaaaatcagactgggcgacaactttaagggacctacactgaacttattcctttttaatttcactagctgcttaaatcaggcccaaaatcaacatattagtcatcaaataaatccactccactagagtcaggctttaattggagtatttcccaaacaggagagaaaaaaggaagtaggaaaggcagattaggccttactattagtttccaaggtacgaaaatgacattttgcgatttgccaacatcaacagattcaacactagaaagaaaatttaaaaaggtgatgctgattggatccctgaaactaaagtttcgtccctgaccatcactaccctgtcacaaggtgattagtgacgactccccaattgtctcaatcgatgcttcttcactctccttttgcttagaccttatccctgagctatcacacattttcacacacacagacacctaccttgtccaaagacaagagtcgtcatcatcatccacatcataatcactttcttaatccttctctgatgagtcaccaatgatttgcacagtagctgtagtgctgtttggtgacgattaatactccctccatactaataaagaaagtcgtttaggataatgtttaagtcaaaccttgggaatataaatcatgaataactcttaagttattgagtttgaaaatgtaaaaattatatatatagatttgtcttgaaaaatacttttataaaagtatacatatatcacttttgaataaatatttttatagaaataagaaaatcaaagttgtgttttggagaccgtgtcgctgtcctaaatgactttctttatgagtatggagggagtaaatatatacaggtgcttaattaatttcatgtatttattttcttaatcttttttcctgtgaagtcgccatcagatggtccattacggtaaccgtgtgtatatatgggtataattgcatcaaaagagtcatgtcatgctttgagcgagcttgatgtgaatgtgatgtgttgctgtacatttgtgccattaattaataaattaaagccagtccaataatctggtcaagagtgtaataaactattggattagtactaattgctgttctccgatgcaataaacaacactaattacttgcccggaatccgatatgcacagtttcatatcactccccagtagtaccaggtcggtgccgactttgccatcctgcaaattgtatcagtattttatcattaaaatttagcactactaatttgttagtagtatatgcttttctgcatattaataattgttcagttgccacagaaaaagaacattttctgaggcagaaaatgcactatttcagaattgaatcatgcttagaaggaacatgccatggtctgtctgctgtgctagcagctgtaccttttgcctcttcatctgcttcattccatagcacataggccaaattttcacaactcatgtgatctgtccaccacaaggttaggtctccctaatcattaaccaaagtgtgacattaattattaaagaaggcagttcataatcaaagtgatttgtgagcaaatgtagtgccaggatcatgggatcctgacaaacacagttttttttttcatcagtctataacggtgtcattatttttttgtgtgtcaatcaagcaaaaaccttttctctgaacagtaaagtatgcagcaagtcgtcaacggagtatagtactagtagtagtgacagtagtactacctgaaagctcatgcttaagttgccagggaagaatagtaaacagcaatctccccatgtgatgatccttctacaacaaaaaaattctttttttctgcatgatgctatgatgatctttgaaaagattggagtagtagtgtcatgcactacacagggattacattacaagttgaggggg

SEQ ID NO: 18203 - DNA, 11296 bp, Oryza sativa
cctcacataaaaagagctgatttattttcacctttcaagcaacaaaatctctcacacataaagtagtttacctttagctacatcactgtgttgatactggtaccttttgtgatctaggagtaagtaatataatcatataggctttgactgttcgagctacggttgataagccgtagaaaatgaaaaaaacaataaaaaataatttataaataaaatttttaaatttgtgtcactagcagtttaaaatataatgttacaaaatattaaatttttttaaaatttaaactcttgtgtatgatatgttaataaacagactttttaaagcctaggcttaagtgatgttcaatccaggtaaacagaagggttataaatttggttatttttgtaaaaatgctttgacagttgacaccactaatccattccaaatttccaatacaatgaacactgatgactgaggaggaaccagccaggaaaggagatggtgcagaagaacccacaccaccatgctcacagatgcacagacacagggctcctccccagttttaatgctaggacactctccccatccttggaatctgttgcattcaatacagctctcaaaaaactaaaagaaaaaagaaaacaagatttaatgttgtcctagctagatccatccaaggctccaaaaacactgtttggctcctcccagtagctgaagtgaactgaactcctctcattttcaagagtgcattagtactcactcccccccctcacatgtgttgtgttttgcttgcttgtgtgattagtggagtaatcaagaagaaatagtggggaaagataagtgtgtgtgggtgtggcaataaaggtgaagtcttcaagtttgcaatcttctccctttgctccccacaagattacaaatcttgtgtttgtcttgttgccactgccgctggtgatagactctaccatactagagaaagccatagaaaggagataagaagaaaccaagaaaagggagaaacaaaagttgaagaagactttctgctgatatttttgcacatatatataattttttctcctccatctgcactctctggaaagaagaagaagaagaagcagaagaagcttggagcttgagctttctgaatttgtaagtttattttgctctaattttgggctaccaattgggtttatatttctctagtggtggtgactggtgagtaattttccccttattttattgtgttgatgtgaggccttggggttttctatctctttgcatcgttttcgctttcatttgtttagagatttgttctttgaacaaagcatgcagaaatctctgaggactgaagtgtttctctctgcttgtcactttctccccaattgtggaataactaagaggaatcgacatggggtctagtcttccattccacaagatttgcatcttccccatgaatcttccaagaaaatctgtatctcttacttcctttctttttctctaggtcttgtcttgcaaactaggataaagatacaagttagtagtacaagaaacagtaaaggtgaaagtcttgtgttcttttccctgcgatttcttctgaaaaaggtcgccattaagaaaaagctttgcaatctttggagtgttcttctcacccagtggtttctctgcttgttctcttctgattaataacagtagtagctgctcattaaattgcatctttttttaatttatttaatttctgttgatgtgaaacgcatccaatctcttgcaatcaatgtgaggctttcattggcgtatgagcataaaaaggggggaaagaaaggtgggagtctttaggtttctactcctaaaaattgtttctttcttatgtgcagcagtcggtgtaactaatgggggagatgaaccagccgccgccgccgccggtggccgtgccgccgccgatggtgatgcagccaatcatgcatccgcccgtcggcaccggcgccgtcttcccgccgcacgagcagttccaccatctcgcctactgcgtccactccaacccttcctggggtaaggaaaccccaaccccttcattcctcctcttttttatctttccttgtgtgtttttgtgttggttggtgaatggattggatatgatgaatattccctttcatccctaaaaatttgggagatttgatttttaggagtatctgctggttggggtttttttgactcaagatattttttgcctttggagtgggggagcttctgtgttgtgttgtttttgtatgattcttgaattggggggtgtccagagatatttgatgtgtgttttgatttgaagatttttttttagcataactcctgtttcactcccctgctaatatttgaagagattatggtgtctactggtgcacactattgatgttttccagagagttgtagctactattattttttatagactagtaaaaggaattggtggtggtgatgatttgctttacaccccactacttcatcagatctttagtgaatggatctatgtagacatagctattgtttgtactactacatgcttatgtatgtagatgttgaattctttgtagtacatacgtatatgcagttgctggttgacctagtgtgaatattttaattgtgaaggtaagtataactgtatttgtgtaaccatggaacttttgacatgttcatttgagatcccctgcaatatagaggcaaacacactagttctgtcaaaagaatcttagaagagtagtaggatgttcaggcaaaaacgctatgaagtgctatcttgatttttttaaattatcaaatgtacttctggaaattaaattactcatgtcgattgcagaaatgattaagacatataaagcttgtgctcactaaattactattgttgatattacgttcagttcaggtggccgcacttgcattcctccactatcttgtgatgctgggttctactgtcatgcttgcatcaactattgttcctgcaatgggtggtaccccagtaagtacattgtttattttgttataaagagtttattacgtaccattatagttctcttctaaagaattggtactgaccttttcccgcttgttgctaatagggggataaggctcgtgttattcaatccttcctatttatgagtggcatcaatactctcctccaaacacttgttggaacgcggctccctacagttatgaatgcttcctttgcatttgtcgtcccagtactgtcaatagccaaagactttgaacaaaataactatgcgagcagtcaccaggtagagtaccgttcatatttgttcaatcatagaaaattgtctggatcatgatcaatttatttgcattgattgatcaaattattattgattacttataacctattagggattttgcagagatttactcacacaatgagagcaactcaaggggctctgattgttgcttctatcctcaacatgattcttgggttcagcacaatttggggggcattcgccaggtacatatcttataatatttgttcttagactacaatagtcattttgtgctagattttttcaaggtattgacatttgaattgatttctttccaggaaatttagtcctgtaataatgacccctgttgtttgcgttgttggtcttgggctatttgcacttggctttccccaggtacgatctctatattatttttacaggaaaatctagcagttcgcaaataaaggaagcatgttctctttggtttcccatggtaggttggaaagtgtgtggagatcgggctaccaatgctaatccttgcagttgttgtgcaacaggtaatgaattaatctccttatagggcggtttcttttaataacactctaaccggtgatatactacgaaacttactatttactatgctgtgtatgcagtatgtgccatattacttccatcattaccatgagcgaatcaccttcttgtttgagaggtattcgttgcttctttgtattgggattgtgtgggcctttgcagctatccttactgctgctggtgcatacaaccatgtttcactcaagacccagcagcactgccgcactgacaagtcctatctcatatcatcggcaccatggtatcgttctcaagtatattgattatgaactgattttaaaaggctgtaggttcttcagatagccatttctaatcgaccctttacatacatgctctactaggatcaaaatcccataccccttccaatggggtacaccaatcttcactgcaggtcattcatttggaatgatgggtgctgtacttgtttctgcttttgaggtaagaccaaggcccaaaaatgtaatcagatctcttttgttatgttttatcttttgttgtttctaatgtgtgttatctcatgtagtccactggtgcacactttgcaactgcacgtctagctggtgcgacaccacctccagctagtgtccttagtaggagtgttggtttgcaggtgagttttgttcaatataagattttatattcttacaccacatctcagtctacattaccgacaccaataaaatgtcttgtctgtatctaacttgcatttgaaaacaagtccccagctcattaatctctaacaagtaatagcgagacatcaaatatggttgtttgtacatactatgcatgactttcctttgctactaaaaatattgatttaatcggatggatctgtgggagagctgttagttcaagtccttgatttactaatgctattacctattatttattttgccatccttgcttttacttgtgaaattttcttgtgccatccttgacgactttacaattttactcgtgtgaaatgcagggcattggaatgttcctagaaggtatctttggcgctccagctggttcatctgtatcagtgtaaggggatctcaacttttatgccctttctatgagtttgttattcgagaagactagaacagttccatgcaaatagatgttaaatatatatgcttcaaacaataaatgctcaaaataagatgtagtgttggtgttaacagagtatctagtcctacattctagctatagttgtacatcgttctggttaggtaaagctttttgtggtattcagtttattactctggggtaggagctgattaggaaccatagtacacatgatgaaatgtaaagttcacatatttttatgggtaggccatggtatgaaattattctgttattatgtacagaacatgtaattattctgtacaactaaccataggcaacttgacggtccctgcttacacacttaaaaaagatacggagtacttgctttgcaaacccttttgtggttaggaatagtggaatactatactggtgggctttgatcacattgcatgagagtaagatttagtttctttatatttgtgttcatttgtgaactgaaaggacccttgcctttaatataatgcagtgaaaacattgggcttcttggactaacaaaagttggaagcaggagagtgatccagatatcaactggatttatgattttcttctccatatttggtaatcttttggtctcatcttcagttgccaaaggggaaagatagttttgtctgaaatttgtatacttctattcatgcagggaagtttggtgctttctttgcatctattccattgccaatcttcgcagcaattttctgtatcttatttggtattgttggtgagtccgaattttctttcttaagagtccttgcatcgatgaatatatatggccgcaacatgattgtgttcattttatgttctaatctgttttttttggcatatcagctgcggtgggagtctcgtacatgcaatttgtaaacaaaaattcgatgaggaacatatacatcattggactttcgctgttcctaggcatctcggttcctcaatacttccatgagtatgtgcttctgctagcactggacctgcccgaacaaatgctggatgggtatattccttgcccccctcgcatgctatttacacagcattatgttctgaccatctgtgatctgactgtggtgatacattctggaattatatttttggtctttgctcctgcactctttaaaaaagtttatacctcggtgtatattattttaattagacacctttgggctttaattgtcttaggtctgtgtcttgaactcttggtacatgagttctggtttctaaacaaatcttttttgtttcgtattgcagttcaatgacatcataaacacagtcttcgcctctggcccgacagtgtcactgattgtcgcatcgatcctggacaacacactggagtttagaggctacgaaaacgaccgggggcttccatggttcatgccgttcctgcaccgtcggaaaggttactcagatcctagaaacgacgagttctacagcttcccgatcagggtgcatgacgtcatcccaagccgattcctctgacgggcgagggtagcgcccgttacctgcgcttccgcgcatgtaaatctctttgttcttgttagcccttccttactcctgtgacatgtagcaattggcaccgccaagattaaaaagtctcaacttagtggggatatggtacaaatggttaggacttttggttttcttttctttttcctcccctttgggccaaccatttggttaattacatgatggtgtagagttggttaaatgattttgggatggatctttaaagaatatcagccacctcaatttgttgattgctcagccagtgatgtagatgtgcttccaggacatgcattgatttcgtcataactctgtaatcacaccatcttttcactgcatttgattgagaaaacttcagaatcagacctgatgcacattgaactcaaagagtctggtctttggatgaccgcatataatcaatcaggcagtaaattccagcatgatgccactgccatctccttcaccctataaaaagagcaggtgaagtatcagcagcttgtttttgttttccttgcctgaagttcagagagatgatcaataagagttcattcagctcagttgtagccttgtaggccttggaggcgtcaggaactgagagataactcggagttaagctgttgcctgatgacgcttcttattacgtgctgatatgatgctagaaaccagtttctaatctgtaatctctgatgacactgtcgcacattggcctgaatcctgatcgataccttgtatctgctaaactggagttgaatgcgataaattggtgcctaatctctaatcagttttctgtttgcttcgtacggcccatctaatagtgtactaaatcagctgtactgaaactctgaaagcaaacactcaattttcagatatgataatgtccttgaggaaagtagaaagacactcaatttttcaatttatagtattagatcaaattagagtgaacaaaatgaacacaaaaataaaatatttagagcagagttaaactactgtacttataagtacaaatttctaatggattgcctcattgtaacagattttctttcctctgctcctgctttgctccaatcttgcatttcgtttatagaacttatttattacctgctcaccccgtagcttctactctaaaagattcgattggttcgtcacaacgatgaaatggtggtgtagactgtagagttggtgaattaggctctgtttgttgctgcctgtttgcaactctcccatctcgatttccgtgcgcacgcttttcaaactactatttcggtatgtttttttttcaaaaaagtttccattttgaaaaaaaaattagctaatacttaattaatcacgcgctaatagatcgcttcgttttccgtgctggaggccacagttccgaacatgcagtctcgaacacagccttgttattatttggataatttctctattaatgatatggattttttataacaaaaatgatttaaatctccagcttctacttcaacaaataaaaaagaaacttcgggtgatgggacaaacctctaactctctcttattattaattagcattaaatcacatagattaatgcatcaattctaatggaccacgcaacccataatgaaataagaaaccatttgctatcgattcgaagggtacaatactattgtgcatagtattctgcttcttctgtggtagcatcacaaattaaaagtggagccaatataaagacatgaaaataaattgcagcatgttagacaattgtttaccattaaaatctgtcattgcggtaatgggtctgttcggttcagttggactgtggctgtatagccacagcgctgcaagcctcccggcataaattgtttgctgagtcctgtagatacagcggtgctgctatcacaaccagctattccgaatgcacccaatgctaaattaaccaacataaagaacaagcttcaattactatgttctttttcatggacctaagtacttctctagccaattatcaaaaatatttttggtataggtggagggatattaaaagcaaaaaacacatatatccaaacaactcgagtaatatgactctaaaagaaaagacgctagattgtctcttttgcataatagaaattaacaacaatatttatctcccctaaagctaggttatcctttgttaggactactttgttatgaagaaacgaagtttctaatagaacctttaaatcccatagtatcctctcgcagattccaatattggagttcatatagtctcaatatatatagatctaaccgaaaattagccattccagtacatccattgatccatcgtaactctatgactgcagtactgcacccttcttttacccttcatttgatgagaaatcatcagatcaaagcaattgcacattgaagcaagctgcaagtgaaatgaagtagcagcaacttgtttttgtagcttgatattttgagagatgaacaagaggataagctcatggagttggtaggcctgagaggcgtcaggaactctcatattagctgataggaatcaagttgttccccgtccactgtgcttcagactctctggcttctccacacatgtttggcatacatattgcaactcttggtttggtgctagcaacctgtttcctttttgaggaaaagctagccaaccagtttctgcatcttgcaggctcagggtttcagagttcagaccagcgaaatggcgagtggatatgaatatgatccctcaatgtcgagaatgcgaaatgcagcttctttcttcacagttgtcgactcatgaagctcgcaaaatcatggtgaactccccaaagatcagttcgtaatggctttgtgttatcatcttgtacaatctttgtctggatcagtatggttctgaatcaagacaggaaacacaagtagccctccagtcccttctccgatcttgtctactatttgttaaatgatgtgagaaagctatatatcatgttaattgttagtttgacgtcatcttcccaaccgtctccggcgagtttcatgaatgtgttgtgatcactcatcatgcatgagttcggtctcaatcttcagtcacccaaaacacaatactgaaatacgtacaagataatcaagattgagtaatttggtctcggtcaagaccgaaatacaataattttagagttggaaagaaatcacataaattattaaaaaaaatataataaaaaaatccacaataataataaaaaaaaatcatgtgtcactggtagtgggtgccctccagtcgacctcctccgcctgtcgccgcgccctcctctaggacaccaccaccactagatcttctgaggaggacgggttgctgacccctaggcaccagtgattcagagtggcgggacaatgacatggcggaatggtgtgatgaccaaaatgactgaataaaatacggttagttgaaccctaagaccgaagtgatctgatgatcgaatttgtcggtcttcattttccgatctcagtcacggtcttttcgattcagtctatttttgctatccctagctgtactgaacaaaacactcgattctcatatatatatgatcatgtcctgtttgctctacatttataaaagataagaccaatgagcacaggttgagaagatgaagaagactcgatggatgatcgacctcttgttcttgccatgatagctaggcttgggaggaaccgggagctgtctttttacacataaccatcttcctaccatattctccgcggttcatttgtcaagttagtagatctcattaaccactcttattctcaacggatcatattacattttatatgtaactggtcaccatgcatctactttccttggtaaggctatagattagatcaaagcaaaaaaagaacaaataaacaaaaaacgcttcgagcaaattcaaagtgctctattgcttaccaactggtttagtctatgtcactttaaatgatctcccataaattcttcttgctccgggttcggtctaaagattcgattgcttttttacacgatgttctagagttgtatgattgggtgaaatgattttgggatggacgttaaagaatatcagctactatatttctgattactctgtcagtaatgtgtgaatttacttccagttccagcacaagcattcattcatcccatcaaacatcataatcaaacccagctgcacattgaactcggatacaggtcctgaatgactgaatttttatttagacagtaaattaaattcctgtgtaaaataccatatgatctcctatgctccataaaagagcagacgaaatgaagaagcatcaacttgtttttctttcctgacattcatagagatgaagaagaggagctcatgtagttaggcctgggaggcgtcaggatatatcagataagctaattgtaagatgctgaaaccattcttcctctcaagcatcaaacaagtttcagactccaatggacttgtttggcatgcaaccccttgatcatttgatgctagctagcagccagttttcgcatcttgcagagttcttcagtgttgcaggagatgatttctcagtccggattatctcagtgttgagggtttgtgataacaaagaaacaattcagcatttgttcttcgagtgccccatgacaagattcacttggaatgtgatggcttgtgtctttaacataaaacctgtcaatgacttacatttcactttaggatcctggattaattcaagcatgtgacaaaacaacaaaacagctgctgctagttggaatagctgcagtgatttgggctgtgtggaaagttaggaataaatcctgttttgatcaaattctcccacatgatcctactgatattttatattatgctgcttgctccctaatga

SEQ ID NO: 18204 - DNA, 7251 bp, Oryza sativa
aattcctgcagcccagaactgaggaagaatgaagatgtgaatggaatgttatgcagacacatgtgaatggcatcttaaaagttgctgctgagtttttagcactaagttgtatggtcgaagaccttagactgttgggctgttgtcggtcggcaaacagttgttttctgttttcttttctcctctgttggttgtgagcacctgggggagttctcctccctgcaggtagtaagactttttttttttgtagtagtagtgccacatttctttaatagaaatggagggtagatgcaactcttgatttgatgctatagcaaccagtttctgcattttgcatggcttcttcagggtagccactagccagagattgcagttgtgagtagatatgatgatccgctggacgcgggatggcggtgatcgaacttcaagtgccaattccattgacgtgaaaatgtgatgcaatagctttcatcatatttgataaacttgttcagacccccaaggtcctaataaataacaaaattaacgaagttaagctacatttgagattaattacatctagatcatcttctcgttataggcttacagcatacaaagagatgagatagtgcatgtgcataaacagcacaaacatatgctgctgagaaaaagaggatgatctaatattaaccatatggtagttaggcatgggaggcattgggagatctctcctgtcaatgggtcacttgctgctgtgtttcttttgcagagcgtattcagaattttcaccacatacaatgaaccaaatgtttcagatgcaccagggagtactcagattacattctgcatgtaactagtctcaatgtatgtgatctatctttctctcattgtcacctcgtgcaagttcttaacctaaccattttgtacttctggattttcatctagttttctcctagaaacattgatacaaatttgttgatgcatcagtctggcctgctatgtccatcgactagaagcccatcgaggaacaaaacacgcgaatgtctaaacatcatgaatattggactgtagttggaatatgcacttagctgaacttctgaaaagacataattattcaatccatctgttcgtttattttttcgaaatgtccttacaagttcagagtagactgtaggagcatgcttctgttcatccaaataattgtcaatttcacgtaaaaagaaaattactaatttcatgcattgtttgcctttctccatgacagccaaaccaaacatctttaattttttttgagaagatccaaatgtcttggtttagagcttttatttcttaattgagaaactttatagtctttaagagttaccgagagggaaagatttttggtgcaaaaattttgtactcataaatcctagtacgtgagatacaaaaaggtattaaattttaaagtaaaaagtgtggtacctcccggtagccttcttaagaaccataaaattaattttcttagtttggtgaagtggcattggtgaacattcattatactattgaaagcaggagatgaaggagaacaattcaatgattcattggtctgtcataatctcatcgatcactaccactttatatatatggagatattgatctatcacaatgttagatagtccactctcaagaaagaattagcattaattacacgtctctagtttttccagagctaagttctgcatttaaatgatggcattagatcatatgatatatagatcaatggacacaaatgctagagagagagagagagagagagagagagagagagagagagagagagagagagagagaggaacattgttcatggaactagaaactaaattttcatgttcgttggcctaggaggtatcaggagttcacatgtcaccttgatacactgccgaacaactgaatgtagcaaacccatataggtggtggctgagatttttactcctcttctgaatccttgccctactattttctccatctcatttaaaaatagtacaaggaagggaataattatccaaagaatcaaggatatgagagggtaaagttgcaaattacactatttgaaggtggcttgttggtggtgaggatgggcagcttggggcggcagctggccggctacgttagtcattgggggtaatgtcgtcgctggcaatgtgtggtgcacatctctctttgttgtttgctaatccactacacggtaaatattgtacagccagacagaattcgactatctctagatgagaaatatgttgtaaatatactttataaaatacttagtcacacccaagaagaatttcctggagatgccactgatttaattcggtggtgtacatgtgatacagttcttttggatgcaggtcgtctgcagtactgcactgcaggggatctcagttgagttctttttgctcgtggtgtgttcgaaattcagctgataatcgtgcttatctgtatggatcggtgtgccatcttacacaatcttgtccatattagagaaaaaaaacagacacagagacttcccatcaatccatcatcctttgatctcttgttaaatgcagagggcaaacattgttataatctgatctcgtcttctgaaatttcggacccccctgcactaatcgatttcgcccgaaaacttcagttttttttttaacttttttagatttggttggcgacgatttgaatcaccagggagcaatagtgaaaatttaatttagaactttttaaagttgattttgcccttttttttcagcttgggttttgaactgctaagaatagtcttagcagtataaaagtcttactagaaaattatttattttcattttttggctttatttttcttggtttataagccagtagctcaaatgctcaatcaatgagacagcttggatcgatgatagcgttccaattctcaggtgagttaaaggatatttcgacttttttaaaagacatatttcgacttcaaagaggggtttcctacgcaaaacaccacttcctgacattattggtgtttatctgataaattagtagtcacaaaataaatttggcaccaattagaactgtcacctcgttaatttggtctcagtttttttttctgtttgcatcagtactgcctagctaatacagagtaataatactagtggtttattatgcattgagctcagctgtactgaacaaaacaatcaattttcagatacggccatgtcctgactcctgtttgctctacatataaaggagtacatgtagatggagattgttcattccaatggctagttggttatcgatatgggagctagctagtaggcttgggagacaccaggagctgctctattacagcgaatttgctgaattctgcatttgatggtaggagctcttgatcatttgatgctagcaaacctgctgctgcatcttgctggcttcttcaggccgcacagctggaagaagacgacgtcaactggacagatgaatccggtgcactgataccatgttaactctagtgaataatagaaatagggaatagatttgttgtgtatatattgagttagcgccaatgacatatattgagtacaatagagatgagaaatacctctaatacccccgacacatctctactccctccatcctatattgatcatctcgtaagatttttgaggtcttcccaaattcatgatcatctaactgtgcctattcgtttatttgtgcaaaattaaatagcattgtagcatgtctggttgtttatatgagcaggagtcaatgtcatcgctgcatgtcaattcatttatctgtacaggagtaaatagcatcgttacatgctcaccttaatcgataagatttaatttaaggaaggatgttttcttgccttggtcttgatgcccatttataaatgagatttgctccagtccagcaaaaagtacctcgagataccggtatctcacggtatcaaatcgtttccgatcgttggatcaagctggacattgttagatctaacgatcgaaaatgatttggtaccgtgaggtattgataccttgagatactttttgttagactggagtaaatctctttataaagacgatgatcaaattgggatggtgggaatatttttttaactggtagtatgacgttgttaatcttgatatcatcttctcgtcgccctccagcgagttacatcggtgctttgtgatcagtagcacgagtgctgttgaagcttgcagcttggctgctgtgctcgtgcagccttcgatcgatcaaaccagtgctatgtatagatgtgatgtgtggtaatgagattatctgataaattgatgccaaatttcttggcagaaaataaaccttggatttaaccatggtaattcggcatgggaggcaccgggagatgtcctgtgaataggtcgcttacctgcagtgctttttggctgagcgttcagtatacccaatgaaccaaatgagagagatgccccaggaatcaatttatatctttctctcacagcattttacatccagattttctttcattgtccctataaaatttgatacaattattaggttgatgcatcattcaggcctgctaggcccatcattaactggaagctcatctgaggaacaacacgcgcgcgaacgtctaaatgccatgaattggactgtagttggaatatgcacttagctgaacttcagaaaagacataattcaatccatctgttcgtttatatttttccaaaatgtccttacaaggtcagagtaaactttaggagcatatgcttctgttcatccaaataattatcaatttcacgaacaaaaaacaattaccaatttcatgcattgttcacctttctccatgacagccaaaccaaacatctttaatttttttgagaacatccaaacgtctttattcagtgcttcatttcttaattgagaaattttatagtccttaagaggtactgagagggaccaagatttttaattagaaaaattggtacatcctaatgcgtgagatactaataggtatcaaattttatatgaaaaagtgttgtacctcctagtaccctccttaagaaccataaaattatttttcttagtttggtgaagtagcattggtgaaaattcattatactattgaaagcaggagatgaagagtacaattcaatgattcattattggtctgccataatctcattgatcactaccaatatatatgtattgggatattgatctatcacaatgttagataatccagtctcagttacgtggacatacatttatgtgctacattgaagtactaaaaaatgagggtgttgagcagctacatcagaccaaatattacttagtattgacacaaaattggtaaattttacagaggtctctactgctagtagaagtgatccatgcccatcatcatcttaaatccaaggggctagacttacttatactgccaaccatggtttgcaagttcgtttcaaaatttccgagacccactggcacgaaaatatttggcccaaaatttcaatttgtttcaatcttttttttttgttgtactctttgttcttgttagtccttcttacttctgtaacatgtactccaagattaaagtctcaacttagtggggatatagtacaaatggtcaggacttttggttttattttccttatttttcccttccctttggatttgttcagaaaactatcagaatcaaagcaggggcatagctgcacattgatctcggctgcatgtcttgagtgattgcatggaatcagacaattaattcctgtatgatagcattctatctcctctgctccataaaacagcagacgaaatgaagtagcagcagcttgtttttcttgattgattatttggtttttatcagagatcgatgatcaagaagagttcatggggttcaggcagcccaggtaggcctggaagacatcaggagccgtcaaatgcgccgatggtaagcaatcttctgctgcttgtctgaccattttgcttctcactcaagtagtcaagtttctgattttagtagttcactgcaattctttcatttgatattagcaacaacccaactgaccagtttctgcatctcgtaggcttattccaagtcgcaagaccaagaggtcatgatcacctcaacatcaaggacacagcacgagtcttctcctccgtccggtttcccgagtaaccgttgagatgcttccaatgatgtacatgtgatgcagtttatttagctggtgatttataacttgctgaactcctcaaattgttcgtgctagcttcctgctttcacctttcacgttgttgttttgtgaaaaagagacatcctctgcttgcgaatgattaatctggtccgcttgatcgtgattggaatggattagagatgttgtagagttgtatgatcgggtaatgattttctgatggattgctaaagaataaataataccaaccatctcatttgttgattgctgtgtcaatgatcaaaatcatcaccttgttaatttggtctcagctttctgtttgtttcagtactgcctagctaatatagtgtacctatttctagtttatatattgagcattgtagtcagctgtacttgttataaaagttagtcgatatagcggaacgacaactaaccttctcgatcgtttcaatcattgaccacccaagacatgccagatgatgacacatgaacacacgatattttttaacgaggttcagccgaagcctacatccccggggctctgattatgggcgctcctccccaaccaacatagcacctagccgctatgagtccatggccacgccgccatcatctccctgcgtgtactacgttgtagtcgcatggttacattgtggtgccccttctctatttaagagaaatgccgggttacagagtccgactctaactctaccccctaacacctattacaactccaagtctaactgtaatcaaataggactagtatattcgacacttattctaatagtactgaaccccccccccctcaattttcatatatgatcatgtcctatttgctcacatataaaagacaagacaaggagcacgggttgaggaagatatgagagaaaagtagtatggagatcgatcactccgagtggcttgtttttttgcggcggtaggcttaggaggaatcaagagctgtcctgttacgatggtgatctgtgaaagaagccacacatttctttggtttaggatcacctgtaggtccatgaaataagccatgcaacttctaaacttcatgagttat

SEQ ID NO: 18205 - DNA, 4216 bp, Oryza sativa
ttaactcatggtaacggatttcctattcccctctgctcatgctttgctccaatattgcatttcattatagaatttgtttatcacctgctcccctcgtagcttctacacctttaaagatttgattgtttcatcacatgatgacatgacgatgtagagttgtatcactgagtgaattatttaatttgttgattgctcagtcagttatgtggatgagatccatttcaatacattgattgattcatcacaatgctgtgtaactacaccctttcccccctgcttttgatgagcaaacatcagaatcaaaccaactgcgcattgaagaaagctgcaggtcctggaacgactaattcctgtatgatgctatgttatctccattgctcaattaaagcgcaaatgaaatgaagtagcagcaacatgaatgtttttgtagcttgatatttagagactatgaacaaggggagctcatggagttgagcctgtccagtggtaggcctgggaggcattggtggtttttttattcactttaggtccttcaatttaacgtcgagtatgaaattcatctttgaaccgaaataccagacacagttcattccccaactcccaatatcgtgtcaactttggtctcaatgcagtacgacttccggtttcgtccaacgtggcacatcaatcaagcatatgatttgaaggatatatgattaagaagatgatcagctcatgtatttgttttgtgttctccacaacttaaagtaggcaggcagcagggccgtcttcaggattttggggcccggaacaaaatgtaaattggggccctaaattttctaaagctaattaatatgtcactttcagtcaactatacaactttaatttgtgttatttcatacaatatttacaaatacattttcaaatattaattctaaaagagtaaaggtagtattgaataaaaccaagagccatactgtcttaagatcaaagttgatactcaatgtcaattttgaggaacctaaagtgaacttattcctttttattatatatatgggctgctccttcaccgcgtgggccagttaaatcggcccatcactttaagtgggcccacaaaactgacggcaaagtatgggccaaaacatatcgcccggtgaaatatgggcttcttgttgggcggactcaatcatcacttattatgtaaaaaaaaaaaacaagtacagaaaaaatgctttgttttgctcttctgttctgccctcatgttttcatcttgctctgctctttgctcaattgctcttgagtagaaaaaaacaagatggatgaaagtgagatcaccatgtcacacacagatgcaggattccttgcgcaataatggtcgatgtgcgggttatattgaatttagcaccagcaattagtggcatgtggactgaaaaacaaagggaaccctctcccatttttttgtgcgagtacaaaaggaaggaaaattgtgacaaacagggccagataggacttaagatagcgttgtgatgatctcaacagtaaaacacggcaatggtagagtattatacaacaaccctgaatactgatatatggcatcccgactgttgcaaccgtcgtggagcactctcctattcctgacacttataatccatggattttggaagatgggtctttaccaagcagattttgttgagcactgggtttatgacttaatcaggccctgatcgttgtgttcctcgggtgaattgtccatgattcttcttttgagaggacattgtctgcttctctgataaaccaatgtgctcaaatatttcagtcatcgccgcgctatgcagatactgcatgttagcacatagtagccattagttcgataatcttcatagcatgttcgatctctaaatttagtttaagcacgcagagcaaaattttgactggaactgaagccaaatggtgataattaaggcaattttgtaacttactctccccaaagcatgtagcatggtaagtcctgatgcctcctgtgccgaacaatatgcaagaaatgcgatctctctcatcttgagagtttttcttctcgttcgtgtgttcgtgtgtcctcgtaataggacagcatacaactcacgcctcctggtgccgaacaaaagtttatgcatgtctcagatggtgatgcgataattgaacactgtaattccacttcaatatctacagcacctactactgtacagagaactgatggtgctcagctcagttgaagaattggaaggtgatgtcccttactcgtatagtagtagttctctgcttgggagtagttctcctactgctctcatgtcgttctacgaaaatgtcttctgggattctattgacgctttttcatggccaatatgagatcacctaacgatttatggtgtaatcaacagagccgccaaaatcgatagatcaaaaccggctagcggaaccgatttcaagattaatttactttcgtggaatcaaacgactaatttacgagcagattagtaaagaagataaatatcgtacttacatgacgacgaacgactagtttctgagtaaactagcaaatgataaccttctcgcttttgtagagaagcacaaccgttttttagcgcaaaacgataaagattaactaaattctagggtcgctataactcagccataaaaataaaatagaaaagaacgttagattgatatatatatatatatatatatatatatatctccatgtgaacagctaataacaaccaataaactcccatcaggccatgcactatgtgacccccatcactgcttctccatcttggctacatgcccatcaatcacctgcacctaatctctatagaccatagtgtatatacctgcttcgtctagatatttaattggttcccaaatctataactcaacaaatacgatagctattctaaataatttggcatggccaaataaactaactacaagccaaattatgattcaaacagattcaccaataatgttaagtatatatgtgtgagttagtatgctaagggcagtttagtatttaatttcctcctcctattgtacacaatttatatgtgctctttgagcttatccaaggtaacaattcaatcccccattttttttcttctctgaaattaacaaccaaaactgtccgtcagatacaaaatggatgatggatgagtggacacggcaaaatgattagcaaataagacatctatatgagttcatggacatagatcatgccagtgacttgtattgcgaggatatctctacgcttgggaggcaccaggacgcgtgagttgtatgctgtcctatacgaggcatccagtgcatgcatcgtctcatagaaggtcggacctattgtacccatatcgacaaaagggaacggttgtcggcggcattgacagagggtcgttgtaactttgaaacgttgtaatatgctggatcagaaatgagtatccgtaatcagtgtcataggcatgtagacttttgctaaacctcattaacaaatattgtgtctcggtgtcgtcatcttgattggttctcctatgatgttacttttgcgtttggtttctaatggtgattttggactgattttataacagttaaatcaatagtgctgtaatatactacttaaatatgtagttttgtgatagtatgatcaaaatatttatagttttacaaaatttactcaaatatttaatcatgcttttccctattttcttgatggtttagcctggcccatcgcgagaaagatccattttcttagctaggtagttgtgatatcacagggatttggctatggatgttgcagcataaaggtaggtgcgacagtagcaccagctacgggaggtgttcataagtatacgccaaagttaatgtaaatatataaaataattttttgtgatattgtaaggtagacacgcaagagtgcacaagtcaatataggcagaagtacctataagctagtgtgtccctttaacacaagcacaaattaaagcacacaaagagagacattagctgttaatccctaacctcactagctaatttctaaaaaaaaaaacacccggcccgtattgtgagcactaaagatttaaatttattgatatatatatatatattgaaaattatatgctactaccgggagtagctactccctctctatgtgccctcaattcgatcgctactaatgccaatgactgttaccgggtctaatgaatcgaatact

SEQ ID NO: 18206 - DNA, 982 bp, Oryza sativa
tagtctttcattttagtatctacgaggacatcctgcatgcgcttaccggagcgtgtcgtattgctgttgtaggttatcgaattccctcttcttttcttcaatgtacctctccaggattcttatcctttcgttaagggcatcgatttgctgccggaacgattggttttcgtccatgtttcgccacactgtagctggtccgggctggggctgtcgacgtccatcctgcatatatatgccaaattaattaataataatacacacatatataaaagttttacatgctaaatatacttgttactgcacaaaagtgaaagtgttactacatgatagacacacgttaccatatatttatgcagtaacactatataaaaaatacagtaacactacccaagaattacagtaagatgcattgttactataaaatttataatctgtattgcacttttacagtaacgtcgtgatgcgattgtaataacgtaaaacagaaaatagtaacaagaatgctatagtattactacctgtggagagtcaaattccaaaaaatcaatgtttaaagaacaatatctctcacgtgatgtatatttttttaaaaccgtttgcaccatgatgctaaaaaaagtacttatcaagagtagatccgtcatgactatatttcaactatattcgaacttcgttactacacgtaagacatagtgatcgtcgtgttactgcaccgttctgcgagacgagagctgagaagaggtggttggtgggaggagttagtaggcggcttgaccgggatttgatcaatgtgagaatgctttgaccgacttttaactgaggtgggaggtgggttttgaacccttgaaagagaggggaggtgggttgagccgcccttaggagagagggggggtatataatagctatacgccggatgtagaatagttttcacacacacacacacacacacatatatatatatatatatagggctgcaggaatt

SEQ ID NO: 18207 - DNA, 16432 bp, Oryza sativa
  unsure (1)..(16432): unsure at all n locations
aggcttgctttcatttttgttcgatgtcatctgtacaattgaatttggtgtggtttggtgtgaaatctgaatgaggcaactatggtgcgatctgtttgtcaaattcagaaataaattagcccgaatggaattgaagtgaacacccttctgatgcatgtcttggagatgcatatgcttaaacaaaatgtctccttaaacctagtacaaccatccacccaagtcactgaaagttttagtctgtgatcaaatgtaatactaatatctactccctccgttttacaatgtaagtcattttagcatttcccacattcgtatagatgttaatgaatctagacatatatatgtctaaattcattaacatcaatatgtatgtgggaaatgctagaatgacttacattatgaaacggaggaagtaaatccaagcaatttattacttcagtatgtgaagtcattcttgtgttcacttgggaactagtagcaggcaaggcaaggccaggcgtgcaacagaatgagagtagttattattattattattattattattattattattattattattattattattattattattattattattattattattattattattattattgaaaagaggagagtttatattgttgttgcactacatcaagcacattgattttcaaacaaaaatcttatacacaacacatttagcactagattggaccgaggtctcgtatcatcccattgtgccaaactgaaagagagctcgaactacatacatggatggagcagcgcaaaacctatagcctagcagagcacctgtggaaagccatgcccatgaggccacctgtggtggcaatgctatccaagtcgcacacagccgccatttccgagcttggaactcgacagcttcttcgagggctccattccgctaccgtcgactcgatcgctggatccaactcaacatggagatttgcagccactgcaggatgcagctggtagtgaccatcacacttcaactatgatcatatcaagtggtttaaaccattgtttggctcaaagcaggagaatattctggggtgccacatcttctctttgaagtgttcatacatttcccgatgcctcctacgccaagctgctggctgtagtgatggcatctggttcgctgaagcattaatttgtttaacttgatctctctactggtagcattttgtaacaagataactccttactcctagccgtggctgtagtaaagtttcgagatagagtgacttgagaagatactaacagatactacacattttatagcgtaaaattttgtacctctcggtactacaataaggtttccactaaaaattttgatatctctcagaaactgtaaaatttgtcttagagataagcaacgagagcataggctttgctagctacctaaacttgcattagcacgaccatcatgtcaattagaattcatcagcaaacactaatttcctaggaagtgatctccatcgactcttctttcgtttctcagcttatgttcatttatctcatttgtatggagcaaaaaagtgttccaccaatttaatgaatacactgtggcactgcttggtggtagcaacaggaggggttactattttggaacacaaacaccataaaacttctctgattctaaaatgtacgagaaatttctgaaccaaataataacccctagttgatgggcaatttatgaacaaattaataaggcaaaaagagaagcatgctactaaatcactggattgcaaaggattttattacaagtacacttgtaagcatagtaccagataataattgatatactctcaagcttaggtcacaaccaaaacgcatacatcttcaagctgcttagaccatgcaaaaaaaggttacaacctccacatggagatcatttcttcttcggcatggagttcagggtagcaaccaaacatgcccctggcccgccgtagacattgtttgtcattgtcccaggtagaaaatgtcctaatgcttcccatacttacctaacataccatatgaactagtactcaacatggccagccccctctatataccttgctaccaaatgaagtatgcgttgtcttcctttcatggaaaataaaaacgggaaagaagaaacaacaaatggagcaatataatctgactacatgcatttagcatgctcaacgttgaacttcgctttatgatcagaaagagcaaatgatcaagcatgcatgctgaatgaacacaaaaaagttagttaatttgtatatatgtaatactttttttcctgaaaagaatatatgatatatggttattcttcttctacatacgtactgatctttttttttgcgaggacatatgtactgatctagtatccatatttttcatcagcttatgtattaatatagagaaaattcgatccatagcacacaaaaaaagccggtaccaaaaaatagcacaaaattttcctctttccatcagaagcacatgccactattttttcttcgatatcacattttccatccaagtccatcggttagccatgattaggagcgtgaaaagacaaatttgccctttattccaaaccttagtttggacggtgagggcgactggatgtaggcgaggcggtggggtggtcgacagcgatggccctcccatcccatggcctcagcccccatccccaagctcattcggcgttgttgccactgctctccaagctccgcctccaccatccccatcactgagctcgttcgtcgcctcctcccccaacgcataaggacatgtactgcttgattcaaatattgttaactatgccagggtcttcaaacattcgtgttcgttgtgtttgtgcacacaccattagggcctaagacccttaatatctaaaaataagtaagtatgaagccttaaggcctctttataattaacttcagttattaatgacccagtggttggaggaattttgcaaaagatatcttataccgatggatataatcacttatgagtgatctagactcaaataatcaggtatactactctggtaacagcccatctacctcaaccctagacataggattcctttgcggccatctgatagctttacatcgatgattgctgagtttccgtgacaccagtttttgagatgagtagcaaaagaactcccaattcctcaaaggcctatatatgacagcaaattagcaatccactggcctagtccacttaacaatctctttcatttctctgtcagcttgagggcttgaggccaacaatagctacccattgccatggcctttgcctccatgaaaggcttctctctctgtctctctgaagaaaatatgctcatttctaagatagggagtctctggctctctgctccccttcatctgcttgtttaggtttctctcctctatctgcatgcatgtatattgatatggtgcaattatcgaacactgtcattccacttcaaagcagagcctacaactggaaaagaagcggcttcagttcagtctcaaggttctggcaaggataagttgatggctatgcctctttgtaccttaattcagagccatccctatcaatcaatgatgaaatcaacggctcaggtctagcaaacaaaaaaaaaagcatcacatataagtcaaactatgtgggagtgatatgtacagtgaaagtaaacaaaatggattgttattcttgttcctcttgtggtgtcaagtatttagcatctgatgaatgaaacttccggcttcacatactcaatcaaaagaaaaacaagtgcactgaacaacatgtatctgtattccatttttttattgacgatggctaagtgaagtttgaatttggtgattgtcggtgttatagataaggtatacccaatagtcttgggtagggttcggcagggcccacaatataccatgttttatatagaatcatgcctcatatacgaaagatgttttggataaggaaggaaaagcagagttctattcaggcactaagaactactcggatcatatccatacttgtctccctaattccacttatccgagggtataaatacatgaccccttagaaggaggggggacacccctcttacccctccgccgcccccgccaccactggtgttcgccttccccgccaaaggaagaagatggtggcagcgccgtcatcggcatggcaggatctccccaccgacctgctggtcctcgtgctgctccgcttcccgtccctcaccgaccgggcccgcctccgcacggtgtgccgttcctggcgtgccggcggccacccgctgcttcctatcttaagccgccatcatattgcagggagacgccatttctgtctcctattgcaatcaacagaaaggaatcgtcgtcatcagctcatttacagacaggaaaaaggactcaaccatggatgtatctgatatcgccttcttccgagggaagctatacactctcagtagagagcagaagggcttgcttgatgttcttgatctctcgatgacgaaaaaaatgtcatcatcaagatgttatcagtattcagtgcatcatccatgatgatcctaaacagccggtaatgtatcgttttttaggactgatcatcagtatgtgttgagtccaatggcacctaaggtcttcgaggcatggagctgtggcgcagtttctgacttggttcttcccggctgatgtgtaattgcagcttaaaatgttgtttggttttgggacattactacgttcaatatgtgtatttaccttcatatcactgctaatcagttatgcaaaactgggaatcctgaacattgttgtgtaattaagctatacaaaataggtcgtcttcaggtcagtagttgatgaagaacaactggctgaatttatgttatgtggtttgctcttcatttataaaaaaaaaatcgaatgagcaacttgctgatgtcttggacaagatggagatgcagatgctaaaacaatgtctccataagcctactgaagtcatccatccaagtcactcaagttttaagtttgtgatcagatacattttaagtttgttatcagatatacattaatttcacgcaattatcaattaattgcatccagtctattgtgctctaatcgggcaatgcaacacgaaaatggtgagctgggtagagcagctgcggcaagacacaaggccgcccagttattcctggcaatgtcatccctgctgcaagcagccactatcattgatcatggtgctcgatggcttccttcctggctccacagccatcgactcaggggatccaactcaacagggattcccactcgcttgttttccacgatttgcagccactgcaggatgcaaatgtcagtgaacatcaaacacccaccatgtctgaccaatttaagccagattttagctcatattaaggcgaaacagtgaggtaaaatcggcttaccattgaagaaatcagagggtttccgatgcctcctagcccaaacattggtaactgataagtgttcatgccttcgttgcacagtagagggcacatgatacaagcaaagctttgctgctggtagcatctgcagtggttggacatgacagaaactggcctgttgcttctaatctaataatgataagaacgaacgaacatggagcagacatcagtcaaatgtgcagttataagctagttcaatacatgaaatcattatcgtgttcaattggacatttgcgcaacaagcgggctacaactgaatgttagctatatataggttcaagtcatgaacttattgagtaaaagggcatgtagcctagtggttgcagtaacctgagtagcaccccaagatcctgagttcaattctccaaaggagcgaatttcaattgggttatttgagagctaagttccctgttcgataggctaagttcctaatttaaaaaggctgcatgtatccggttggatgtagaggctgggtaaaaatacccttctctaaaaaaatgaacttgttcatcagttcaaactgaatgggagttgcattaattgtcgttatattacatcgagaatcaaaatttccaacaggttagtatacgtacagcattgacctccaaactcattaaaaaaaggcaaatgtcatccatgagtttgtaaatcataattatttacaggtctattactccatttttatacattcatcatccacgaagagaaaaataatggtgagtcgatcaggatttaagaagagcatccttcccctcgaccatgggcctcctcccccttgatgatagtgggggtgttggcattggctcgttgtcctagaccgcgccgatgcagatctagtccacggacacggccgagctgcagcggcagatccagatccagtccaccatcttcaaagaggttagtcgtcaagttcaggtgaacaaatttttggtgtcatctctagattggaaaaaagtttgttgctgttagatgtgtgtctgcaatattgacaaggggttgtgttcaaattgttgtgtataaatgtctgtgtacaaaaattgatgtgtaatttgggtttgattctggattgatgtggatcgagtggcttcctttttttttactgatgagatcctaagagtgatggttttttatccagcactgatgagccatagaatgccggcacaaaaggctggttccgactgacaccaatggcttgttctgtactagtgagaccccctttgttcattggcagttgcgtgaggctgccattgacatgctccgacctcgacggctttctccatatggctccatctctattgactcgacggattcaagtcgacagggattatctcgcacttgttttctgcgatttgcggccactgcaggatgcaagggttaatgaacatcacacatccacatccaccttgtttaatcaatttaatccagattttgactgaaactaaggcgaaatgatgaggcaacatcatcttatctttgtcaaatgtttatgatgcgggtaattttaccatccttgagaagatatctagaggtaccatattttctcctccagataccaaaatttggtacctctagatactaagtatcttaaggcactaaaaattctcgtgtaaaattttggtacctcaagctaccttttaaaggattgtaaaattcctcttatgatgctgcctaggccgcctaggccaaccattgcaagctgctgggtgcagcggcctcctccagctccctaatcatttgatactgaagggcagtgaactgcctcttctctttttgtgtcagttcacttcagtgcgccacaaattacatacaggttcgcatttgcgaaaatattgtgtcatccctcagctatacatgtggcatcttgcatgatatagagataaagaaaatctatccagccggtattactgaattccagagcagtcaccacatgctgggctccagcgactgtgccgccgaatgctttcgctcgccgcggtttgccgcttggtggcactggcttggcagtcagcacctacacgactacatcctctgacatgagaagtcctgatgcctcctaggccaaacgccactttcaaaatcttgaagacgatatgtcatgtagaatacttgtgaaattcccggcgaagaactgcaaggagttgcctttctcatcatgctattttcctttgtggcttcgtctcgtattgtgtatgtggagcagaagggataggttcatatatatagatgcattgtctgatggcagcaatttaagatgtgggatggacaattcagaatatatgtgaaatatccgtgtcaaattttaaccccatagcttgatttttgttggtaggtcagatcagtttgtctcttcaattgttcaactcaatgcagcgagttatcgaccatgccagctataccacttgacttgacgagttaatttcgaacatatagcttggcaaagaataattaacaccggtaccgaggtttgcaatttcgatcataattattaggagtagctcatatcaagttcataactacttacatgtttttttatggggagtgaaatactcctataacacctatacgtgttcttagtaactgaatcgaaaagaacaacaaatatttataccatgttgaaacacgaattagtagtagaaagcaaaatcaagaaacaaattttgtcgaccagccaccatggttgtactataccagttgcccaagggagggtcgtggtggcatgtctggtcactgttgagaggttcttggtgatgcctgcctgacaatttcaacaggtgacatgcaagctcctgatgcctcctagcccaacacccatagccaccatctacatggctggagtggcttctgttccatgaaacattggttgcaccattgttatgtcaattgaatatgtatccttcagtcctttctcagcttgtgcaactgcatctcatatttatagagcaaaagggtgtaccactacgtacattactaatggatgcacatcgcagtctagtggtacagaacggagtgtggttgtttctgaaaatgtatgacaaatttctgttacttcaattcttcaattcaaagtagaaagtcagtggccacgcgaaccactcatgattttaaattgcagaattttgttacatcatttcagaaacaaacaattactggaatccataagttcattattagttggttgattcgatcacaaaaaggcggcgtggattgatcaaaatctgtggctgctagccaactcggagctcaagaagactgcgcatctccttcatgcatagggtatatgacaatatccagctagcatttgcttctgtgcacatgccgatcatctccatgattctggactgtacaacatgtgagatggggtaatcaaaccattgctgcctgagtctgtgatgaaagagctgcggcacaagcgccactttctgacttggttcttcccggctgatgtataaattcttcgtagcttaaaactgctgtttgctttcgggaacatcagtatgttcagttatgcatttaccttcttactccttctaatctgttgaaacgatcagcacaaccaaactgtgctaaatttagaatcctttaatggcagagcaatttctttgcaagctatgcaaaattggctgtcttaaggacaacagttaatgaacaaaaatttgcaactgtgctttcgtttttatttgatattaactggcaaaatttatgtggtttggcctgaaatctgaatatggtgtgatctgtttggcaaattcagaaacaagatggcctgaataaaattgaagtgaacatgctgctgatgtcttggagaagattcagatgctaagacaatgttgccttaggcctagtacagccatccaaccaagtcaatgagagttttagtttgtgatcagatgtaccactaatttctaattccaagcaattatagttcagtacatgcagtcattcttgtgttcaatggagaactagcaagctacaacttaatgtgggtcaaataggtacccaggtccctaatttcttcagcaattctaatcagcaacaacgcaatggcaaggcttacaactgaacgaaagttgcattgttgtttcactgcattgttgtcgtacaacatgtattgctgctggtggcattgcagaaattgaacatggcctgaacatccgcagatagcagccaagggggtcagagattaaaacgctggcgccaattgccattcaatttagaacaatcagttggacatggtctgaacaattagtttcattttagctagctgctatcagtagcagtggcctccactaccaacaatcggctaggatctggcaagttagagtcctttcatgttgttggtatttactgggtaaatctatgagttaattttgtctgaaatctgaatttggcatcgggggtcaactttcaaagacttgtttcagtccaaatgataatagcagggtgtgattttttagactggcagcaatggcatggtttatttcagaaaattcagaaaataaggtggccttagaagaacaattgagtgaacatcttgctgtgtaccagggaagacgcagatgatcccataagcatactttatacaatgcgataccgggcagttatttgttcactacatgcaaactttattagttcagtgactgaattgtctagcaggttggcgtacaacattcaggattcaggaagagaagatattcggaagaggatttgagctgaagaagcaggacgtagatatccaactgagtagagcagttgcaccaagccatggcgtccgagtggatcattggcagtgcttccatccttgttgcacgaggctgccattgacaagctccgagctcgatggcttcctctctgcctccgctaccattgactccacggttttatggactgtctcacgcttactttctgctattccaacgcactgcaggatgcaaactgttagtgagtgcacatccaccatgtttaacaaacttaagtcagattttggctgaaactaaggcgaaagtgatcgaggcaacataagtttaccttcaaagatttcaaaggatttctgatgcctcctaggccaacctttgcaagctgctggggtgcacgtgcctttgtctccctgaaggactgaaccaatggtcattttcttcactatcctatagcctatagcatttattgtgctccgtcatgcactcatgggtttacatatggatagcctagaatggatatatatgatgtgaatgagtcatgacataaagcaatcaagtgaagtgcattgaattgttttgttctctttgggtgtcaggctttcaacaatgcaagccatcaagttctcactccgtctaaaataagtacagtgtattgtgttcttcaatagaggatctgctgatctggaagactgttacatctctttttttttagaaaatggattaaaatccggcctctacatccacaatggatgtatacagcctaaagtcatacaagagtacttagacccgaattccttacaataaaagagtaccaaagtgacaacacttaaaagagaaaagagaaacacaagactacaacaatcttcttttaaggttccacccatattttgcatacaactccatgacccttgcctccaaaatcttgcaacattctttcaatttgtggtcatcctctttcttaagcaacaaagtctattgaagcacccaataagtcctcttgaagatcagatgtaaaaaagaattagttttggagccggacactggttgctagcatcagaaccaaaatagcaatcgtgtccactgtgatttgagagaagaacgggagataagaattcccggtgcctcctaggcctaccacacccatggtaagcggttaagtgcagcagacactgaatttgttttactctatatatgattatagtcctacaccttttgatagttcatatgatttctgatgccgcagccagaagcattttttgtgctccgttattcgctcatggatttacatctatatacatagactataagggatacatattatgtgatacctgacataaggcagtcatttaacactgccagtacaagtgaagggcagtgaactgttttttccccctctttgttgatcaggttgttagtcaaaatgcaacctagcaagttcaccttccatctagagaagtgcagcataatgtattgtttagaaactgattacatcataccatcaaaaccaaaatagtagtcatccgctgagtactgaaacattggaagaaattgaagcatcatagataccggcacctcccaggcctaccaggcaaacccattgtgaatagccattgaatttacctttcatccactatgccaaacgaaaaaaaattgttctagcaactcatttctctcatggttacttcctctgatctttcatcgagcaaaagaacaataggcctgtactgtagttattccactgagagatctcaagatgcagtatagccatccgacggagatagtcaaactatcaaacaaagcgcagatcaaaataggtgatagttttgaaaacacggtaagatcgaacttagagaggcaagaacttgaattcctggactggacaaacaagtgaaatctcggtacctcccaagcctaccatagccacgcagcaaataagctgaatttcgagtttggcatccatcaaaaacctgaattccctgtggttcattctcctgtgtctctcagctttagctactactcaccctcttgttatctcttttatatatgggctggattgggagagcttgtatatcatatatgtcgacaaccaaatgtactatctgattccatgcaataattattgattcagcacttgcagctagtcatgttcagtacatcaggccaccaccaaaatagtgctgccgtgatgcaaggggagccgcataagtctgatcactgatcagtttgggcacttcaattgttcatcagttcaagcagcaagtgaaactgtatccttgctaccactcaatgggaatcatgcattccgatgataaattgcaagtcttagaacagaatagcttggaaaacaacaaacagttaacacaaagggaggatcaaatgccaccaattgctgtgcggtgctgcatgtatccacattgctatgtcagcaaatctcaccagagttgtcgctttaaggatcgtattggcattagcattgtcgagatggaacagatgtggaatgttactgcgactacatggtgccattgcatgcttcggttcgccatggagaaagctcttcgtgatgccgttgccagttcgacacagtcgtttcgtgacatgaaaactcctgatgcctcctagtccgacagccatagcaacccagcagcatggctggttggagtggccactgctccatgttcctcgaagagctactcgtgtcagctactccatgttaacttgcaagaacttgatgatgcgcaccatgaactcttgttcatgatgatctctattaattcttgctagctaacatgagaagcgagaaatacaagcaaggttttgtgcaatctatttctcgcgcacgcatcacttttgccacctcatctggccttcttatggagcagaaaatatatagcacggcatcatgaatgaatttacaatctgaatatctctgaagcagtctgattttttatcaaatgcaggaaaaagaagaaggggtgcacatgaatcaatgcagcacatgaaccaatccacaccacagacttggagatatgtccaatcagtttgtagactgcgactatggcgtcgtacgttgtatgatgcggtcaccattgccgccggtgatccctgatcacacggcgccctggaacgaaactctcagggaaatcacgaactcacacagatgcacaatgaaaagacgaggtgaaaactggcccatctagtaaaacagactcgaatgaaaaactctgaaaaatgagaaccagacgcgctccaggaaactgaaactctgaagggcagcacaggtttacaacatagaaactaatagccatgcatgccgcgatgatcctagtgatgccacacattcacttcatgacatgacaactcnttgatgcctcccatgtccaacagccagacgncaacccagncaccatggctggttaattggagtggccactgccccatgttcatcgaaaagcaactcgtctcagaaacattattgccgctacaacttgcaagaacttcacggtgttcatgatctctctcaaaacaagcagcgggatacataaggttttctctctaatctcacttttggcaactgatctccttctgtatggagcagcgtgttgaatagtcctacattggttgtggaagggcaagggacctagctaatatataagtgggagggcacgggacctagctaatatttttggtaattggctaaggggagcctagatccattaaaaaaattgattttgtttgtaactagcaccttgtgttggtccatttggcattgccgcaatgatatagtttttgataaccaaaaattgtctaaccccatgcaggttgtcttcatgtcttccagttgactccattcttggtccttgatgctttcataggaggagtagaatattttgcgcagtgaagctacactcttgaaatcgatagccatgggacttttgttcacatgcatgtaaaaggaaggtgtaggtggagtcactgtgcaatcttctttgctccataaaaggatcatcagaagtaccaaaagtgactatggaagctttgatgttacaatatcacctctaggaaattccttaattaatgaccattcctcaagaatttcagtggatatatatgatatatggttgtgcaagtttcggtagcaaagtttcttgatggacagtgtttcatggagaagaggccaatccatccattgaactagttgctatggctattggcctaggaggcatcaggaactcctgtatctcatgataaattcatcagccagaatcaccaagatcctccacacatggccactgaaattctcttcatctggccaaagagcaacacaatgcacatggagacccaggaggctgtccaccaagccacagccccaaacctttactacgacaggagcttgacatgccgatgcatcctcgtcgtggtcgtgctgctctccggaggttgtgtggcagtggtagtctatcgtgattgcaaagttcttttcttttgaatgaatcgggaagccgccaatttcatagaatagagaatgagtaaacagtacataaccaggagaaatgaatgaatgtacaagcttagggcctttggaccaagctaactatatatagagtgagccagttgccgaggtttttcgcaattgcaaagttcaactcatcgaaaatgacaagtactgttaagttctagagtaattttaccatccaatatttggtaacttgaggtaccacattttgcacacaaagttctgataccttgagatactaagcaccttgaggtaccacattttgcactagaggtgccaaattttacactataaagtacctcgagataacgaatatttgtggtacctcaaggaaccaaatgttggatggtcaaattaatcttttagagcaattttacactatatatagagattttctccggtccaataaaaagtatctcgtgttaccggtagcaaatcgtttcccatcgttggatctaacaatgcccattctgcgcagttagattcaatgatcagaaacgaattggtaccgtgaggtaccggtaccttgaggtaatttttgctggtcggaagcaaatctctatgtataaatcttacacttcgatcactcccactatatatgtttgtggatattgatatattagaatgttaggcagctcactctctggaaagtgtgaacatgacttatatatctcaagtttttttacaggtaactgcagcattgacctgaatttacttttatgaaatgatatctcaccaaaccagatcatatatactaagtagtaagaaatggcacatgctgaggggggagatgaacaacgtatcacacaaccagagaaaagtttttggtttaagccacatacccaaatctttttaagaacagaaaagcatacaacaaaaaggtgaaagcaggtcctgccagtgtgttggcttaggagacacttctctgtctggctgcactgaatttgatccttagctagtgcagccattgaactagtccaaagtcagaagatcaagcctgaaacagtgagatcataaggaggccccgctcgatgacattgatggccatagattccagtgatcatcaatgtcaacctcgtgcaggaagcatgccagtacgttatggcacaacgaacacagcactgcttgtagttgttgtagcaacggcagtggcattcttgtggcgtatgttttttaggtggtttatatatggtggtagaattttattatcaatagtatcatgagtagaagtgattaagaaatttgatttatcagttctcctatcaacagaaaaaacatattctactatgaaaggtctagattagttgtactatcaagaaagaccatttaaaaattgtaactgaaaattcttatgagaaaattgccgcccgtttgtttcacaacggctgacttgtccgcttaatcttggtccaacagtatgaaattaaatgactgtcatccaattggctcaggggatatggaggctaatggacactataattccactccaaagaggattcctctgcaaaatgctactttgttcatactttgaacaattcacggtcagtcatttaggatcataaccgacgtagcgcgatgcacatgaaaagtgtaggatcgtaaagggcctttcccacccaaaagctagccaataaggtgaggggctcctccacttatatattaggtatcttgttctttcacaaccactgtaggactattcaacaatctcctctttcacatattggtgtccctcagccattcaccggtccttcaccgcatccc

SEQ ID NO: 18208 - DNA, 3529 bp, Oryza sativa
gctgctcaataccaatgtaggacaattcaaggatggttttttttaacatccttgttgtttggaatcctttattagagcattttggtttaaacttgttacttatgttacatgtatactagctgatttgcccgtgtgttgccatggagtcttaaaaaaaatctttggcattcattttaaagcctaaaaatatttagctctccaatcattttttgtcataaatattttcgattcttacctagttagccagagtcatgagacatagagctatgtttctttgacatacacattgtgagcccacacatcagtaagaggatggtgatggtagatttactgcagccaccactattaatatttaaagtagtatagattaagcttcactgttttttttttgttttgctcttttttttgttccttctgtttttcaaagcccttcttcaaagtggttgctaatccttaggcctgaggtgtcgagttcatgtcagggcaatctgattttctgtttgtatgggatgtcacattatgtgatggatcgtgacgcgtgcatatctatcagcctcaatggtcaagctctgtttttcattcatattaatgcaggaaagaaagctagagagcagccttgtcgacaaagtttgcatcaccaaaaattccattggttatcatcttcaatcaagttagatcatttgatcctgccaacatatataagatcgtcaaatcaccatggctcacctcatgtccagaagtttagacataggtttaccattacagatttgatttttctggatgacacctcctttttttagatgaaaggcattgcgcccagcttttactaaaaagcataagagtggatgacacctcctttatgttgcaggtgggtcattgttgctctcgcctgattggttcatgggccacatacgaaaatcaattttcacagacagacctcttaacccatagcttgttttttattggtaggtgatcagtctgtcatttcgattcttcagttcaaaaagcagcgagttaacgcccaggtaatcctgactagaggttatcctgatattaagtttcaggttttcgaacacatagcttggcaaagaataattaacaccagtaccgaggtcttcaaattttgagcataacatattcacagtaaactcacacatcataagttcgtaactagttacaggtttttgtctggggagtgaaatgcttccataagacctatatgtgtttcctggtaagaaatttacactaggttgataggagaatcagtagaataaaaagcaatcaagaaactaatgtgttgacgcacactcatacgaccagctgcgatctctttgctgtgcagaggttgcctattggcccatttgaactggtgacatgcatgttcctgatgcctcctaggccaacatccatagccaccatctacatggctggagtggcctccatgaaacattgctgaacatttcgattcttcagttcaaagcagcaaatcaatggccacgcgaactactcaaaattttaaattgccagaatttcgggcatattagttcagaaaaaacaataattggcacccataagttcaatattagttgggtggtgcagattgatcaaatgggtatatgactagagcgccgttctatatatagagagaacatcttgtaagcagaaatatcagtttcacccacctgagaaatgtatcgctgttattgattgcaatcctactggtagctgcactgctgggctccattcactttataggatttcaagtctgggtattcactcgataattaattaatttacatattaaatccatcacaagaatacaagatgatatttagtaagagttcactcaccccctaaactatgatttccccagtccccagctggtcgtgttgtggcaggcgacactgatgcatgtaatatatctccatatatcaaattattttagaaattttgggtattcacaagaaggcaggcctcattgtgattgatgtgcctacggtaatgagtatcgcgggacgaatgactgtgttatatacaccatgcatcatctcactgggatcaccttgacttgcaatggctgaaccggctagagatctcctgaaactcttctgtttcaccaaatttgagcaaaattgcaatggatccaaaataaccagaagattattgtggctttgatctcagcgacagcagcttgaatcgttggacaaagtgacatgagagctcctgatgcctcctagaccaaaaattactcatagcaacacataggctgtttgtggagacctggagtttactctacctccatgaaatacgtgttaatatatctccctgtgtgtgcgtgcgcacgcatgtatgttggtgttctattgggtctatataatatttgatttgatgcaatcatttaatacaagtaaattccaattcaatgcaacactaacatctgaaagcctggagatatatgtcatgttcatcctaataaaattcagaaaaaacagacacagtgggctacctaatattcttagtaattgaatcctgatgaaggagatttatgccagactgattgaatagcagaaacaaaaatcagtgactgtgcacatgtcagtgaaatacagcctcctacggagttcttttcatatgcatcacctacgttggttatgatcctacatgaccgtgaattgatcaaagtatgaacatagtagcatttttcagaggaatcggcctctttggagtggaattatagtgtccattagcctccacaccccatgagcagattggatgacagtcatttcatactgttggaccaagattaagcgggacaagtcagctgttgtgaaacaaacaggcgccaattttttcataagagaccttatagtagaattaatctaaaccttttgtcttctttcatccattaaattattactagctaccgatagtagaacgatttttttgttggtaacagaactaaatcaatttcctaatcatttctacttctactaatgatactacaggtaataaaatactaccaacataaaccaccgaaaaaaatatatgccactgccgttgttacaagcggtggtgtgttcgttctgccacactgccatgcttcctacacgaggctgacattgatgatcatactggaatctatggcaaaccctccaccgccatcatcgcaaggtcagggcctccttatgatctcactgtttcaggattgatcttctgactctggactagtccaatggctgaactagctatgaatcaaatacagtgcagccagacatagacgcacggtgacatgaaagctcctgatgcctcttaggccaacagccctgcatactaacacattggctggacttgctttgatctctgttctgttgtatggttttcttttcttaataaaatttgggtatgcggcttaaaccgaaaagttttctctggttgtatgaatcgttgttcatctctccctcatcagcatgtggcatttcttattgtatgctatttggtcaatatatttgctggtttggtgcgatgtaat

SEQ ID NO: 18209 - DNA, 3136 bp, Oryza sativa
gaattctgtcttgaattgttcttattctatccacttttgctgtcaggaatggaacttcaccagtgaaactataaccacctagaaaccagagcacagtataacatctcatacttcaagttttggtggtctaagcaaaaagtgacaaatacatcaattaactaattacttggacaaatagaactcgtgtagtttactcttaactgaattatgtttcttccaaagtttatccaggagcaatagtagtttgatcgatggacatgattgtgacgttgaacctaataaacctgagagatgcagtaacccatttgtgtattgatctttctaaaaacatttatatcctcttgcaagtgattaaaatgggcaaggcctgatcgatgcaaggtggccgcagtgcaaagatgcatcaatgcatttgaaaagtatatctggtttctccaggagactatcattgaattatttccaaaattcaatatattttttgaaacttcaggattactggtgggtcctagcaagatattctatttgccaaaaattccaatttctgttgattttgcaaaaaaaagaaagaaaaaaaatcaaatttagcacaatatgtccaaattttgattttttttccttctgaaaattccaaatttggaattttgatgaccctggtatgattttgcgttcgaaatagtgaactctggctgtagtgacctacatatcaatgagagagaacccatggccatggagtaaattcccttgatttgataaaaaaacaatggattttattttctaacataattctaagagatttgctccggtccagtaaaaagtacctcaaggtaccgatactctacagtaccgaatcgtttccgatcgttggatctagctgggtaggatgggtattattagatccaacgattagaaacgatttggtaccgtgcagtaccggtccctcaaggtacttttcgttggaccggagcaactctctaattctaatggatccaacacaatggaaaccaccggtgtaatagaaagtttcaatggcattgaaggcatcatcatgatgcatgcaagtaaaaatacaatggttactcacttgatttgatgtgattatccattgctctaaattcatccagatagacatgtgtatcaaactatgccatcatccagacagacatgtgtatcaaactatgccaattgtatgatagggataacatgaaaattgatccatcagtcttctttgtagccgtggcgagagttctttgtgatgcctgtgatgtcgtctcatctggttacatgggagctcctgatgcctccaaggccaacaatcattggtgtagtagtgctttttgttccatgaaaaaattttgcttgtattgacacattggtagtgaaacttcctccactctctggtgtataaacttgctagttatttacttatttctcagcttgtgcaactccatgtcatttttatggagcaaaaagtgttccacactatctcatgttactgaacagagtggtcaattctgaagaaaatgtacgagatattttggtcaattcaagtcttcagttcagagcatgaactcaatggtcagttgaccacacgcggcagccactgcactggattggaggtaaaaggcactcataaattcgttctcagacggcagattcgatcacataaaagagctgcagattgatcaaacaagtctaggagtatatcgatgttttgtacctttcaatttgtagactaatactttcatcgtaatcagcaaatttaagttgcctagcctttttgctctattgtatggcgaatgtactgaacactgtttctttttctacctgaaatctatgaaatggcagaactcctgcctttgctttatacaaagaaaaagttattttatatatagcacatattgtaaacaaaaatatcagtttgcccaaccgaggtgaggattgtatacctacccctgaatgcatgctggtgtccagtgcaaaagctgctcatctttactcccctgaagcagcatggggaaaatatcctttacacctaggtaccatggtagtatgcatgcggtttaaatagttatataaaatttcatacaattttgacgacattatgagaatataagacagtatgcaaatatgcaagtccaggtagcgtgaaaccaaatggcccagtacagcacctgcggcaagccatgttccttgctgcacatagcggcagtgctgcactggttcaccccattaagcttgctacgcaaggccgacattgttgctcatcaggttggaagcaagttctagctccgtggctacggttgtagcgacacaagctcaatttactatgcgtagagagtagatcgaggcacactatggtgttaccggagctcctgatgcctcctaagccaacaatttactatgcgtacagagagtagatcgaggcacactggctgtagacctggagtttcctcttttacctccacgaaaacattgttcaccgttagctctacctgcatgtaaagcatttcttaatcatattggtgtaatattgggcctatatatatatatatatagagagagagagagagagagtatattctactccatattttttcaggtaatgatatagtactccgtattttatttgatgcaatcatttaatgtacaagtaaattctaattccatgcagcaccaatctctggaaaagaactggacatatgtcatcatgttcaatgtctgcacgttattcctagtaattgcatacaaaagagattggatttatgccaaactgacgcacagctcatagcagaagtaaaaccaactcaatgatttgttgactgcattttgtattgtcaactgagacaattccattattagagcatcaccaagagattacgtacaatcttccccaaaaatttgtttttgggtttcttaaactgaaatagaaagcaaaataactaatctctccaagagaaagcctaccaacagaatttccgtttcctccgtcggcgcgtgcaacctcctgacactccctctgaaaccgcgcgccgatctcccacgcgtgggaaggagaggaggaaggtgtgagcggcgagattgggagtgggtgagggcaccgttttctcccacatatcaacagagcgaatatttcggg

SEQ ID NO: 18210 - DNA, 7160 bp, Oryza sativa
catcgtgtccactcaagatgtcaaatttgcttcattgttttctcatggatgaatttcgacacaactctctctcagatgaatggcatcgagggaatcatgataaaaatatacatgtaacagttaatccattaatttgatggcaataatatatattattaaaacttttgatggtatatatttatctacatatctgcatcatactacagaaactctgtcatgcatcagcgatgtgtgccatccctatgacgtgtacaacagaattcttgaaccgtcactcctgtgcccaatgtacaagcttgatctctacatggtggatggcagcgatggcccctgacatccttctggtcatcttggcaaggttctttgtgataccagctactccatttcatcaggtggcatgagagctcctgatgcctcccaggccaacatccatggtgcgtcatctgctccatgaaatgttgctcatatcgaaacattatatactgaaacttgcccaccgtcatgccagttgtaaatcgtcagcaaaaagaataatttctcggaagatagaagtgatcgtcaccaacttagcgatttctttatgggagcaaatgctgtagtacctctaattaatgcactttctgctggtataggctgatagcgaacattaaagagtagccatgttctagaaatgtgtgaaaaatttccaaggcaaatattaatacctgatgtgtattagcaaattaggtgtttgatgttctctaacaattcttcccacaagtaactgaacttttagtgagtttgggatgatgtttctatcagatggaatttaacatagttctgatgggatatccaacaaaatgggaattccatcatagtcgaaatgcctcaaccacgatgaagtaaagatgcaacaatcactcgtttattcgatgtgaacatttcacactttcttgttgccttaggagctgcagtttcccttcatgcacgcgtgatcagatgctccatcaatcttaatccggtgccctcaatgatacaactgacatttcttaactgccataaagaacaaaagaactatcttctaatatcccactagagaaaatgtggctgaaaggtggatggcagcaatggcgccatcacatgcttctggtcgccacaacggggctctcggtgacggtggattgactttttcttgctgtggcataacaactcctgatgtctttcactcccatgcaaacaggcatagcaaaccgactccatgaatgacatctctctctctctctctctcaactagaaaggtagcccgcgcgaatgcgcaggcattcaggaatcattgcttaaatattttttctaagatatttgttagttttataatatgtaatatttaattcatctacataagcacttatctataatcttaatcttcttcatcatttaagaagacataggtctttaaagtctaaattaaaagtaaggtgttgtttttctttcttaattgattgttttaggtcttatttttaacaaaactcaaaaaaggttattgctaataaatgtgttttatttcttcttttaattggttcacatttgacacaatttgttatatgtacttacatatgaatcaataaaaatagagtagatatacatattctagacctcgcttccctataatatatgtgatctatatctttttttaaatatatgtagtcaacctgagtgttaaaacataaatttaatagtaagaaatataatatttaaaactatctactgctaacttagtgtagcttatatataagcaataatatgtacataaactcataatgctatggcatagaatagggggaagtctattaatctgtagtcacttaaaaatgatgcggtggttatgtatagttgtccaattcaaagggaaaattaagaaccacaatggttctaagaaattataagattttctacaattggttcaatttacagcctgttatattttttctattttttattttatacaaatattatttttagttcaaatttacgatatgataaatagtgacaacattacaccctatttgtcaaaaattttatctataagcaagtaagattggtacagattctcattgtttattaatgaatggattgtatgggacatgaggctacgataaattcatgggcttgtatacaccaatatgtttgcattatgtgatagataattcatttgggaacatttcatatgtagtgtgtgaggctctacacaaccattgtggatacgatttgatatggctaataagatataactgtacatgcaacattattttcggaatgtaatgtattatgaatgctcccatcatttacatatttttctataaaatttcctattaaatgttaggaattgcgtgatcgaaaccaatcattatgtattagtttagctagccttcacttggcatgaattaattagatttaaattacataatcctttatgtgaatcccacaatgcatatccgatccaattgccacaaaatattgaaaagagaccctagaaagtctttgcattccaaagtccaaataaattctttcaatttttttcgcattgtagtatagatatggtttggtggctatatggtccatttgttgctcctatttattatgccctatggctaaaaaggtaaggcaaagctaagcttgttgtgctttctcacaccctttgtatatgcattattctccttgagactggtctacgtgctgtttttctgcttcgatttctctcctcacttgtatttgcgcaaaaaattatttgggttccaaagtataaatgaattaattataatttgtgttagaaaaatctaatggttgaaaataattggtcaaatgttttacttttttttcattgagtttgtaaggtgtttttttttattttttttagacgtggtaacttaagactgctctaggacatgtttgttttgtctaaatattattattttggttgacatgtaactatgttcaagtgatgtattttaatttttttaaataaaattatggttaatatggatcttaaattatttatttaattataaataaaacaacagttaaaaaattttaaaaacatatatcaaattattgattgttttgatattatgttgtattttaaaaattgaaaaattagagaggagtaaattggacagaagagaagatacgtgcatgtaagtgcatgcacctacagcaaggggagaggatgagagttttttttttcttgagatagatcccattaatgggttcaccagtacgagttaactatatttaaacacaaatataatcttagtgaacaaagtattgtattttttactacttattattttaatcttattaattaattttgtgtgtttcatattattctaatataagcttaatcaagtgtttaaaaatctctatgatattcccataaaaatgtgtctcgagtgaccaatagctagttaaaagttatatttttttacttgttaaatatagttaatttaggccttaaattaaacgacaaaatctaatatatgtggataaaaaatagctttaagattcagatcagatagttgttaaaatttgttatcatataatatgttttctatctaatactacatcataaaaacaggagagaaaagggacagaaggagtggagggatcggtatatacatgtacgtacgtacgtataggatggaaggggtgggacgtggcccacgtatgtgggcctttcaattttttaataacaaaaataaatttaatgggtccaccatgtttaatgaaaaatgatggttgtgccacgtggcagttcagaagtgtttgtagaaatgccatgtggcggtttaagagtgtttatagaatgtttaatggacttttagtatatgatagatagaagatagatttgtgcaaaattgcgatggctccaagacgaactacaattaatcttagcgacactggctcagtttcaagggaaaatgccaaagagaactctgaatcctgatgccacccaagagccaacaattatgcatgcctataacatataagtagcaaacacgctagctggagagatttggagtttcctctgtctccatgagaccatgacacacatacagtctgtttctctatctcattgtgtgcatgtaacatttccaactcctttatgttctatttgacctacatatatatgacatcacatttggtttgacacgatgattaatttaataccctttggctcatattttttatgagccaaaccaggagagtttgcataattgattttattgattagttcggcacatgcatctggagcactggtgcatcggagccgtataggcatgattattcagtttgtcacttagattctttttggatcgagggctcatcgccctgctttttgtgggttgcaatctttacaaagtacaaatccagacctgcctctaaaataccaccatacacaccgcttcgattgttcatcaattcgcacatctcagtcacccttgtctctgcaccggttcaatgtatgcacatcgtcataattaatatcatctaattaatagatttatccatgatcctctaaacttgtcccaattccttgtttgttttcactagggttgaaaccgatcaaacacaattgtgatggatccaacacgtactagtggaaatcccaatgtggtcgaatattgcttcaatggtaatcgaaggcatcacgatagagtaaacacgcaataatcactatgtgatttgatgtgattatttcacacctattgacttcagagcaagctgcattacccaacaatcatgcacatgcaaccatattctccgacaatcctaacctagtcgcctcaaggatgcatttgaaatttctatgacagagataagaacaaaatcgatcagtgatttctctgctcgagcggccatggccagacagtgtgcagcggctatggcgccgatgcatgcttccagtctccatcgcattgctcttggtgatgccagcatttccgtatcttattgtggcatgagaactcctgatgcatcctatgccaacagccatatcaaccgaaccggaccattgttggatcttgtggcctctgcccatgtccattaggagagaaaaacattaaagcaagagaagtgttccagcccttaataaagtactttggaggtaccaagattttataaaattttgatacctactacctagagatactaaattttacactaaaaaatgttatgcctcccggtgccgccttctcaaagatggtaaaattatgcttaaagcaaggcactcatcattactatttgctaacgtttctattatttgtccttttgtggccaaagggtagtaattcggagtctcagaccaactaaaattaaaagaagagaaagaccaaaggactggctgttaaaccctagaccgctgctgaggtgaaggcgccattaaatcattgggctacctctcaacttgttgcatggtatagcccacccaatttgagttcagcatggtggttacctactgctgtcgtggagttgtagccaccatggcgaaatacatagcaccaaataaaatggcgttgagattttggacctcagcagtcagcatctttggctatggcgctaaggtcagggtcaaattttttgttacggtttatttctaaaataagttttttaaaagggctaaagtaaggaaatttcagttactcatagatggtggttggtcccccgagaattgaaacatgattatcttacaatgcctgtgttgctgagcacattcatcttgtcatgcttgctatgccctaccgctccctgactatcactgccaagttgcctcctcgtcagaatatcacttcatcagacgatgtccagcaaaatcccaccctcatcattcgccattattcgtccgctgtcttgctaaaatcccaccatcctcagtcatcagactcggattacacttttccgatggctgtagttgctaatgattgccgatggagagcccaaaaattgttgcttcttggcaaagttgaagtggaaccaagccaaacaactctgcacgacaaaaccaattagagggaagaagtggcgatggccttggcgacacgagcaagcagtggcgaaggtcttgatgacaccagctcagttttgtggaagagtgaaataagaggtcctgatgcctccgaggccaacagctagaaatttgcaaaatgccgagtagaaattaacctggagtttcctctgcctctaggaaatgggtctcagtgtgtagcattccttacttgatccttagtatatactattgggttgaatatatagtgtttgatgtcatgtgatcatttaatacaagtaacttccagttcaatcgatgacatttgttttttacatatagttcaatgcagcacttgctacctctgaaataacagccatatatatgtgatcacgttcatccttccatgatagtggactccctcaatgtgtactaaggtgtggaagtgatttctatgcacgatttaagcagcataacgattattgaattgttctctattccacatttgctgtcaggaatgcttgttcacctgtacaacttcacaaacttagaaaaaaaaaagaaacacaacaactagaatggccagttttgtggttttatcatatggcgaaaaatggttgaatttgttaatcatttggacgaacagaagaacgctcatgccgcttactctaaatttgtgactgaattttgttactctctgaactggccaatgcattgtcgattggttgttagcagcaaccaatagacagtgcattaaagaagtttctatcccaaatttaagaataaagtcatatggaagttgaatgttctacccatttccaagatctaaataatgtcttaccgaacaaaaatacagtttcatcgaaaggaaaatataaacagagttcgaataaagtactttcctatcaaataacacaaacatcaagaaacaagaaactttttaccttcgtacaagccacaaaaacatgctcaattttttatctctcactaattttacacatttcaggtatcaattttttttgtcgggacatgtcagctaccaattttcagtcacagacaagatcagagagattgaggaaataaagaggaagctcgatccgccagcttcaagcacgagcagacataaaagagaagaggaaaatga

SEQ ID NO: 18211 - DNA, 4647 bp, Oryza sativa
gatggctgcacttacaaacttacagaggcagagttccatggaggccaaccttggtcatggcccctccagctttagaaatattgcattattggagtccccaagtctttgatactctaatacttcacaaaatagcacaataaccgttcaaagaagctatcacactgtctctctccaatttattgttcaagctccgccgctgcaagcggagcaagttgctgcgcggtgtttcttttttttttcacgaacacgcagtgtgtgtcagcattagaagaaaagagttttagttatacaacacaataagcctgaccggcccttgccaagtaacaagggagggatagcaggggttgaacaaagagaagggatacaaactaacaaaattgctgctcctagacagaggaagaaaaaaggaaaaggaaccccctatcctcccaataggtcccaaaacgaagcggcactagctaaagactagagcgctgtttctgttaattatcacaaactaaagtacccatgtaactcgccagagatagaagggaagatgaggtcaaatcgtgatatattgcttagttatgagcatttaacaagagatgcaaggaaggtgggaagtctctctttgttttctatctcgatcgtgtgaatgaatctggacaatatttatgaaagacggcacacgaatccaggcagatgtacaagggattggcgtgacaattttacacaaaccaacggctaaaaagggattgcaccacatgtacatcactggagcaagtgaaatttcaccataaaagcagccagctttacgcgagataatagcgaaaggaggagagatttgctccggtccaacaaaaagtacatcgaggtaccagtacctcacggtaccaagtcgtttctgatcgttggatctaaaaatgcccattctatccagctagattcaatgatcggaaataatttagtaccgtgaggtaccggtacctcgagataaccggaacaaatctcaaaagatgaagccctatcgcgaccatgaaattcaggtgaccaaatccactctagaggggcttcatcctgcgaccttgaaggtgcctgccgcaagatacataataaactggttggttgttgctagcattaaaatcaagagctgcatatatgccaaattaaacatgtccactgaattatgaaagtctaaagcttgtttgagaggaagaattgggtcaggcaacagcttaccaataagatgtatgagagctcctgacgtcttccaagcctaccatacaatagcaagccaaccattgggctggctgaactccatgaaatattcttgtttcatctctcttaacatcaagctaaaaaaacatgttgctgctacttcattttatctactcttttatggaattcagcatgtcaactatctagttagtcatgtcaactatcttgagaaatgctgagcaaaaaacttagtagcaggaggctagtttgtaacaggaaagctcccgatgcctcttaggcctaactattatatatggagcaacaagccactggagtggtctatctcccatcaactcttcaatatttgtttttcagtctggtgtcctttctcttgttatatgtggaacaaaatgatacggtcatgtagaaagtgttatagctttgtgcatctttggatgccaggatgtaattattctattatcttaaaaaaataaaaaatatgatcaagtatgatttaaatgctcatcagttactattagctaccacacactgatgcaatagaaggttgcagaacagacacgatttggtttggtggcaaattaatttaagtggtgtttttttgaggaaacctacatttacgtcgaaaaagttagcccattcgataaaccaggtcatatccaaccatttgataggacagatatcagatagctttgtggaagccatggattgttatttttttcaagaagaaacctccttttgtccatatttctagtcatcaaattggcggctttgtactttgttttttcttgatgaaatacagaatacacatttcgccacttccaaaaaaaaaaaaacagagtgggtgaattatgtttttcagaaattcagcatataccattccaaccacagtcatgaagtgtacaggcaggcaacttcgtcgatgggcttctaggcgacgaccaacataagaggcctgagagatgcagtaactcatttttatagaagtttctaagaaaactttcaaggtaaaatggtgatgacgagaacttatgcgtgtgagctgatcatggtacaaagatcacatataaaatggtgaccagttacatataaaatgcaatatgtttccttgatgattgaggaccctgtagctaatcatgtctagttatccgataaatgttgtggtaaagaagttgaaggaatgggctattttgtagtgggaaagctcccggtacctcctaggcctaactttcaacaacaagccactgtagtggcccatcaactcttcatctctttctcaacctggggtcttggatcctgtcttttataatgtcggaaaaaaggataatctgtactccctccatttcattttaggtgtagttataatttttcatgcccaactttgatcgtccgttttatttgaaaattttttaaaaaaatttaaaaacttaagccatgcataaagtactatttgtgttttatcatctcataacaataaaaatactaattataaaaaaattttaaataagacagacgattaaagttgggcacgaaaacttatggttgcacttaaaataggatgatcgaagggagtaataaccgatcatgactttgtgaatcgatcgtcagatgcaacgattgcgatattattattacactatgtttgaaagattgagtgtcatgtttcatacagtcgatttcaatgcagcaaggcaacattcacgcaaggaagagctgcagacaaaattaacgaggcgaggatttggatgggtgcgtcatggattaatacaatggaatacattagcagcatgagatgatccagcaataatcaagagtgatccaaactaaagagttggaatgcttttctttcgtgtatgaggtcctcttttcagtcgaaatactacctccattttttaatatatgacacatttgactttttgacaaacatctaacagttcgagaattacatcgctaactctagcagagtcaactacaactgttcaaccagatcacccgtgcatcagcggaatcagcagttgaactgttgaagttaattaccagcgtctaagaagatccacgagacaacagaaaaggaagaagctgcagtttgctccctagttgaggatatagaccagattgactggacaataaactgttctgcaaccttgaagaagcctacgagatgcagaaacatgtgtcgcatgccaaaacatgtccactgtgccactgcaccagagttctgaaactctgaaacttgcttgagagcagaagtgaaacaacggttatgcaacagtttaccaccggcgtatctgacagctcctgatgcctcccagacctactatacagtagcaactgggcgatgagctccaagaactacttcttttgttcactgatgacttgttgttgttttttcactaccgctgtcaatatatgatcaatgtttactgatgcccatcacttcccaaactaagaaatgatgtcactgaataaagacggccagaaggtgaaaaatgcatttgattggttagttatttggacaaacagaagcacgctaatgcgacagcaggagatgcatcgacagatgcatggtgacctgttacatgttatcgagtctatatagcatctgattgaagtgatcatttaaatacagctatattccagttcaatgcagcacataacttcttttgtactggtggctaaaatgggtttgcacaagcggggacaaccgcctttgagaaaatgtctgtgaaaatgctatatttccataggccgggaagcaaccagctgaggaaatgcatttccacattttaatttttcaggtgaaagaaaggtaaataaattttgtattttagtatgtgtctatacatggtcaatttttcatagctatgcaaaataaatacgaatggtttggtggttatagagagtaaggtgaaaatgcgtgaaactggtaattatgtgaacgaacagaagttcatgcaatttactctgaacttgtgaggacatttgcaaaaacaaaatgaacagagggactgtgaattttgtttttcagaagttcagcgaagcgctttcaaacaacagtgcaattcatgacaatgctgacttcgtcaatgggcttccagatgattgatgatggacatagcactagaaggactgagcgatgcatcaacccatttgtaactatcaatgtttctataaaggggggaaaaaagatgctagaggaaaaatggtgaggttaagaacttaaatgagcctataatgagagaaagatctatataggcaaggtgactagtcacatgtagaatgtaatatgatttcttgatgcaccattcctgtgtggttggtatcttgaaaattcccaagacagttagcaaagaacacactgggaattgacccattgacaggacatttcccggtgtctcccatacctaagtgtcctagaagagatttgctccg

SEQ ID NO: 18212 - DNA, 3449 bp, Oryza sativa
tcatctccctcaatggccgatgatgggggcggcaaaaaccggcgacgacgaggctcgaaggcggcggggtcggcggggttggcgacggcaaggcgcggggttgccgacagcaaggcgcggggtcggcggcggcaacagcgaggcgtggggtcaacggcggtaacggcgagacggcggggtcggcgcggctcccctcccctccctcctagattcggtcgaaggggggaggggggaggagaggtggcggcggcggcggttcccctccctcccagatccggccggagggaggccggggaaaggcagcggcagtggcgacagttctcctccctcctagatccagccggagggaggctgggggagggcggcggcgacagttcccctccctcccaaatctggctggagggtgccccggggagggcggtggcggcggcagtgcccctgcgcagttcccctaaccctagatcggccggaggtgggtaggggcgcgggtgtggtggcggagaatttttcttgttcgtcgagatgattttcacaagcgggtgactgggccatttgcgaaaggcattgacatacaggcggatcgttccccgcctgaaaaaaatcatttgtgtccgcctgaataaaccattttctagtagtgagataccaaattttgtactaaaaatcttggttcctctcgatacctcttaagaactataaaatttcaaataagaaattaaagcactaaataaacatgtttggatcttctcaaaaaaaaattaaagattattgtattccgttgattgtatcgtgggtgctgaatattgtgccttcaagaggccccagtcactcatatatagagatgatgcggggtaggattagaaggtagaaaacttagccatatatggctttagttttctggtctctattttttatttatttgaataggattccataccctatattttgtagtacaagaaatcatactatggcctgatttagttcctaactttttcttcaaaccttcaacttttctatcacatcaaaactttcctacacacacaaactttcaacttttcagtcacatcgttccaatttcaatcaaacttttaattttgacgtgacctaaacacaccctaggctagtttgagtctaccttctatctcctagatcaggcccactctcccttcatagccattaattatgcctgtcgggtgggtacccagatccatgatcgctacagggtcctgtgacttgcgaaattgcagtacaacctactagcaactggatcggttggttgctgtgttcgtttatcgcggtcattgcttcaaaatatcatataggtgtaggcactatataggtgccgaaagtgctaaaaccaaaacctatagtcatttttccatttttacgggttgaaatctcaaaaaaaaaaaaacctttaaacaattataggtgtcggttaaccgacacatattctataggtatcggtttttttttaaaaaaaagacacctttaatatattaatatattataggtgtcagttaattaaaaatcgacacctataatatacggttttaaaaaaaaagatacccgcagaaatcgagctgggccgacaatcgagccaagccagtttttttttattcttgtgacctcaaaggtgccgggcacctttaaatattcacatcagtgccgcctccgtggtgtcgcttgggaaaaccggcacctatgtggggttcccaaccggcactaatgtggttttatgtggcagtgagttgggaacggtttcctatggcatggaaaacggaacagttcattagtgcgattaattaagtataagtctaaaaatagaaaatagattaatataaatttttaaagtaactatctaccatatataaatacatatatgtatatatatatatatataaatacacatatatatatatatatatggtgtgctacctagttacgtaacacctctcacagagtctccttgcgtgtccctactaggcccagcccacccccgcctgcacccaccaaagtaatttttttactatgattagcaccgtctatttatatgtgtttctatccggcagtaaccatccaaccccttatccccgaaatttttggatcatccactcagccggcgaacgcctcaccctgccgtcaagatggccagaccagctgggatgcggtgaagaaggagcggctagtgcagtcagcacagctaggggtcgccaaactccacatcggagtggcgttagaggacctgccgttgagggggagccgccgtcatccgatcagatctggagccaccgtcgccatggctctccaccgcggaggcctaggcagccaaggacacgaggtgactgccaagctcctccaacgcctgccgcagcgccgtccacccctcccgccatcggcgatgttcatgaaggaaacgggatgtaacccgatccgctgggaccagcgccggtggcaccaggagagccgcgacaggtccggggcatcaggcatggcttcctcctccttgctcatcacggaccagcgctgtatcggtgagacctggcggctggaggctggccgtccctgtgctatgcgtggattccaggcagatttggcgctgatggctgacattgcctgcgcagggccacacctgctgctcgtcaatttcttccctatctacaagctgggtcctcaccaacacctgcgacacttctcatgttggtccctagctctgctctcctttatctcctctctttcaattgaaggggtgggtaccagcaaccttcttcttgccagtaaaacaaatagatttttcctcttcgattgtgcggtcttaatttgcaacagtatttttttattttatttttttttgcatttgctcattgattttgttgtagattgccggcacccaaagacagccgaggacttcctgaagctgagccccggccgcaaggttaatttttctctagacgcatcttgattggtatatgtattagtgttaatcctgagtaacatgaccacagaagaaataatctgcagctgtggttggtattcacactccactatgattgatggaactgatggtttgggtgttgctgatttgggagttggtgacattgaaacaaccactgattgcacaaacacatcaaatatatgtataagttttatgagtctattagtatatgttctttaggttatttttttttgtactagtcttgtatctgacattttgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatggagcttgagaccgtgtgttctgcatgcagagtactcgagcata

SEQ ID NO: 18213 - DNA, 714 bp, Oryza sativa
aattcctgcagccccgtagtctttcattttagtatctacatgtgtatatatatatctacgtacgtacgtacctgcatatactatacatacatgcgtgtgtatactccaacctagctagtatgagtgtgaagggagtatactatattatattatttgtgtgaataatgaagctctgcaggcatgctgagcatggctttgctggagctagctagcatatgtaaacatgtacctaaacggattgaaatcctctaacttattttcatctgcacttatgctcaaagtcagatagaaataaattagaggttcctcttccgtacctagacgcgatcatgcacatgtctctccctgcctgcaggctgcagcagatcgataggcaaattaaagtggtcagcgtaaacaaatattgtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttattgataagtataggtatgaatcaaattattataactaggtatatactcata

SEQ ID NO: 18214 - DNA, 513 bp, Oryza sativa
acgttgcattggcttacaaggattgcatataagttggatttagccgatggtaacaaagatttcaccgtttaatctaatatgtggattttatgacatcggacctccagccgatgtattctttaaccttcagatcaatacttgttctatcatatcattgttagccgattggtttctacttgattatattgctattttattacatcagtatcagccgagcgattgcctctatattgttatttacatcatgtcagaatctacattggatgtatagccgatagctcaaaaccctatcgatatcggctggactacttcatcggcttgtcagtcgatcggctcgatcagctcactggtcttgtcagttgtaggatcaaactgactggcacgcccgcacctcaccaagatttggacctgcactggagctaagcagatctcccaggccagtgtgtatttttcgcatcaacagctcgttaacacgaaatcaatccacggcgatctctgtgtttattgccgtcc

SEQ ID NO: 18215 - DNA, 5277 bp, Oryza sativa
ggtttcagatttaactttacgaaacattaatgcaggcatatagcatagcatcaacaattagtttgaagaaagtgcttggaggtttcacattggcgtactgtcattgccaatagtggagtaaatattttgtgacagttgaaatttgaagtacgctgtgttagtagtataagtaatatttagatattagagcttttagatggaacatatgttgggaacttccggtgggctacttttgatgttaattgatgctctatgttctgtcaagtcattgacacatgatattgtaatgtttcttatggtgttatacacaccggtctattataaagtagtaatcctattatgacttatgcactactatgaatttgtaatctttctagtatatacctgtcgagaagctattatattctattatgaatttgtaatcctactttggcttgttaagaagcttttattgggagataagttcagattgctgaaggaaacagtcttaacgagcttctacgaatcgagctcgagtcgagccgagccttgatcgagctcgaactgagcctaccttcaagctcgaaggtaatgctgggctcggctcgagcctgtaccgagctcgagcttaggtaggtaagctcgctcgagctcggctcgttgacagccctaataaggaccattttacatataaagagcaactatatttgtctactatcaaactctctatgattgttgaagaaaaacaaataatgtcacatatgctccaaatctcattgaattcctttcacaccctagaattttgttccatccttaatgatgactatctctctcgtgacctgatcttctggtaaggggataactctcgttttgatcgagtgcgatgtttgcgatgtggttatcaactagaataagtccagaaccatgtgcaatcgctacaccacaaacgttgtcataccaaccgtgacgcacagctaatgatccctgcaatgcaaatgagagaacactgtaaggacaaaataagatgcaatctaaatattgtgaataggtaattaagcgcaaaggagtagtaacgattgaagtggtagatctaatcgacccgacaaatcaacacaccaattattgggagctctaaatttgtagtcgttggctaatcgagcgaggcctagagaaaaggtgaatggcgcttggcaaaattcaactaaataaaaatcaattgttctagagggtgtacatagacacttatagaggaaaatagatctagggttaagtgttggttcgtagagatggagggagacacttccgaaataggcctaatctattacaaggctcaaggcccaaatacagtttcagtaacaatactatcttgtttggacgttttccattgactcgggatgaaatttgatatgagaccagatgcatttgaaaggtgacgacataagctcccaacaagtccaaaatttctcaaatcggagttggaatgaaggcgctaggtgtgtttgaagtcagtgttgcctcaaaggccgaactgaattcctaaactcattggacttgaatatattgtagatcctccattcgtccgatgtattctttggcaatgttttatatttctcatgtttggttgtatgcctatacttaatggtcacaacacttaatgagatgcatcaccatctttttcatctaatttcaccctcaactatcctcccacctctaaccgcccctcattttaatgaagtactctctctgttttgtattatgacagtttgacttttttatgttaaatttctttaattttgattaaattcatagaaaaatttagcaacacttacaacgccaaattagtttattaaatctaacattgaatatatttttatagcatacatgttttgtgttaaaaatgttaatatacctttttttttatataaacttggtcaaacttatttaagtttgaaatacatcttataatgttttcataagtttttttgtggggaatgttttcataagtttgactagagaaaagtgaaaatgtcatatactatgaaatgaagaaagtactttgtttccttcaccttactcttaaaaaaatacttagaaatactcaaatacagatggagagagttggtatgtagtattactcataagtcgtaagtagctatatgcgtggtatttttctccattttttcctctctctttttttcgtgtttaccacacctaacacggcaatagaacattaattggctcaaacacgtgaccaaagcactgcattccgcctatatataggtatccatgttcattttaacttatgccttcccaatatccatgtgtgtgcgtggctatgaaaactttattttaatatcactagatttgttgtgagaaatgctagctaccccaaatcataattacgttattatatagtaatgtaaagtaatgaaatatgcactggtggagaaaccgtttgtagtcccggttggtaaccccctttagtcccggttgtccaaccgggactacgaatccgggattaaagaaagctatctttagtcccgggtgaaataaccgggactaaagatcgagctgaccttttttttttgcatggccctgtttgctgcatggttgattatatatatatatatatatatatatatatatatatatatatatatatatatatatatatgtgtgtgtgtgtgtgtgtgtgtgtgtgtgtgtgtgtgtatgtgtatgtataaatcatatatattaacacaaaagcaaatgtgtacatatataaatatatatatacatgcatatatagtacaattcatttgctcggtagctatagctacgacttcgacttcgacgccggcgttatgtcagaagaggaaggaccgacgttatgaattgttgatgatccgtcgtagtagaattcaccgtcgggattaaggacttcttcgttgatgaatctcatcagttgttcttgaacagccatgataaaatccttgtgtgggagattatccctcatgtgaatacgctatcattcgaaaaataatgacgtatcaatatatgaaattaataaacaacttaacaaatcgatacgcaatgaacttttgaatggtttatgtatacgtacatcgagctctcgtgttgtgcatatttggtttgataggcagtgggcatactcgcatacgtagtagacgcataagttagttccctgttcctgctttgcacactacatgagaaacgaagagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatatgcagttgcaagctatgattaattaattattatctgagatcaacataatagcaatagattccccgcgactttggaatagatagcattatattacctgtctatcagtttgaagaccttgtcaaaaatcttctcctatttattcattgagtcgtacacagtgactctgcatgcatccaagtcgaagaattacaggacccagtggaatctggaatatgcgtgagatgagatatatctgatcgaaaatgtacatgctatatgtatgggaatgaaatttgttcgaacgacaataaaaactcactctgtgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggccctttgaatctccattctacaacgatgaaaggaaagtattattgcttacatatatgtcaggagctaattattgaacgaaacaaatcgaactcaaagatactcacaaaatccatgcgctcaggagagagacgtcgagggcgtccaactggtacagatcgaagagatctttgaaatggatccagagaacatcgtctccttgcaagaagtcggggtttctgatcctcgccccaaacatctctctaccgttggcgctcatttccatgtaccgttcatggaatttgtacatctgtgtcggtagggactccagctgttcaggtttgacaagcggtttaccgagttcaaacttgtatgccacttccgccttcgggattggtgcggctccaaccaactaatccacagatagaccggtgtctgcaatgaaatccgttatgccaaaatcttcaccggtcaccaacgactcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcctcttttcaggactctgaggcttgagttgcctcttcacctctcctgccacataagcatcaagctcctcttgactgcaatcgtatggtggctccttgtttttggtggcgtcaacttttgccttcttcgttgcccttgtgcgggcaggcggtggagcttggcgagaccttgtcttgggaggtgcaggcggacacggtggaggcggaggaggcggaggagccggaggagatggtgcagcaggaggtggcggaggagccggaggagatggcggagccggaggagatggtgcacgaaatgccacttgtcgcccaggaaggatgatgtaccgcttgcgccatagtatgatggcgtggcttgtgtctcgtagatgcgtctcaccgtcccctcctgggtagtccaactcgaggtcctcgtacgcggcttccactagctcaacttcgaccctcgagtatcctgctggaatcggcctgcagtggtaagtcccggaagggtccgttgggatggccattcccgatgccaccttcacgtgatgagaggttatctattagtaatcaacctaagcagcaacttgcggaatgtacaagtcaaaaatcatcaaactacgagcataccttgattgataagttcttgaagggaatatgcagctcacatggtgtccgctgcgtgatctcatcaacggggcaggaggtttcgtcctgggtttgcatggcgtctatgctctatgatccgacctgcccggttgaggcgcagctgctacgattgcctgatgggctgaccattacaggatgaatgtacggctggggatcttgggaccgatgtgcggccatacgttcatccaccttcc

SEQ ID NO: 18216 - DNA, 7643 bp, Oryza sativa
cggcagtggcgtgcagtggcggcggcgtcggggcgccgtgggccggcccggcggcgtgcgggcgcgccggcggcggcagcgtgggggcccggcggcgtgggggcgcggcggtggcgtcgggaccagcggcatgcgggcgcggcggcggcgtcgtggggcccagcggcgtgcgggctcggtggcggcgcgcggcggccgcggcatggcgtagcggcagcgtggcgagctcgaggcggtggcggccgagtggcgtagcggcggcgtggcgacctcgaggcggtggcggccgagtggcgcagtggcgacggtcggcgtggcgtcgcggaggcgtggcgtagcggcccggcagcgtggcgtggcggcgtggcgagctcgagggggggcggcgttcgtggcaatggcgacatcgtcggcggcggcggcggccgcgtcgatcgtcggccgtggagagagagagagatcgagatcgagatcgatagagatcgagagagagaggcagcggcggctctcacccaagaagtgcggcggcggcgtctgctgcggaggcggcgaggaccaccgagcgacagcgagaaacgacggcggtgtcggcgcgggattgccctaggcatggtggcggcgaaggacaaaccgagatcgaaaaatggttaagtgttggtggagaagatgagggcgtaaccggaatatatatacccccggatgtttagtctttagtcccggttgttgtcaacaaccgggagtaaagatatctttactccggttgttctcaccaaccgggactaaagatcttttcccgctatttccaaattctttttaaacccggttagggttaggaaccgggagtaaagataatagcagttctacatatgtgtttctataatagtaaataatgtattaaaattatttaaattcgaacaattaatgataaaaccttcgaaaaattattgttgtatgtagtagaatacgtggataatatataataagcacatgaatgatttaaaattgttaaaaattctaattaacatatgtaaatagcacatgcatgatttaaaattaatacaaaatctaatatcatatataactagcatatcatgatattaaattgttaaaaattctaattaacatatgtaaataccacatgcatgatttaaaacctttagaaattctaataatcatatatatgtagcatatggatgatttcaatttgactaaaattctaataatcatacataattaacaaaaaatctaataaccatatataactagcatatggatgatttcaatttgataaaaattctaataatcatacatattttacatatgccatacaacaattgattagtatagatattcggtacatccaacgtagtttacatcgtgtacagaacaattacggcaatacatcggcggtgacggttgaccggacgtactttctcctcactattgttccttccttgtgatcgctacgtgagtaaggggtgtcttcatttgataggaggatgctagggtcaattgtcatcgtgaaagggggttgcccatcaaactaatcgtaatcctagtcagtcttgtcctctactccgacgatttttctttttcccgggagaaccacgtggcgcttcgactcgtcagtcactttgcccttttttcctttgctagacatgttcttgatgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgtcagtcgtaccatcgtgtcccatggcatcgatacgaacagcactgttctggttcgtgctcttcatgtcttgggccctcgtgtagaatgtgtacccattgatttcatatccctggaatgtcgcgatcgagctagatggtcccctcgccaggaaggccagttgttggttaatcgtctcgttacccatgagatgttgtcgcagccacgtggagaaagtatcaatgtgatgccttgtaatccatgcatcggacttaccgatgtttttggcgcgaattagagccaagtgctcttcgatgtagggagccaccaatgaagattgttgcagaaccgtgaaatgggctttacggaataaattgttgtctaccgtcattattgctttccttccaaaagtcccctttccccgtagtctcccttcatggcgtgattcaggtaccccgattgggcgaagggcttcgataaattctacgcagaattcaatgacctcctatgttccataccccttggcaatgcttgcctctggacgagcacggttacgaacatacttcttcagaacgcccatgtacctctcgaaaggaaacatgttgtgtaggtacacaggaccgataataccgatcactttgacaaggtgacaaagcagatgcatcattatattgaaaaagaaggtggaaatatcaactcaaagctgacaagacattgcaccacatcattctgcagggcttctaatctatcaggatcgatgaccttctgcgaaattgtgttcatgaaagcacatagctttgttattgttgcccggacattatctgggaggataccccttattacaactggtagcagctgtgtcatcaacacgtgatagtcatgagactttagatttgtgaacttcttctccttcgtgcttattattcgctttatattcgtggagtatccagacggtaccttgatgctctccaagcattcaaacatacttcccttctctgccttgctaagagtgtagctggctggactcaagtaatggcttcctttctcctttggttccgggtgaaggtcaccgcgttgttccatatgcttcagatcattacgtgcttctagtgtatctttcgacttttcatatacacctaggaagccaagaaggtttacacaaagattcttagtgaggtgcatcacgtcgattgcgtggcggacgtccaagaattcccaatagggtaactcccaaaatatagagttcttttttcacatcgccgcgtgaccatcttcgctctctataggctggctgccaggcccctttccaaacactactttaagatctttaactatagcaaacactgttttcccgctgcgatgtttaggcttcgtacggtggtccgccttatgttcaaagtgcttgcctttcttccgtaccaggtggtttgctgcaaggaatcgaagatgacccatgtacacaaccttcctacagtgtttaagatacgtactttctgtttcatccatacagtgagtgcaagccttgtaccccttgttggactgcccggataggttgctaagtgcaggccaatcgttgatggttacgaacagcagcgctcgtaggttaaactcctcctatttgtcctcatcccacacggagacaccttccttcttccacaacagtttaaaatcttcgaccagtggtcttaggtacacatcgatgtcgttaccaggttgcttggggccttgaattataatcggcatcattatgtacttcctcttcatgcatagccatggggggaggttgtagatacacatcgtaacgggccaagtgctatggccgctgctcatctctccaaaaggattcatgccatccgtacttaaaccaaaccgtatgtttcgtgcgtcctttccaaagtctttaaattttctgtcgatgtttcgccactgcgaaccatcggcggggtgtctcagcatcccgtcctgttgacgctcttcagcgtgccaccgcatcattctagcgttccccttgttcttgaacaaacaccttagccgtggtattatagggaaataccacatcaccttagcaggaattctcttcttcgttagctgcctgtcaacttctcctgtatcatctcgtctaatcttgtatcgtagcgctttgcaaacagggcatgcttctaggttctcgcactcctcaccgcgatataggatacaatcattcggacatgcgtgaatcttctgaacttccagtcctagagggcacactatcttcttagcctcgtatgttgtctcgggcaacttgtttccctccggaagaatgttcttgacgagtttcaataaatcgccaaatgccttgtcactaacaccatttttttccttccattgcaagaactccagagtggtatccaactttttgtgcccctgctcgcaacctgggtacaacaacgttctgtggtcctctaacatcttgtccaatttatgggcccccttttcactttcgtaatcctccttggcgtcctgcaacatctgaccaagatcatccgcaacgttgttaccatcagcatccctttcctcctcgcccgtttgatttccttcaaatccagcgtactgagcaaagtccggaatattgtcgtcttccacttcatcttcttccatttcaacaccttactctccgtgggatgtccaacaattatagcttggcatgaaccccgactcaaacaagtgaaaatgaatagtcctggatgcagaatactccttctgattcttacacttattgcatggacaacaaataaaacccttttgcctgttagcttcggccactctcaaaaaataatgcacgccgtcaataaactctttggaccaccggtcagcgtacatccattgccgatccatctacatgacatgaaaaaaaatcgtacacacataattattcgtacaataatgacagtcatacaataattataaaataattacaaactctttcaacagtcacacaataatgacatatcattattcatacaaatattatgaaacattacaccgaataattatatatttactatttataaagttttaaactaatattaatgtgttgtacttattttaatttttcattttactttgttttctattattcaagattaactttcactatattttccttctcaacttttttataaaacattctttaccaaataaactaaatttctatatattctttcttctccacacaaattttctctctcatcaactaacaacaaaattttggagacaaaaaagtgtgcaaaacatagctccaaatgtaatatgaaaaaaaaatattggaggatgaagttgctaaccttttaggcacctccgatttgtatataatcaacacaataaattcactagaaattttggcatgacctcccctcttttttgaagaaattttgaagcttgctcgggctggaggaggaagaagacatatatataggggtgggactttagtcccggttggtgttaggaaccggggctaaagatcgccgggatctttattcccggttggtaacaccaaccgggactaaagttatgatctttagtcccggttggtgttattaaccgggactaaagatcccgggggggctgacaggccctgacagcatttgaaccgggacgtgttaccaaccgggactaaagatcaaatatgtctgttaccctttttaaccgggactaaagatcatctttagtcccggtttttgttgcaaccgggactattgtggaattagcccgaccgacgaaagatggtttctccaccagtgatgatagacatagttgtatctctaatattgaaaacagcctaaaacgagtagaggcggtacatcataattaccttttggtgttattttctcttacagctctatatgtttgcagaaaaacttacagaaaataacatttctgggtaaacagcatgaaccgacacttagttgagaatgggtggcgataggaatacataccaaaaaaagatgtggctcgaggttagttacagaagagaacttagggcgtcatttgctgccctccatagctaaaaactactcgagaggaccggaaggatgcatcatgcatggttgaagaactctcttgtgttgctttcaagttgcaacggtggggatgggtggggatggatcatcctgttcagtcacacatacattcatttcgttgtaatgggcgtgttttcatggggcagccctcactttttgcttgcatgaagtaccgacgctgtagcaagctgcaccgaacatatgcccaataggattatttaccgtcttttctcattaatattttcttcgactttatgcttctttgccgagtttgatcaatctatgtgcacaatgagctatacccaaatactgtcaaacagagcggcgggttgcaaaaaaaataaaacctttatttagtaccacaccaaattatatatttgcgacttacatatttaactttttccccacacgttaattataaattatatatgtacacaaaatgaatagccagctgctatatgtaaggtatactatcagtatttctttatgtgctgtctttggctactcctaaagggaacacagaagaaagaaagctaaagctgggccaaagcttagccaatattactgcatactcgtgagtcgtgaccgcacacaagttaattaatggacatatttgtgctgttctccttttttagattttttattttttatgagtgaatttaggagaattaatttcttagctttttgcttggcagagaatgggtggcaccaggaataatcttatcatgttggcatctcaaaaaatggcaacagtacagaacgtaccaacaaaatagtcctgtgtacgtcctacatcaaaattatagcaacaagagagtacggtgtagcaaaaacacagttgtgatattaccccttatggctatagggatcttatatatcccttcatactacataaagttatcacccactaactgtaattatgatcctaaagctcaaatatcaatgctccacatcatcgtcaattctcagccgttggataagtagattagatcggctctaaaccgttggatggaaaaccgcagcatatgatcagattaaacacaacccaacccatctcacacacagccaccatgtgagacccatgtatagcttcgaccacgggaagcccatctcattccatcgcagcccaatttaatagtgagggatatagggttcagtggggtctctgttggaaatttggtcataattcggcatatttttatccaaaatattaagaaaataaacatggcatttgcaatttgagtatatctagtgacagtggtggatgtaaataacttgagcatgcttaatataaaataagcatcaacatagatatgagaacgcaataacattgcgcctgacagtaacaggaaacgaagaatgaacagtaacagtaaaggattgtggcagtattgtctccgttggtattgacgggaacctccttctccttatctctagtgttgttgttgtctccggtgttcaacatgttgatgcagaggaagaacaagagcaggcgaagacgaacaagaacgaacagtaggagcagtcgcgcgcgtagcgctccccaaaaacttgatcgcccgcctacccgtgcaggttctcaagcggacggagttttggaagcatgtacacctgtgcatgcaggtgaacggaaccggagaagcagtagcagcacaagaacaaaggagtaggaggaacctgaagtgcaagagtctgcgggaagaactgatgaactgccatccctctgcggagtttgta

SEQ ID NO: 18217 - DNA, 25118 bp, Oryza sativa
  unsure (1)..(25118): unsure at all n locations
tcacaaatagaacttttatcatgattgcttcttagttcttacaatttccgcaacaacgcacgaggtatcatttagtcatcttgatattaaggatccataattttattgggcagatagacgaaaacttttactggcatgtgatacttaataaataattagcatgtgattaattgagtattaattatgataaatttagaaataaattatttgtaaagaaactttatatattttatcagaaaatacattgtttaatggtacagaaaatatgatctaccactctaaaagactccaatggtggtggtggaccaccactcactatcacatgggtccttgttgcagtgtaccaatcgtatgttcaaaattcaaacaactttagagtgatcaatacccaatatacttatgcataacttctaaattttacatgattctccaagatagcaagtgaccgtcccctccgtaaggaatgaggtctcttaaaaaggtaaatgggttattttttagataaaataaagttttccaactataatatctatattgattaggcacatagtcgaattaaaactgatgtatgtatcaactaacaactctaacatgtcctagtcaaaactcctacgatttagtctataagaagacacatatattttttcttatagctttgctgggtaaaattttgcacttagtcagcatagattttcaaaatatttccaaatatctgaaatttccaaatctcattgtcctcacaaaagaaaagaaagaaacaaagaaaaccaaccaagccaaggatcagccacagaagtgcaaattaacaggcgcgttggcgagagaccagacagaggctagaggggataacggtcgccgaactatcctccatccacgtggcactcacctattggtccacgaatcggcaccgctcatccattctctctctctcacctcttcgctcgccgccggccaccgtcatggccgccgccgccgcagcagcagcagcagccggaggcctcctgcacctgggggcttctcgcgtgccgtcgcggcggccctccgctggcgctgcgcctcgccttcgtggggcctcgtgcgcgcggggccgccagcctcggcggcgggcgccgccgccgctcgcggtggcggccgcggaggaggcgtacacgggcgccgaaacggagctcctcgatgctctcgccggggtccagggccgcgggcgaggcgtcgcgccgcgccagctcgaggcaagcatggagcgcactaggtgcttgttgaaatgcttgtgcggtgttgctgacatttcgagttgttacgtgtgcgcaggaggtggagagcgctgttcaggctctggaagcactgggaggtttgcccgatccggtgggtgcacggtgccttttcttttcatttgtattgtctgaattatactagtatttaactaggtaattgttgggtggctagagaatatagcagtagttaatattgaattaacgattttataaggcgaagattttaggtgaggtgcatgcatctcaatagttaacgatctgaatttaattgagaaacaagctgttttgcatcttgatcagtgcaaggtaagcttgagtttcttgctgaaataagttgaagctaaacagagaacttctggagtttgaatcgtaagattatatgataaatatgttacaagtgaagcttgccagttgccattgaagtgattcatagagcatagtagaaagtactttctgctgaacgagctagatggcatcttggacttacggtcagaaactccataaatgtgatgatgttagggtgttacttttacttactatgggaaagtatgttcttatcaaagtttgatatgattggcttatctacaaaattgaacatagctagtgctcccattatcatacatgtatttgacgtagctggaaagtttctatgcaacaaaggctgtcgtcttatctttcatggttcatatgcagaccaactcaagtctaattgaaggtagttggcagctcatatttactacaagaccagggtcggcatcccccattcaggtaaaataccagcagtatgccccactgaaaataatgttcagtctcccatttatctctattattttttggattttcaggccgaccgcatatagataaatgactgattttattcttcattcacattgcctgcagagaacatttgttggagttgactctttcaagatctttcaggaagtataccttagaacagatgatcccagggtgattaatgtagtgaagttttcagaatcaattggtgaactgaaagtagaggtattgattagcctacagtaaacttgcaagagatacactactaggaatgattgaatcaatagtatgacaaaaagagacacatgattagcaaacagaaattctgttgaccactcctgtttgttaatgttgtgcccatggattaacctagccagcacacagcgccagcaactcatcagattgtgccatgactggtctggaacaaagctattggcatgaaccgtgcatgaacagagtccaattcaataataaagtcctcttagtctacatttagcatgactcgtgcagtgcctctggttgtctcgttggttgttcaagtgtggatatgtttgcaggtagagtcttagttgcattacttggggcttgtttgtttgctaccttcaatctgcctgaggattgttttggttggtaccctgagatcctccctgaccaggcaacttcatctaacttccatgaagatcctccgttgcatcacctccatggacaagaaaaacctcacccaatttcagattctcgcaagagcactgctatctcactggtcttcttcgccagcactgaccacacattgctaccctgtcccgaagcacctccacctcagccatctttactgggaagttcgacaggtcacactgatccctgttcaccctttccttgatacctgccaatgagttgtctctgtcaccagtgttctgtctcagccgctgcgtgtaaccagtgaagtgtcaccatgcacctctgggagaagaccatcacactacaggatgcccaacatactgttgcatcctataggaatctgcctacatttgcgaaagggcatgtagcctaatggttgcagtgacctaagtagcaccccaagatcctgggttcaaatatccataggagtgaatttcagattgagttgtttgcggggctaagttcccaatttaaatggctgcatatatccggatggatgtagaggctaggtaaaatattacccttctctaaaaaaaataaaaaaaaaacatactgttgcattcctcttgttagggatacacttagataaatagagtgggtcatcatcagtaacaagttcttccaactagatatctatagcacactctctatttctctagtgatcctctaattgcctattgcttccccattttatagtgtgccctcctccagctccatttcttctcaagccatttaatttatcatctaataaatagtagttatcttgtcgggaacaaaaatcctgacgaccttaagactgatagttctggagggctgggcattatattgaagaacaatatattgtacattgctccgactacttggtaaagccgaaatcagaaacatcattggcatttttatcttttgggagacttcattgtttaattaatccattccatagtaaacatggaataagttggtaagagcagtctcttacactcctaaagagagttgacagaacagtgtgcttattctgtatgaagggggataaatacttctactagtcaactaacttcgattactgctagttgctaaatttatagtgcttttacaatgttctacatgactttatgatgagatttatttaaaatataccaggcagaagcaactattgaagacggaaagcgcattctttttcgttttgaccgagcagcattcaacttcaagtttttgccatttaaggttccatacccagtgccattcaagcttcttggagatgaggcaaagggttggcttgacactacgtacttgtctcaaactgggaatatacgtatttcaaggggaaacaaggtacatgctacatagtcttgatgttattttactgcctaacttgcagtaaggttttcacaactgaaaccatgcagcaacgcatttaaaattttgaattgtataattgattttctctttttttatgaatctacagtacagaaaattgtaatatctttatagtttgtagaaatctttgctttttcccaaacctgtttgtacttcattagcttttcaaaacaatctgtagtgcagggaaccacatttgttctccagaaaagtgcagaccaacggcaattgctgttgtcagctatatctgcaggaacaggagtaaaagaggtatgttattatagcttgaattgtccattgtggcagtactttgagtatttgacaaagtggtatttacaacatatttgcttgctaaaaaggctatagatgatctcacttcaagcagacaaggaattgaagctgatctgaacactctagcgggagaatggcagctattatggtcctcaaaggttagcatttacattttcataaacaactccaagcaatatttcatatttctaatgtctatgcatcatttggcaatattgtttttgagcaatggttggttatattgtgaaatatttgacgtgcgaatcaaccacatggcagtactagatcagacctgcgcaactaaccatgttttatgtatatttgttcttctttccctgtaatttatcttgcacaagttctgatgccaaccacctgggctttaatcgttcaggcaggcatctcacagttctatattttgcttagtattatttatattaggtttactatcaactgttttatataaaatctgactgggagaagtatttctctatggaaaggaaattaggactcttggcagcatcaaacaaaacagatccttttctggtttgtgaaaggacttgacagctgctgcaaatgtaatgagaaatggttattcctgcatacaccttcaagcgttactaaaatagaataccacagcgtgccacgaagatgaaatttttcatccaattcctatagcagaaacgaacgggacctataaccaaatttgtatgcgcagactgaagatgaaagctggtcatttgttgcatctgctggtctgaagggtgtccaggttagtttcagaaccacctctgaaggatttgtctgaagactgagcaaaaagatgaaatgtcactctggttttttacttgcacacgatatggcttacaaatgatatgggcttttcaatcagatcataaaagaagatgggcaattgaagaatttggtaagaccctttccaggtgtcagcctcaatgcaagtggcaacatatggtaagctcgaagagctgtatgaatgctgtacttcctgtttgggagagtttacagctttgaagaccttttttttttttttttgaggaaacaagaccatatatattagaacacagtttgttaccacctacttatctacatataaaaatccacattacactcttgaaattgtaaattttgatcatataccctctccttggattgaacttgaggattcaccctcctgacccacatgtgaccttaaatgaccccacatgtcattggctcaagagggtaaatcctcaatttccaatctaaatttaacttccttgaaatttcctattggatcttgattgttatctttattacaatactactacaactaccaaattgactgttcatgtggtgttttgttcaataccgagcttgcgagctaagtattttctttattaaacttgcagtaaaaatgaggatggcaataactttaacttgtccataaataaaggagctattcaagctggtgggttacagtttcccttggatgctcgaggagaatttgccatggaaatattgtaagtttgggttcacattccaacaactgaaacagaattgatgcttgtctgatatttgtgaaatttcatgcaggtatattgacaataagataaggatatctaatattaaccaacacaagcttgtccatgtacgcattgcaaatagaacataaaactaaaatgtagggatctatgaagaaatcgcttgacttcatcactgagaatctttggagacttcatcactgagaatctttggattcaatgatcagatgatgtacacgttgtagttgaccgctaccagtacaatagtaagattcctgtaattatagattcgcatgaggtttgcagatgctcaatccttttctccaatgatacaacattacacatgttttggtgatagaccatgataatacatattataagaataaggttctgcatttctgattttggaaacctttgcttgcaattggcttggacgttcactcagttctttatataaatatcaactgatttaattaagaatttgataagggtagcagctgcctgtgctcattaatcagtcaacaaaaaccatgaggaaactgttgagaatgcttatatcgtaacaagagattgttcagaacctacaagcaaattaagttcatgtgtacacaggagtgcattcaggcataagaaaacgtccacagtatacaaatatacaggtggatgcgtgacaagaaaatcgcagattccagattgaccaaaaaagcttgattacttctgcatcagcaacaatgattgtagtgtactcaactaatattaatattccaaataaactaactgaattgggtggtacaaatagtttcttcctagctctaaaaatacaacaatgaccctgtgtaaaaaatgttacatggtacagtttcctccattattgatcaacttttggttctatcgttttgttcaagaacaaagcagttcttggtagcaagttgagtttggaggcagatgttgatcggcgggtgacaaaacgtccagggaatttgccagtataaagttaatctgtggatgaacgagaccacagtagcaaggattttatcacaattgtttatgcagaggccaaactatcacataatgtttggtatgctgcactgcagtgcttgaatttctcctctgcagtagcctgtccatttaaggaaaatcatgagttacataaacaaataggtgtaacagtataagtgattctggtagttttaagatataagctcaaaacatcaaaaaagacaatattccattgccaagaactgcatctgttcgttcaaacaataatttcataccatgccttctattgaatcagatacaggtacgttcagagaaagaaaaaaaaaaagaaaggaagatggtggaaactggtaaacttgtctctgtgtgagctaataaccaatccttcatatgaaggttggagatgcaaatgaaatactgaagatataggggattttggtccgcaatttccattccagcaatttatataatcatatccaattatcttgtgtgaactcgagatacttgtggcaagactatctaaacaagtgtattattcaccgaacagcctggcatacaaaaaacatgcaaagagaaaaatagaataaagtcagatgtgacaagttcaccttcgttgagccattgtgacgatctgggtgccatctaagtgcacatgtccggtatctagtatgaaaacaaacaaaaataaataaaggataaaataatcttgaaaaggaaaataagtgaaatctactaaggttcatggcttcatggtctaatatcacaaaaaaacacataaatcttggaaaatgttgaaagcttgaaagatcttacgcgcttttaacatcttcgagtttcagtggaccagaagtactcaatccaagtgcctgccgtgccaaagatacctccgtctgtgcgggtgtttcatcctcatcatctgtctcataactccaacgtctggaactttctgaatgagaacgtctgtgatttctctgacaaaaatcatcagaatcaaaagaccaataaaatgtctgttgcccacggaaagcattgcgaaacaccgtttccggttcatcttcatcacttgtgcaaaactcaaatccacctgttctcgaaacaagaaacaacaaaattctataaggttcaccttatgcattatgcatgtgtcatatccagctaaaatatttcttgtaactgaaatatttataacataagcagactacattaaaaatatgtgaattctgaaaatagaagtgctaaacaggacaataatttgctaataagatagagaaaatgaatgaagtaatgtacccctgcttctgaagtttccaaaataaaaatcatgtgggcggaaaccattattctttggattcctgacccaacggtgtcccctgaaccaagaaggtccacttgattcatcatttttgtcatcttcatcccgccaactctgaaaattaatataaataaatttgtggtcaagagcattctacatcagcatttaattatgggaatcaattggattaaaaaactgtaaccaacattacagtaagaacaaagtgaaaaggaaaattgcattaaaggctgaagaaaaaggtctattttacagcaaaacaaaagaccaaaggtagtggagacttgtactaaatgggctgccatgacagctgaaaatatgtgttgtctgttaatgtggcaaaaacaactagcagctatggatgagaaatgatggttttataacagtttaatgtaataaaatgcttttgtagttcagactttgcaatagttaaatgttgtaaggtagacttttccaaagctgaaatggtgcgacttatggtgacagaaccacagaaaaatacaagtaaccaattcagttcttataatccttaattccttccaaaatgccaagggaagaaaaacagaagttctataccattatctgattttttttttcaatcctgcgtgccacgactgtgtttttaatggcaccaatcctagagttgcgacagtcttgcaagtgatagaaaattagggtaatctttggtgtattgcaggagctttttcccttcaaaagctccttagtgggacggcaaacctgggcagctaagctctccgggtggtcttgggtgtgtgggtctcggtaggagggctcgggtcctcctactttgtaaatatctttgtttttgttttttcttccccttaatgaaatgaaatgcagctctcctgcattttcgagaaaaaaaaatcctgcgtgccacataaagcttagtctaaactgtagagtgttaacataaaaaccttatccactgtaatcttcttcataacatccaaacaatattgcagggtttcacatggcacttatattgttcttatgctttccagaaccatttctttagactttagctttgtttctgtattacgtaagatggaattaaaaaatcagataatggtaataatggtataggacttctgataacaaaggatagtaataatgtgttgatccaaatttagtaaccacaagaccagtagatttagaggatttgtgatggctaaaagtcctcatctatttacttcagttacaccgaaaagaaaattcaaagctaaaagatgtgtcaaaattttaattatattgacctggaagaggtactcagcatattcagacatattccgtagcatggtcctttttgattctctatttctcctgcgcttctcataataactgaacctctgtgggggagcaaaagaaaaaaatgttagctctattcatcacatgaactactttgcaacaaaaaacaataatcccttgtcaattgttgctactttaaacatcgaacataacaaagggatagaggatagtaaaacttaaagcatgattacgtgatgaccagacaaactgaaacaagcaaactaaaaatagaatcaaggaaaaccaatcattttaataagcacaacagaaaattaaccacgctcgagcctctgcaatcaagtacaattagctaacaaagtcagcaaattactacctccgtttcatattataagactttctagcattgtccgcattcatatatatgttaatgaatctagacatatatgtgtgcctagattcattagcatctatatgaatatgggcaatgctagaaagtcttataacctgaaacggagggagtatcatattacaaaatgtacaaagtgcagatcgcaatatcaatgttctaaaaggtagtgcgatgttttgtttcaggcattccactttatagcgctcatgcggtaccttaggggtggtactaggtcaggacaaccgttccttcaatctatgcaaccttgtagaccatttttctaagaacactgagcaatacacaaaacagcctaacaatttacccatgggaacacacacgagcactgacaataaattcctcaattttcgcatgcattatcccctgcatgtcagttataacgagaatcaaattcaaacgccaatcagttccacatccaaaacccatcccagcagatgaaacgcaggagctacacagcgcgagctcacagatctcctcgcgcaaaaattcatcacgagcgcacgagaaataaaacgactgaattcgcaaggcttcccccacccccccaatacacacaggcgtttcatcgaacaccttaccgaccaacccaacccacaccttccggcagatcaaaacaaaaaagggagcaatctttttttcctcaacggagacgaggatccgctaacaaacacaacagagagaggggagggaggaaagaaggcggattacgtggtgccactgcgtcttgcgcttccgctggaggggaggggtggagtggaacgaggcggcggcggcggcggaggcggcgaggtggtgcgggccgcggtggccggagaggagagccgatttgacgtgggtgatcatcgcggcgggccggcggacggcgtcggcggcggcggcggcggcggcggtggcggcgagcggcgtttacctcctcatggggcaaaaggccgccggcgatggcgggggacctcgcgaggtgttgtggtggtggcgctccgtgagaggaggaacgtgcatgcttggaatggtcgctggtaactgggcccccagcccaaacgagccctacggcagggtaaggcccagtttgatttgcatcactgagcaaattattaccaaggattatctactctattataataaattaaaaggtaaatattagtttggagtaccctttaatgaatgttttttttacttttgaaccgggtaaatttaactttgtggtactttataccacatttaactattttatccatatgcatcaactcgttatatgttaagtcaattgtttaagtatagctgtgggagttcatcgatgagtaggagccgatctacttgaaattgtttatatgcttgataaaagagtcaggtagtccaaagtggaacaaaggtgagattattcgattctaaataaaaacaatggttaaagggttgatccaaagtaaaacactagtaataaaaggtgatccaaagtgaaatttactttaaatatttatctaagagataatttgttttattccacaaagtatatacacgcacacaccattacacgcgtaacatcacattcacgcacccacagatatgcccctaacacacgctcgaagagatggaaaccaacggtatattcttggtcttattaaaattctgttgaaagttccatatacatatgtgtgattaatttgaacggagagagtatataaacttaattttgtaaaaggatagacctttgtagcaccatatctttaaaaagggacgatatattatgtcatgttcgtttcatctagctgcggccagcggccgcggccgctagttagcagacacaatactcacaaggctcaaatgactcagagagaagtaacgcaagggcacacaagtttgcaataggaataatagccctctcaaggggagaggtgaggctatttatagccacagcacaaattctgtccgttagagcacaataaaagtgattttcagaactttcgaaaatcattttcggaactttcaaaaatttcagatctgagaaaaacagagtcaatgcaatttttcggaacttccgaaaagtactttcagatatttctgaaaatatccaaaacccaaaataccttatatagatttttggaacttccgaaaaatattttcagaagcttccgaaaatttccaggagcatatttggctcgcagacattttcgggaacttccgaaaatttcctgaaggttgaaatttattctgtgtatttttggaatttccaaaaatgcttttcgggacatccgaaaatttacagaacacaccaaacaaagaaatgcttccaagaaaaatagattttgagcacacgcatcactccttatatgtctatgcatcatccccctaatagtatggctttcctataacacaatgcaaggtaaaatatgcaatataccatttgatcattgtcgtattacgtcctgatatcgcattcaatggggtatgcatcacattacaacacgtcgaggacatatctaccttcacatttacttgaatagaaaagttagtcctccctaatcgaattgtaattaatcatcaaaatcatttggtgcctatatgcactttcaatctcacccttttttgtgctttatagcaatacaattagattacaagagagaatgaatataatagatgattttggtgcaaaggtttagtgaaagctctccctagaagtgtgcattaaagaaagtggagagctccccctaaatctttgcatccacatttaagctcaagagatacaaatcatttcatagcacatacatctcatttcatgactcattcatcacatgcacaatataagaaggaaataagaacatttgcaccatatgaatataacacataattgtcattacatctcacacatccataattaaacaataaagtcttataatatggcaataacttaaaatccacacatagtctcataaaaaaagccaaccatgttcgactaagatagctaaagctaaataagatagataggtattctctccctttggcatcgaagcaccaaaaaggaaggatgacgagacaaagactcaagcgaagggcgcctgaggaggatcctctagaggaggatagccatagccatggccaaaaccaaagaaatcatagtctgaaggtatcccagcaaaaggatcctcgatctcttcctctcaggctcatcgggctcggcctcaaagcccggtggggagggagggacatccacgtgaaaatgctcattgagttgtgcctgtatgttcttgatgcgccgagctgtcttcttgatcccattccgcattctgcggttctttttggcctctgcggcgcaaaggtcaaagagacttcgcagaatgcggaataagggagacggctcacgacgagccataggagagggacgctcacgagtgggaggaggctgagtggaaccccgaggaacacgtgccacctgagggccggtctcctcttccccttccccggaccaagcatggtccgagtcctccgcggaggatggagaaggagtgggagaccgatcccgagcgcgttcggacttgtgagtgagggacttgcgtgcaggcatcctaagtcaagaaaaagaatgacaataagaataaggagactaatgagatgaaatacaagcaatttgagacaagaatcatgcgaaaccaaggttggagggttcagacatgaattttcggaacttccgaaaataattccgaaaattttcggaagtttccgaaaatgcctagccgaacactacaactcagatcccgcacaaatcctccaacaaaaagttgtgaaattgaatctacaagtcttatggcactagaggaacaactccaccgaaggaaatcacaagatttaactcgaggggatttgattttgagatagatacctcaagaacacgaagaacacgtgaagagctcggtgaagaacgacaatctagcctccaagaagtgccccaaacttgctcccacgaggatggagtgaagaggagcgccagggagccaccagagaggagttggtcgctggagaggagcggagtcgcagaggaatctgtaggaaaaggagtgaaaagagagagaaaaagaacccacggattggaagaagattttatacccccgagatttttcggaagtatccgaaaattttcggatgtaccgttttcaacctctaaaaaaagaaaaacgttttggcattctctgtactttggctgtcacgcacgcacgcgtgggcgcgtagcaaagcaaagcagcgaatccggcttcactagtcttcttcccccccgccgccgcatcgatcccccttcccctcgtcttccttccctttcccccaatcagattgcttccagaagcctccttccccgcgaagcaaccaaccccttccggatcccgactccatccaaacccccatcccctcccctctcccctacgctcgaaaccctagggagatccatccacatgccgccccgatgaggtcgctccgccgcgtcctcctccagctcgtgctcctcgccggcgtcgccttccgcggggtccgcttcgacgacgccgccgacgccgccgccgccgcccaggggtcgtcagacctcttcgagctcccttcgccgtccccgactctcgcgctccccggcggcggggatgagggggcctcgacggagatcatcgccgcgccgtggccggggcgccacggcctgttcacgccgccgcggagcacgtcccagccggcgagagcggtggtccagccggccgccgacttcgggtgagcttcttggtccccctccctccgtcttcttccagttgcgatgctgttcaggaggaggctatggagtctataggaggtggatcgattggcttgtgcagcgggacagggtggggggggggggggctttgcctcctgttcttatccttggcttttggaggagcgaaatggattcccatcccgccaagtgttaaagagggtttcttgtagttagggaggcttgctatgttcctttgtcactttcttgctttcgtgctgcaatggagtggggaaatgcggggaaaagagagctctctagctgcttaggtcatgcatgatccatggttggaacagcatcttcttgctgctttggtagttctcactagcattagtaatgacatgactttgcttgattgcattgcacttcaattttagtattagttacgaattaatttatggaaatgagcagcttttgcacttactattcctagtataagaggtgctacttatgattcaaattgagctgtttggttcatttcttatgtgtgtactttccattttgtcccgccatttgaaattgcaacttatttgcttgtttttattgtgaacagctcccaactccagttttacgacaatggtacaattcaactagtggaccttctatcaaaattgcctcggtggcagttctccaccggaccccctctttcgaagcatatcactacttcgaaacctgatttgaactatgtcatataccttgatgggtcagaaacatcggaccttatagaagttcataatggcagtggtgtggtatgctttgcacaattgcgttagttctcaacatcctgtctagttttgctttgtttctcacctatcactggcttattcctgtagagacttccctggaaactggaggagtttattgctgagactccatatatacgggattcttttgttacgattggatcaaaggtttcaactacttttgtggtcaatgctgatagcggtgagatcatttacaagcatagcttgccagtggccttgaacgaggtaggtggccccctggttgaggaaattccatccaagttagatgctgctagaagtggtacaagtgctaatatcatagtggttgtgagaactgattattctatcagtgcatcggatcttggggaacatttgttcaactggacaagaacttccttcactgcaaattactatgcgaggtatggccaccaagacatgcttgcccaatcgtcctgtctgcgaggaaatattccatgcattaggactgagggtccaccaattaaactttatttacctgattcaagttcagataatgcaattgtcttgagacctgtgaacgaagtttctgctgtggatgctctggaaccacttctacctccaaagaagttaccacaacctgctggcgagtctaatgtggccttggatagtgctcaaaaccagactgctgacattgccctaggtcattttgtgcctgctgacactgaattgaccaacagtgtcactaaattttcttacagatggctattccccacgtttctcatgttgttgatcatggcttgtctagtgaaattggccgatgcaagcaaatattgcaggcaatttgtgattcgatttttgaagccatttatgcgtgatgagaaattgatggacccaagaggcaaatcagagggaacatcaaaaagaaggaaggcgcggaagaaagatggacttatcaatagcactcagatcttttcagcatctgataaagaggggaatggaactggtggatcaactgaggcacaaagtaataaagcacatgattcaacaaatgtggaactccctaatggcctcaatgggcgtcagattggtaagctttgtgtttacagtaaagaaattggtaaagggagcaatggtacagttgtctttgaaggctcctatggtggtcgggaagttgctgtgaaacgtctgctgcgctctcacaatgatatagcctcgaaagagattgagaatctgattgcatctgatcaggatcctaatattgttcgaatgtatggttttgagcaggacaatgattttgtttatatctcccttgagaggtgtcgctgcagcttggctgatctaatccaactgcactcggtaccaccattttcaaatactaagggaacagacattgaactttggaggcaggatggacttccttcggcacaacttctaaagctgatgaggtatgtgacaactggtcactggtgccctttcatgttgcacaccatgtttatcagtatatgcatgtgttgtttactttgagattaattgactaaggtcacgcttatgcatagcttaacttgatgcccttttgctaagaacactttgccaacaaccaacatccaccatttgctattacaaagttccttaatggctgatattatttgcctgcctattcttggtattgttgctagcgtgtccaccagaccaccactgatgttgcccttgtgaattttcatgtgcagagatgttgttgctggtattgtgcatttgcatagtttgggaattatacatcgtgatttgaagcctcagaatgttttgataagcaaggaaggacctctcagagcaaaactttcagatatgggtatcagtaagcgtttgcaggaggatatgacttctgttagtcatcatggcactggtaaggttcaaagttgcttgcgaatatgcaatatgagaaattactttctgtatcttttttatggtcaaggtcaactttcttaagtgcattttttagtcattgcgatgctctctctctctctctctaactagccatttcatccctgtcaacttactgcaggatttggaagctctggttggcaagcacctgaacagcttcgtcatggtcgtcagactcgagccatagatttatttagtttgggctgccttatattctattgcattactaaaggcaagcatccgtttggtgagtactatgaacgggacatgaaaatcataaacaatcaatttgatctcttcatagtggatcacataccagaagcagtgcatcttatttctcaactgttagatccagatccagagaagaggtaagaataatttggtattttgacatcgttaatgccctgaacatttaaaaaggcttcctgattttctgaatgcatttttttattaatgttaacagaccaacggccgtgtatgtgatgcatcatcctttcttttggagccctgagttgtgcctttcatttctacgagataccagtgacagaattgagaaaaccagtgaaactgatctcatagatgctttggaaggcataaatgttgaagcatttggtaaaaattggggagagaaattagatgctgccctgcttgcagacatgggacgttatagaaaatatagttttgagtccactcgtgaccttctaagattgatcagaaacaaatcaggacattacagagaattttcagatgatctcaaggtctgttgctgcatttcttgttttgtttgctttgttttagttttcctgcatacagctaaactatgggtcaaacaagaggtggtgctgtagtatgcatgaatgctgttgtgtgttcaatggatgttcatattagttgctgtgcatgaatgtagtatataggaaaagtagttagttgcagtcatgaatgttatattagttgcttctgtattatcttagatagtttcttagtttacttcttttatgtaaggttcaactaaactatgtagtgtgctagtttgtgatgattttgattctacagtcttatcttcctcacaagggtgggcactactgctgacctcctcctaggagttaggatatatctctgccttttcggttttctggagaatattaaaagtttgagatactattttatacattttcagttttctgaagaatattatcaagtttgagatactacttacagattgtgaccatgcaatcatcatcccagacgctaacatattcatgttaataaaattccaggagctacttgggtcgctgccggagggatttgttcagtatttctcaagccgattcccaaagctgctaattaaagtctacgaggtcatgtccgagcattgcaaggacgaagaagctttcagcaaatatttccttggaagctcggcgtagctgtaacctgcaggaggggtgaaggccctgccctgcctagtgtgtacactaacactcttctagcaaaaatgtatgtacatgtgatttgtaccatatatcatagggtaaagaaagttcagcctgtacattgtattccacagaattgtgtattacttatagtaaatcaaatcttttacctgactatatggactgcattatcaaggtttttttttttttcaattttgtttcgtcttgtgattgtgtgctgttagtccccttgagttgttccagaagatgaattcatcctattcatgtacggagtacatttgcaagatttgattccgttgttagattcgtttagacaggtgagttcggcttgttaaaaatcatgagttggtctatgtcagattgtcagcatgcaacatctctagaactggtgtaattagaacaactggtgtcatatctttttgttttctcgttctccttccgtatgttccatcatgtgcgggtaaccatagtatctgtcacgtcctgataaattcatcctgaaataaaaatcattccctaaaaggaataatagaattaattaaaattcgaaaagaaattggcaaacattaaaatgcgtacaagaaaattttgaatgtggtccagagaatttttgttaaattctctttggtctaaaaggagccctcaaattttacttgaattttcagagcaccggaaataattattaagcaacaacaaccttgatcaatgtttattaaaaagaaaaagctaaaaataaatcctccttcctcctttgggccaagcccagcccaaagtctccctctcctccctctctttccttcctcctcccggcccacctcttccctccccctcccagcccagctccctcccctcccctctctctcccgggcctgcctctccctcctctcctcctaggccgcctccgggcccaagccgagcggtgccctcccgcccgtgccgcgcatgtgcgtgcgctgaccgcgcgcctggccgcgtgggtcccacacgccgggtcgtcgtcctcctcccgcccagcctccttcctctctctctctctcccgtgcaaaccctagcgccaaacctccccaaaatccaagcgattcaaaccggggtttccaaaattgattaggggttttaatccccattgattcctctctctttcccccatattttccccttgattcatggccccaatcgtcgggaacgcccgcgccaaccccgggcaccttccatggccgccggccacgaattccgccgccgttccccgtctctcccgtggccggctccctcccctctcctataaaacggaatctcctcgctccgttctatcgttttagccccttctcgagctcccccacggccacaccacctctccccgccttcccttctctctctccggcgccggccgatctccagccgcccctgccgccgcgtcggcacgccggccggccgtgccgtcacctctcccggcgtcgcagctgcctcctcttccccggcttcgcccccgtttcgcggggaaatcatcggagacacgtcctcgccggcaaaacagtggcgttgccgccactgtacctccttcagtcgcctcggtcgccgcgccagagcgtcggccgacgtcgccgtctccttcgtcgacgtcgcagcatcgtcctctcctccggctgctcctctgtttcgctagaacaccgccgtgccacgccggcctctccatccgcctcgccggaatttccccggtcggcccttcctccacccgtgcgccgtcggccgcgccaccaccacctccggcatcgcagcagcaaggtcgccctcggcctcgcctccccttcgaccgaaccccgccggtgttcgtcgtcgtcgtcatcgttcctcctcgccggctcgtcgtctcgcggcgccgcctccgtcgtcggattcgcagcggcgtgttccacaccgtcctcgtctccgtgcagccgctgccggctgccctcgttgcctcctcgccggtcccggtcgtcgtcctcatcgtcgtggcgttcgtccctccgtcaagccgttctcgtccgtcgtccgcgtccgtcaagtgtgccgctgcagccccgtcgtcgtcttcgtcctcgcctccgcgtcgccaagcgttgcgtcggccgcgtctcgccttcgtccaaggatcgccgctgaagtcgtcccctcgcctttcgtctccatcgttcctggccgtctccgccgcgcccgttcgtcgttgtcgttccctcgcctcgtcgcgtggtggtaaggatctctccttcgctgccccgtcctcgtcctttcggtgtcgcccgtgcccgttgtgcggttgtcgaccccggtactcgtgtaccagtgtcggtagtcgttcgcttgtgcgtgtggtgaccgtgttagtgtgcccgctcggtagccgcgtggtttccacgtgtgcaggccgtgtggtgtctagtggagtccgtttgtcggccactcgcctcggttgagacacggggtccgcttccgtcgacctgtggaccgtctctgtgtacccggtctgccgtggtcccttaggttgacatgtggggtccgcatgtcaacagcgcagccttcctgtcttttccaggctagcgcttacacatgttttataattgcaaaacctaatcacaataattcataaatctccatgtaacagcattaaacttcagatgatcatatcttggtcatacgaactctgaatcgacccgttcaagtctcctaatgtttgttataacctaaagaaccatgtgctttcatttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttgtaaaattattttgatttaaattaatgcattatcgctttatttaaattcccgcgttatcactgttttatttagccatgcctatttatctttgttatgaacttatcattgttgttattgttattattaccttgttcaccctaggataaacaaaaccccaactagtgagtactctatttatggttccactagtacgaacttaggtagatgcttcgctggttaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggttctataaggattaagctcgggcctctgttgcaaagcactactgtacttgcacatgtctagtgggtaaggcttagtttgtggctcagtctagttataaacaaaggtacacggatggagatggacgaagtcgggggtcgatggacatctctaggacaaatgaaggctacacgagctgtggcccggtagtcgagatgtcatggcacagggctggtgtcctgctgctagggactcaatcctgcctgcctgtcccggaggttccggccgtaggcggggctgggtcgatactcttgtttatggctaggatgggttggaactatgtcacgtcttccgtccgtatgccgtggtggtatgtggcacgtggttacacgtgaggaagatgtgtcttgtgggtaaagatgtacacctctgatcagagtaaatctattcgaatagccgcgccctcggttatgggcaagcctagcaatgtacccaatttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtcagggttcacggctttgattaataacactatgtagctctaggatcgtctttacaaagtagctttgggcaactaagtgacttttaaatgctgtttactgcaaaacttaacccctatattattaccccttgtacctccttgcattaatcatgtatctgccagtgtggcttgctgagtactgtggttgtactcattcttgcttaatctttccccccttcaataagagaagctttggagaagaagtattaggtggagtcctggcttataccccagttgagcgctgtcacaccccgaagttctcctcccaagcctaaaatttaatttataagagaccctaagaaaataccggtgcaaagcaagagtaaacccttttaaatcaatgcaaataataatcggagtgggcatgtggaatttttcttgagttctacatgtcgaaattcactaacaggatttttagtggaattttcagagcgctcgaaataattttacccaattaaaattgagcaagcaatattttaattccagggaaaattcttttctcctttttctttttctttttcccttccttttccgaatgggccgctggcccattctctcctttcctccccctcctccctgctgggccggccacaggccgaggcccagctaggccgccccgccgccctcctctcccagggtctccgacaagtggggcccacctgtcgggtccttccccaacctcccgtcgctcccgccgcgccgccgcgcccgcaaccgcagccgcgcccacgtctccgcctcctccgggccacgtcgaccacgcccgcgcgtgcgccgcgttccccgcgcccactcccctctctctctcgctcgcgcccgcgcccgagatggccgggattcgattttcgaatcccgtctctctctcctcccccacttcccccacgttggccggcgaaatcctgcctctcccggccacgtccggccccctctctccctatttaagctctgccatcgccccttctcgctttttccccatttcgccgaactctcccgagctccccatcgctcccgcgccgtgcaaccacccgccgccgccgtttccgctactccggccgccgctagccgccgctaggctcgccgccgcaccgcgccgtcgccgccgtcgggtttgcgtggccgagatccaccccgtccaaccctccttcgccgaggtccgccgccggagcgccattcccatcgtgcgacggtgagggttgccatgtccgccgcctttggccggcattcccgtctcatatggcccctctcttcctctctaatctatttcttttcgttctntaggtcgtcccggtcgccgtccgccgcgtgtcgacctccctccgtcgctcctcgtcgccggtcgccgccgtccccttcggtgaggactccctcccctttcttttccttccccgattccccgtgcgtcgccgccgcccgcgctcgccgtcgccttcggtcgttgccgccgtccgctgccgccgctttcgcgtcgcttttgcgccgtcgcctccgccgccggatgccattgccggcaacgcgttcgcgcgcgcgtgccgtcgccgctagccctggccggccggtcggctttgatgccgagccgagcctggcggccgcctctatcgcggcccgtccgatcggcccgaggacgatctgggccgtcggtcccgtggaccggcggtggaccacctgcgtggtcccggtccacggtgaaccgccccccctgagccgctgaccagtgggcctcgcttgccggcgccgcaccctctccgtgctgacgtcagccctgggaattattgcgcaataaatgatttaaggtttttttatagtaataaacacaatgaatcttctaaaattcataactaattcatccgagctccgtttaagcccattcaagtctcagtaaatcaagaaaaatgtgtagaatccattaaaaacggttttgttccctgtttcagtagtcttatagcctgtttgcaatgtttgccttgtatgtcgctagattccggttcctccgacgctccggtgtactttgaaatagtcgccgaggttcctccagcagcagagcaaggcaagtcatgcttgtcacttgaacatgttgatcctatattgcaaatgctctattgttttccttcaaatactgcatcgttttataatgttactaaggggtgtttacctattgtcatagccatgctattgttgtaccatgtccctttgtcagcttggggttataacatgactagagattggactagggattgcttagccatgcttag

SEQ ID NO: 18218 - DNA, 1453 bp, Oryza sativa
cggcctatgcggcttccggattcacctaggcgcgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtatcttgtgggtacagttgtacacctctgatcagagtaaaactattcgaatagccatgcccgcggttatgggcggtcaaccagattcaccgtgattagtttcaccctagtgtaatcttttgaatttggatagtttaggtggatggttgggcctgttgcaacgtggaatagcgttggacagtggatagttaatattaattaattattacaactgtttaaatctttcaacttctgtttataagtgctcgctttatgcaaatgaaccactctagctcttctgtgataattccctgcatcatacccctattccggtatgacttgctgagtacagtggatagtactcagtcttgctctatttttcccaaccccagagtacgagtatgtgtcagatggaggtgtctctgaggagtaggcttcgtccgtgccgtcgaggatgcctgttgagtggtgttcccgctgcagttctagtcaaggcttagctcctgttgtctttcttttcttccgctgcatttatataagacttttatgatgtttgtaagacgtggatctgaatgtcaacattatcgtttgtgtaccccggccggtcctggacggggattttaatgcacatcctgcttggaattctattcgggaatttctgggcgtgacaagcgcgtgtgaagatggaaccgtaggcccgctagtctgctgctgtttatttttgattgtcaggccttaagtgcctttgtaataatgtaaatattatcgatataataaagatgtgtcttttatatcatgtttgtatggtgtaccccggcttttcctaggacggggattaatacactagcgttcgggaaagtgcaaattttctcggtcgcgacagtatcattattttaattttgatttatcccccctaaccaatcttaaattatacggtttggaaatatgtgaatagtaaaagtatatttccaaaccgaataatttgtaatggtatgatctaattaacccattttgtattggctttcgctttgtactttactgtagcaagccacaaccacgattgattgaaaagtggctcaaacaaacgagctcaatatctccaaccttttagatataataaataaattatgaaattaatggactggattttagtacttatatcaaccggagggatacttgtattaagctgggaaggaagttatcatattaaacttaataaaaataatttaaataatagatatcatttttctagtagctatataaaaatttgacaggttttgaaaaaaaaa

SEQ ID NO: 18219 - DNA, 3590 bp, Oryza sativa
aattcctgcagccccaacttgaaagttttggtgaaaaaaaactgtcaacgatttcttagcacatccgtttttttaagtgttgcaatccttttttttttctcgttttgttgcactggttgtgtatgagcgtttaactctctttttatttggaccagtaaataactaaatatgccatgcattgcacggccaacactattgggagtgggttagtcgtaaatttgtcatatatcctaaaagcacatgatctttctgaactaaccgtttcttttttttctatttttctccatcaatattttttctttctatttttctccattaatattttttctttaactaatcgtttctatttgagctggggctaagtcttcggactgagatcctctattttaagtcaagtaactttaaagtcactgacatgtacatggatccatagcaaagaaagtccatatcttaagctcagttcgtttcccatggttcccaactcccttctcatttttcgcgtgcacgcttttcaaactactattttggtgtgtttttttgcaaaaagtttctatacgaaagttgtttaaaaaaattatattgttccatttttgaaaaaaaaatgagctaatacttaattaatcacgtgctaatagattgctccgttttccgtgcggaggagtttggttcccaaccatcctaagcgaacacagccttaagtgacttaaagtcagaggatctcgatcccaagtccctctatcttgctagatcaccatagagaataagaaaagaaaggggaggaagaagaccgaagagaatcagagcaaaccctccaaattcaaagttagatctacccctggatatacgttatgggaggaaagaagtacgactccgtttttacagagaatgttatgtttgtgccttataacgagtcagatccatataataatgggttaaatagatccataccattacaaattatttggtttggaaatatgccattactattcacatatttagaaccataccattataatttttagctatttaaaatatgccactacatacccatctgatgcatccaataaacattttagaccaaattacccttttctttttctactgtccatcttcttcctctcctttctttctttttggatttggatctgatactggcagcttatctttctcctcctcatctactcacccattttcgcttgaacctaagcaaggccactcatgtactctcgcacccaaaggaaggtccagcaacgacatcgagccatcatcaacaacttccctgtttatttttttctcgtttttgtttctctagaatttgtactaaagaaaaaggaaacaaggaccacccactccacctttggcccgacgaagatcaagcatgcgtgcatgtgagcaaatatcgctggcggtcatgccttgtgcgactcgcagccgccttgcacaagtacgagagcacctgctgcttcgagagaagaagggacgaaggagagagaagatagaacatgggagagaaagaagaagagaacgaggaagaagataagggatagtttggtcctaaaatttttgcaaatattttgaagaggtagctagtggcatatctctactacttaaaaaataaaagtgcttccattgtccgttaaaaaaaccgggcgaaaaaaccgaatctatctgatccaaaaaaaccgggccaaaaaaaccggaaaaagaaaagaaaaaccaaacgtcaataaaaaccagtcgttaaaaaatgtccgatcaaaaaaaacgggtgaaaaaaaaactgaaaaaagaaaagaaaaccgaatcggttcgatccaaaaaaaaagggcgaaaataagtgaaaagaaaaacgaatccgactctgtcaatgcggtaaaaagagggtgaaaaaaatatgtccgattccaaactctgcattggtgaaaaaaattgatgtgccggattgaagatctttttgcaaaaacggaacatacgtgtcgagagcattccatttttatataatttttatttttagtttgtacttttgcatttaagtccctgtaatttttatatttacatttaagtccctataatcttgcaataagatacttgaggtcgtttttgttaaaaaaataataaaagagagagaacaaaggcagaaaggtgcattaaaagaaaaataaaagctgcacaaaaaagaaaataaagaaaaacaacaacaacaacaaaagtctttttcccctaagtggcgaaaaatactgtagatccgaacggaaaaaaaatctgatttatataaaaggcaaaaaaaaagtggtaaaaaaaatgctagatccgattcctttataaacggaaaaaaagtctgattcctataaaggccaaaaaaattctaaaaaaatatctaaaagagttcggccgattccctaaaaaaatggtgaaacaaaatccaatttctaaccagtatatatctcttctctatctctaatctaatctaactattttaaaagagaaaatgtacgagaaaataaaacggttcaaaaaaaatgtgtgaggcaaaagtcagaaaaaaacaccaaaaaaacatgctaaaaatgttttccatctttaataaaaaaaataaaaaatgcgcgagaaaaattatttctatcgtcggtaaaatattttttaaaaaaacatgcgaggaaaaacctgtctgaaataacgcgtcatttctaaaaaaatggttttaaaaaaccgcacaagaaaaataacaccgtctactaaaaacaaattgctttaaaaaaattgtcagaaaaaagataaattgatggacgcttgaatcgaataggatcattgattttttgccaactactatatggctttatttcgtcatatattctcttgtattggaaaaaagagaaaaaaagcattcgaaaaaaacaagcaaaaacaacatgcaagaaaacaggcaaaaaaacacacgagaaaagaaaagcaaaaaaaggagaaaaatatagttttcttcatcagtaaaaaaaagaaaaaaacatgctaggaaaaaacttttagaaagaaatgcgccatttctgaaaaatggtttgagaaaatcgcgcaaggaaaaaaatacactgtttataaaaaacaagccgcttattaaaatagaaacattgtcattgacatgattatgcatgaaaaacatatattatcattagaatttttttacccgttacaatgcacaaacatttttgctagtaacaaataagtgtgaaattataatggtataaattcaaatagctgaatagtaatgatatatttcaaaaccgtaaaaattatagtggcataacccatacaaaatacttgctgtactagttgctatggttgtacagctatgtttggtttcgaaactactaatgataatcagaattttcaaagtttaactaaatcttatccaaatatcgaatatttataactgtagagtacttcatatataacacatattagagttatcaaaaaaaattcaaggtggaaattacagtagcagagtagagccaacaacaaaataattcagcttggacaattagtagtagtgactagtgggctttacacagccaaataattcagagggctgcaggaat

SEQ ID NO: 18220 - DNA, 13331 bp, Oryza sativa
  unsure (1)..(13331): unsure at all n locations
aactccccgtccgcgccctccccctcctcatgcctgggccgctccgtcctcatcgccgacttcccccacgccggcgggtaaaaacccctccctctccctctccacccaaaccctaatctgcctgtgttcaccgccttttgcgcttcctcgcgccgtttggtttcccacctcaggaggggcttggcggcggcgcgggacctccggcgcggcgagctggtgctgcgggcgccgcgcgccgccctgctcaccagcggccgcgtcatggacgatgaccccaggatcgcctcctccgtcgccagccacctcccccgcctctcctccgtccaggtaatttcatatgcctatgtcaggctgtcttcgaattgacttgagttgttggatggtttcgatttggagtgcattgctctcgttgtttccgcaacagtggagtgcgttgctcatggtggtggtaggttaataccatattaaatctttggatgcaccggagaattcgcaaaatgtgccggcacgataaaggcatcatgaatactggagttggaataaccatatgcttctcacaataaatcttgtgaaataaatttgtgcgaagaggcacggccttggctttgagaagaccagaaacaagtctggccttaagcgcaccgcagttgcaggaaccaaatgctgcagacagttggtgtgctaagagcaggtacaatagcaggctataagccagctgcaaacatattttaaggagataaatcaggagagagaagagcagcgggctacagatttgtagccagctgtagcacggactccaagacgcagtgtgtctatgacagttggggctaggtattaatagtgtagcatgtaactattgtataaatgagctattagattggctatagatgagttggagttagtagttggctaaactattgaacttgctctaatccattagattggctctacatatgttgaattggtttcactattatgtttcagtttggacaaaaagattggatggatttggcaattttggggagggtaaaaagatcacactaacacatactagtaatttactagataaaatgaaaatgaaaatcttcgacacaaataactctatcgtgatgtcttgatgattctattttttatttgacttcgaaagtgtcaactcaatcttggcctttctatgccccttttgatcttgtaagggcaatgaaagaaactttcatgcttggtctccttatcacatcttttcaattgcttcaatgctttcactgatattccctttgtatctgagcagaccctgatcatatgtttgttgtctgaagtgggaaaagggaagagttcaaattggtatctatatttgtctcagctgccctcctactacactatcttggctaccttcaatgattttgaaactgaagctctccaagtacaactcggtagttctgtctacaaaattttagttttccatttcgattgcttcatgttacattcagcttacttcttttcaggttgatgaggctatttgggttgctcaaaaggctcttcgtggaataagatcagactgggaagaagcaacaccactgatgaaagggttgggatttaaacctaagcttttgatgtttaaatcatggatctgggcttttgcaacggtatagttttttgaattttagctcagtttataccagttctctttgttgtttgacataccagctttgctgtctagttttttgtaagggagtttgtcgtctagtttagttactgcatagaatgaaagtaatggaactcaccttaccttttgttttttaacatggctctgagttttgtaacgttacatttatatattccttgcacggggatagcctttctctttcatatttgacatgctagctttgtagccactacaatgaatctctgctgactcaagaattttataagtttgttagtcttaatttctgttctatattttcatggtggaaaggtatgaggtttctgaagtttcttttgacaacttgaaggtatcttcaagaacattgcatatagcatgggatgatgctggttgtctatgtcctattggtgatttgttcaattatgctgctcctaatgatgacaattcatcaccggatgaagatagagatgatatgatgcatcaggagacaaataagatgttggaccagacagattttgattcatctgagaagttgacagatgggggatatgaagatgttaatgaataccgtctgtatgctcggaaaagatatagaaaaggagagcaggtttcttctgatatttgcctaaaatatatgcccttttttgtctataggatgctcatgttctcccgtatcacattatctgccttcttgttgttctgtacttttgaattaaactttgtcctttcgtacaggtacttctggcttatggaacgtatacaaacttggaacttcttgagcattatggttttcttttgggtgagaaccctaatgagaaaatctacattccattagatttggatttatgcatgatcggttcttggccaagagattccttgtatattctgccaaatggacatccctcatttgcattgctgtgtgcattaaggctttggacaactcccagaaatcgtcggaaagccttaagtcatcagatctactctggatcattgttatctgttgaaaatgagctggagattctgaaatggttggtcaagaagtgcaaggaaactttgcagcaattacctacgactatagaatttgatgataatttgctcgtccttttatgcaagctacagaacagcactagctgcataacagaaatgaaccggtcaatctttgagcaagaatttgctccattcttcagatttcatggcttcaagctggattgttctatacacagtaaactcccagttcgtcttctacgatccctggaaagatggggattagctgtccagtggagatgcaactacaaaagaaccctaaccaagtgtattgtgcactgtaaaagtttagttcacgagctttcgttgcaacaaaatcaacaatagctcaaagattcaagctaactatgttctttagaatgcagaagttcttgatacaacaaaaatcaacaatagctcaaagattcaagctaattatgtttttttaatgcagaagttcttgatacatttttgcttaacagcatgtcaaattgtcaacactcgatagcagggcgaggtgctttcatagttccatgcatcacactttttggggttgcatagtttaagcataacaagcgttctgtggaatgccttctgtggaatgccgctgagatactgataattgattatcaggcatgcatatgatcttgtcaattacctcattcaaagtgtttttatggcgtgcttattttgttttctttcactgcttaaacagttatttttatgatgttgcaagctttttaaaacacaatactgtatgtaattgggagtttattttttgaagtgaactttggatattgcacatacaaacaaaaacttatgtattttagaaattatttaattttcatctaaaaagagagaagttatttaatagcatgctttacgattaataacaaataaaaatctaagaggctctacattttgctatcgacaagtgtccggttttacgaaatgttatcgatgaaatcaagttatacacaatggtatggtacaaacgtctttatcttgtttttgccaccatcaggtttctgtcactttgacattagtttgtttttgtgattgtggacacgcctgacctgaggcccgatgtcctagcgctagcaggcacagttggatttattttctgcatacgagtacccgagggattttagcccattcttacatcttgccctatttgatccatgatagtagccatatgtccatatatatgctattgtgattggaaccctagctggagcccctcctaatccccctccctccctacttggtcccatttgtagtctccctcccacagcgacggccattgcagcggcgcagatgggccatggacgtcgccacgtcgggccatggatgcatagatgaatatcttaagatcatttgagtttgataaatgtattatgtcaaatatgtggccggtacccatcggtttctaggagcttgacgggcacaagcgtagttctatgttgtgccatcagaggtgtcaggtttgggccgggcacaagtacagatatattcgtgtttgacctgagcctaacccaactctttgccatctctaatcctggcactattgaacaaacctaaacgttttggatgacctcaccataaagaccaacatttaaaaaggtaagtggggaccacttcaggacccttgattcttcccctcccagctataaataccaccctagtctaggactccatggtgcaaaactctaagccacagagctagcgacagatagaacgcctgcaaggccaggagcggaggtgctctttgaccagttcgaccgcacgctctcccttaggcttcaggccaaggtgacaatacgctcacctcaaaccccatgtttccatcgttccctttctttttcctacctaattttttgattcttcatgttctttttatgtggatccatgttgttgttcttggatgatgcatttttgcatcagaagtggattcctctcgtttagtttgatatgattttctcgattatactttagaagggttggactgattagggttttttttgttttgtatgatggaaacaagttcttttttttcctcttgtttttcatagtcctcgttggttcctatggtggtttttcaatcgtctaatatatatttgggaatcttgaatttggtacatagtttgtttgtgtcgattggtttttttatagatctatttatctctttttttttggaagtaaaactcgagaggaaggacatggtttgtattgagatgaatagatctatgtattgttacggttgtttgtatgttggttatgtcgtagaaatgatagcttggcttgactcttaggtgaacgagattatgggatatgtgagatagttatattttcacggtattagattgaacaaggatgcaccaaacggttttaaccaaagatgttggaaatttggagggcaacgacagccatgcatggtagatgaggccatcataatatgtggtgatggtggtagcaaaggtgaatgtaatttaggaggagaaaacttgcggtaatagaatatggatatatgggatgaggaaattaattgttgaaaaatatggtgacggccacggtggtggcggcggcggcagtggaggtggaggcgatgatgaagagattaggaaggggtggggattttaaggttatggaggggtcttgttgggccgggcctaatatccatgcctaaaacggtaggttcacattggtcttgggttatgaagggttacaaatctcaaaggatgatcaaatggatcaaaatacactcgaacaaaaattgaaggcccttcatttatagaaaattataaacaaaggactcctgatatatgacagtagcctaaaatatactccttcatttatcaaatgagctagatggattagattgtgggatatgtgaggttgtaataaattcaccatatgttgtagttaaggtgtagggcagatggagcaacaccaaacatgtactccattgatcgaaggagttacgcaaattaaattatcattatattagaaaataatattttactgtctagttataataagttaaaaggtgacacaaccaatagttttggtacaaggatggtgcaaaattagagacaaacaccatgaataacagatagaggagactaggaatgtagggagatggtcttttgtgggttgagcctaactttttactcctcgtaatagtgatctttactagagttgtcgtgttagggggtcatgatgtatgcaaacatcgtttcattccgctatagtctcgtacaccctatgtcacatagtttaatcactaataaacacatgcataaaactatttattaggaatatataactgaccacataaatcccaagtccccaactaagcgctgccatataccaaacatgccatacatccaggaaggcgaagaggtttgacttcacatattgacttccttcccttcatttttcttttcctagttaattaattaattagttcctcaaccaagatgagaaagaacaagaagaaagacaccaacataaatttgatgttgacgtagtcgtgccaaccgtgcacacatgacgtctttagatttggaaattactggaaggccttttcttcctcttctttttttttttgaaagaaacttatttggaacttggaaggtcttttcgctctttaggaaagcgcgcccgcttccatcccagaaaaatttccacgaaggccacgacccgcgtcgcgcgcgcccgtttccatcccagaaaattttcctgtataaataaataagacccacacgaagtccacgaaccgcgtcgcgtgggacccttccagaagcagagcccttcctgtagtcgtcgtcgtcgtcgtcgtctcctcttcgcgttgggtttgattcctcttcttctcgtctcccgcagcggcggccgtcgatcggaatggcgagccgaggagaggccagcaccagcgccaccagcagcagcagcagcagcccggcgggtacggacgcggcggcggcggcggccgcgggcgcggccgggacggggcgccgtactcgggtggtcgtgggcgcggtcaggacggatcgtaccctggcggccgcggtgggggctatggcggtggtggtggtggaggtgggccgccgtactatggcggaggaggtggtggtggtggaggaggaggaggccaagggcgtgggtactatgatgatggcggcgatggccgcgggtaccagcggggcatggagggaggcggaggccgtggaggttatcgcggggacggcgatggtggctacggacgaggcggtggcggttatcacggggacggtgagcgtggctacggccgaggcggtggcggtggcggtggaggcggcggcggctatcgtggggatgacgagggtcgtagcagctacggccgagcccgtggcggtggcggtggcggtggcggctatcatggggacggcgaggctggatacggccgtggacgcggcggcagggactacgatggcggccgcggcggcggaggaagaagaggaggacgcggcggcggtggttcgagctaccaccagcagccgccccccgatctgccccaagctccggagccgcgcctcgccgcgcaatacgcccgcgagatcgacattgccgcgctccgggcgcagttcaaggggctgaccaccaccacccccggcgccgcgtcgtcgcagttcccggcgcggcctgggttcggcgccgccggagaggagtgcctcgtgaaggtcaaccacttcttcgtcggcctcaagaacgacaacttccaccactacgacgtaagcatccacactactacagtccacagcatctccattcccatctcctcgtcgatcacctcatcaccgtttgttttgcaggtggcgatcgcgccggatccggtgctgaagggcttgttccgcacgatcatctcgaagctggtgacggagcggcggcacaccgacttcggcggccgcctccccgtctacgacggccgcgccaacctctacaccgccggcgagctcccgttcaggagcagggagctcgaggtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtagaaagaactcgatcagctgcctcgattgagatctcttgaggatttcgtaaactgggaattgatgaattcgtgtaatcgttttcgttttgaatgtgcaggtacgttgcgtttggtcggtcttacttctcaccggggctcggatcgagggaactcgacaagggcatctttgcgtggaaggggttctaccagagttgccgggtcacgcagcagggcctttctctgaacataggtcagatttgtgtttcagtttgtttctgaacttgtacttgatcgagtttacctgcaattcatgagaatgattaggtgatggcatttttttttgcagacatgtcttcgactgctttcattgaacctggtcgggtgctgaattttgtagaaaaagctattggacgtcgaatcactaatgctattactgtgggatattttttgaacaattatgggaatgaagtgtgtaatccaaatgctttcccccatgatttgtttgcgtggagttgatcttgacttgtttttccgtgcttcgtgaatttgcagttgatgaggacccttaagggtgttaaggttgaagtcactcaccgaggaaatctacgcaagaagtaccgcattgctggcttcaccgagcagtctgcagatgttcagacgtaaggagcctagcttaccttctccctgatcttaacagtttctgtgtaatgttgctatttgaattctcttgcatagcttaaatcttaccaattattttgttggatcccaaaactattaaggttcacatcatctgatggtatcaagactgtcaaggagtatttcaacaaaaaatacaatctgaagttagcttttggttatcttccatgcctgcaagttggcagcaaggagagaccgaattacctgcccatggaggttcgtgcatatacttcacatttaactgaaatgttcgattcttttctacatcctctgcctttacacatgctaattctttgtgttgaaatttgatttggatttcagctttgcaatatagttcctggacaacgatacaagaaccggctcagtccgacacaggtttccaatctgattaacataaccaacgatcgtccttgtgaccgtgagagctccattcgtcaggttcctgcttatgcttattttctgtgatattttgtcaggtttttactgtgtgggtaaatacgttttttatttctctctaacccatctttcctttttcttagactgttagcagcaaccagtataacagtacggaacgcgcagatgagtttggcatagaagttgactcttatcctactactttaaaggctagagttttgaaagctccaatggtaatcctacttatttttttctcatcagtatctccttttgtttttcagtttttccgtacttctgtccttacatttgtgagtaatgttgtagctgaagtaccatgattctggaagggtgagagtatgcacgccagaggatggggcgtggaacatgaaagacaaggtacatcatgttgaactgaaacatttcttaaactttttctataatgttttgtaaatttattactatatcacagaaaatggttagttttagtgatggggttattgttcttcatctctctagttttcaaataaaagtattgatgactattactgttccattttgacacctaacaactcttaaattattaaactgatgaactaccgaagtttcatgcctatatgtctaagatacaatacacttcgataatactactatagcataagttttcttttttctaaaagagatgagtggtctcgatgacaactatttacaaatggatggagtacctgtttattgtctatagttgagtgttgatatgttgccagacaagctacagttggttcagagtcttggttccctcaaacttcttatttgcttaaacaaaatctgtagagctcttgtggattgttcccaaaaagagaaactggttggaagatcctggtctaccaaccctgtgcaatattttgaagtttgcgcaaatagttttaggaactgatttctttttaggttgtatactctgtctattccatttacccccttctatattcttgtcttctctccacactgtttgaacaattcttttgatgcgcagaaagtagttaacggtgctacaattaaaagctgggcatgtgtcaacttgtgcgagggtttggataatcgtgttgttgaagcattctgccttcaattggtcagaacgtccaaaataactggactggtaatttagcttttcatcatcctctttttgctgttttgatcattttatttgatgtactcttagctaattttttactttgatttcaggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtaactagcatccaaattcgctctaatgtgtggaataatattattcattaatgtctctttataggttagagttatattggctattcaatatagtatcttcttctaccatgcatctactctgttataattttagccccaacaaagttcttaaaatctctctgattaaattgatgttttttttttgctttttttaaaggaatatgcaagcccagtttaacaaaattagaattcgaatagcaaatatatatttcttgtcttgaagaaaattctcacttgtgccatgcctgatgacacttataaccacaggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggtaaacttgatcacctcccagaatctttgtttcgcaaagcttattgaaccacaagattcaagatgtaatatatattcaccatgtctgcaggctggaggaaggaactcggtatttcttaatgtagaagcaagtttaccggttgtttcaaagagcccaactattatatttggtgctgatgttacccatcctgggtcctttgatgaaagtaccccttccattgcttcggtaagatatatatatttctttctatcagaaaatataattgcatctattactgtaacagctttcatctgacggggttccatttaggttgttgcttccgcagactggcctgaggtgaccaagtataattctgttgttcgtatgcaagcttctcgtaaggagattatacaagatcttgatagcattgttaggtgagatcttcatgctgctcagctaaattctagaattgcatgccagtgtgccaccatttggcagttctttaatttctaaaatataaaattgcagggaacttctcaatgcattcaaaagggactccaagatggagccgaagcagctcattttctacaggttcatattctccatgtttgtttttttttcttaattgtacgtgctcctttgttgatcataccgagacactgataattgtcctgtttcatcatcagggacggcgtaagcgagggtcagttccagcaagttgtagagagcgaaataccggagatagaaaaggtataagcaatttttttcttttcctggttacgactctccatggttgtaatcttgtatttttttcctgctctatcaatagaacttcgcaccgtctcgtgcgagtcgttcaaaaaatttgatgactgaacagtgcaaaacgttttaaccatctggttaaaaaatatttgttatcgtaattcactgtttcttcaggcttggaagtctctgtatgctggcaagccacgaattaccttcatagtggtgcagaagaggcatcatacaaggctgttccccaacaattacaatgatccacgcggcatggatgggactggaaatgttcgtccaggttgaaaatcgatggcctctcccgtaaacgttgtttaattaccctgtttggtcaattgcctaactcgtttttcttcttctgtaaataaattccaggcacagtagttgatacagtgatctgtcaccctcgagagtttgatttcttcctgtgcagccaagccgggatcaaagtaagatgcctattgcctatagcacgctgcagagtacaaatgagtgaactgtcctctagtctaattacttaatacaagagggtgccctaacgatgtttaaattgtaaaattgcaggggacaagccgtcctagccattaccatgtgctgcgcgacgacaacaacttcaccgcagatcagcttcagtctgtcacaaacaacctgtgctacttgtaattgtgctctgctcttctttgccgtgattgctgatgtctgcattttgcactcgcgcggttgaatgatgacttctttttttttgctgtttactcgacagatatacaagctgcactcgctcggtgtctattcgtaagtcacttctctcttagctatgagctctgttttatcacagaagagtattcaaataagcttttctcctaaaaaaccatgaatgtctgcatttttgattcttttctcctaaatgtccattgtgctgcaaagaacttgaagtttttgtacagtcataagtcgagtgaaattctatcaaactcaagggtagttaaataaatgatagaactattgggctttccaaagaacatgaagagggatttaggaatgcatgaatggaactagagttttttttttaagatagtcgataaagtccggcctttactactgctacaactatctcaatttgtcatgctgttctgtcttaacattgtcttgtttgctgttgcagcacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcncaggttgccattcgtttccatgtggcatggaggatggcatcctgaaaaggatattgtcatgtttgtgtggtttttaaacgacattgaagtttatctccggtgttactatctcagcactttggatgttttattttgttatgtctgaagatatagacacaaaacttcatttttgtttctgtttctggtgattctgcttgccgtttatttttctggatatgcaagctaatttatgcgtaccacaaaattgttttttaaaaaatataaaacctcaatttgtatttaaccatctaaccttggcacctcgattgtgtttagtataaataatttctaaaatttaaattcttta

SEQ ID NO: 18221 - DNA, 27128 bp, Oryza sativa
caaaattttaaattatttttaaaatttatttgaatataaggaggttaccgtggtttttcttttaccgtaccctttcagtaagcgcggtaaccatgcggttaccaatggtttgggaaacaggatgaattttctagctggttaatttgatattgatttgtcttcgaaagtgatatgtgtttaacttgaaatccattttagaaatttgattctgtttgagatgaaaggagttttgagcaccactgtaccatggcacaatttctgtaactgaaactctgccggcagaggtcattacattcaaggtctaattatctatcggtaaaggcttcccccgaccattgtccgacagaacttgtggggtcatggtgtcatgtagtactcctcatggttagggcatgcagcttgaaataagtgctaagtacggtcgatcgatcgattaatgcagttgcataaatcaggacatacacatccacgaaggctctacatattgagtgttatgtttggtgtacacaaaaatgtcattgtaccgtggaaactgtattacgataaaaccttttcttttaaaaaaattcataacatacagacagggcacatgggtactgttcttttgttttaccgtaaggttatagttttcagataaagtgatacttatctaaagttatagcaaattagtatcctatggtttgaaggctatctcatgtttacttaattatatggacgaggcgtggttgttacaataaaatgaccaaatctctcttcgtaatcgatatactataccttgaacgtaaatctaatttgtttactttggacatacaatataatattgcaaatcatgaaagggtctgtagcctagtagttacaggaggttccgtagcacctgaggtcctgggttcgactccctataggagcgaatttttcaggatttaacggcgttgcgctttcaatgatttttcaggattttaatggcgttgcgctttcaatggtagggcgaggcgcgagtcttcgaagatgttcataggggtgagtgcgcgtgcgttgtgagtttctgtattgtactgtgtaattctaaaaaaaggtataatattgcaaatcgaagtgttttctttcatactagtatgtaaaaaaccaaatcctagctatgtgtgtccagatttctagctaggattttttttttacggagagtacttctttaactagacaaatcattttgtattgggagttgtacctgtcactagtgctggtaaaattctatccattgaatccttaaaattcacaaatcccagttatgtgtgtccagatttttagttaggatttgatttttttttacggagagtacttctttaggcagacaaatcattttgtattgggagttgtacctgtcactagtgctggtaaaattctatccattgaatccttaaaattcgtatattagagatacttgccgcgtccttgaatagatatcatttcagagtgcatatatatgtagtgaaatttaaaatctttgccccgctccccctaacacgtttcgaattagtacactaaattcaaatgtgcatactaatgaaagatgacaaagagacactttcctggaccacatcacactactacatgattgattttcttgaacgccccccataagtgaaattacacggaaaaatagagggaccgacaccagtttatcacccgcacaggaaaatcaattttcgtgtacgggccacttaacagacccacacgcaaaaataatatgtgcaggtctgctaagtgacatgcacacgaaaatagcccaccccacaaaaataaagtggctccctccacccggctcctcccacagacccacacttatcctcatccctcccacacttctccctctcctcctcccctcctcccatcgcgctctccctctcgtcctcggcgacggcggtgccctcggctagggtggcggaggcggcggcatcgactacggctcctcccccctcccatcgccctctccctctccctattgtcctcggcgacggcggcgccctcggctagagcggcggaagcggcggcactacggcaacggcatcggctacggctcccccctcctcccatcgccctctccctctccctctcatcctcggcgacagctatggctaaggcggcggcggctgcatcggctaaggcggtggcagagcgtatccgtggcagaccaccgcggggaggccggatccgtggcctgccaccgcggggacgacggcgacgggcttcgggaaggcggcgacgatgacggcaggcttcgggaaggcggcgatgacgttgacgatgttgattttttattagggttcgtgggtggattttgattcttttcccttttttattattccgtgcggttggtataacatgaccgcacgggataatcgattatcccgtgcggtcagcccgcccgcacgcaaaaatggcgatttttccagacgaccggctgcaaacgggccggacccccgcacgggataatccaaacacccgcatggaaaaatgggtattgtagtagtgtcaaccaaaaaggagatacattcttcatccaaaattgacgaagattttcatgaccgttctaaacttcaagcatgcaaaaatgtatgaatttcttgtcgttatcacaccttaatttgttatatgagtatattatttagataatggataatccgacgtttacttcaaatgaagatatagccactcttattacaaagttcttagataaaccaaaagcaaaagttcaacccaatcaagttgacgagaagatatacttaattaaccacaatcaaccacacaaggagacaatttgttcaggaaaacaatcctattattatatttatgaatatatatactgagattggagagtgagataaagtgatatatgtgagtgcatcaccactacagattctatttttcaatgcagccaaaatcgattttttaggcgagtgggtggcccggtgtctgtgaaaaatcatagttttgcatgtgggtagagacgattttcgcatgaggtcacttatagcgaccacacgaaaaaataattttggtgaaacaaaaataagattccaaaacaaaaaaaaatcagtcgaaaccctagcctaccgccagcagaaaccctagcttccaaggcgtcgtcatcatcctcgacgcaacaacagtcaacgagggctggtgccaccagattcgccgcccctcgccgttgtcgttgtcatcgtacttatcctcgtcgctcgaagtaatcgacggatcctcgcgtgaggcagggtggagtagtggcggcgagatccatgcgggagggggagggggcgccggatccgccctggcgtcgctgccactggcagatccacacgcgtaggggccagagaggtggcagaatgctggaatccacgcgggagttggaggggccctagattcgtccctcccattgccgttgccagcggatccgcttgaggggggggggggggtagagcggcagccgaatccaggtgggaactaaagggggtgggatccctctcatagtcgaccgccaccgttgctgccgccgccattgccctagcccgcctcgctcgagcctacgaggagagggggaggtgcatgggggagaggtggagtggaggagaggagagggatggttgtgagtagtggggagagtgaagtagtgaggtggatgagagaacttactgggagagagaggagaggagaggagaaaaaaagaatgggaagagagaggagtattttcgtatgcaggccacttaagaggcccgcatgtgaagataaacttattttcgcatgcaagcctcttaaaaggctcacttgcaaaatttgattttcatgcgatctttaatctctacacgggagattgagttttgcaggtgggaacaattatgatccacatgcaacctaaaggggttcgttcagaaaaattgattctgtaatactgcattgtcagatggggaaggtcaatgtggaatcttcaatttataccttccatatattggtgttatcaatcaggcaaggtatggcagaggggttgttgcgttgttgtcacaagttcttccacatttatagttagagaaaaaagatgagtagttttcctaaaagaaaaatactcaactaccgtatctgaatggagcaattatatatctgatgtgtcagtttttttcttgggttgttacacaaagcacagtttttcttattaattagcaatcaaaaaggaacatatatatatatatacatataatgtacacctcacccacactagaagcttgaacctattattgatgttcatgaatcttacggaaggcatatactcttctctccacagctttccttcaaattgttaatggtcatgcaaaaagaggaactctaatccaatttgttcttttaaaaattcctactttttaaagacatggtaagttgatgattaatatcgatgaaacgtactaatgggctatgtaaacaacaagtaaaacttgctctttgggttcatttttgtatgcacctggtaccaaagattaaaaaaaaacttgagtctttttgtgcgcatccttactaccaattattgttttttacaatttaaaaagttaaagttcactcttccgtatggtaaggggtcttgtccttgtcataaaatgagggcatttggattatagaggggtaccctttagaacaagagaaaatccataaaatgccattgacaaacactctaatcccaaaaatgccattgacaagtgcaacttccttaaaataccatcgtacaaacgtttttctcccagagatgccatcacagccatactgctgttaactcctccccgttaagtggtatgaaaagacaatcttacctctgggtaatccttttgctcaaacaacatcattttgtattgtttgctcacacaatattattttgaattgatgcctatttaaattcacagacgtgtattatttagatatcaatcaaaatatttcaaaattaaatatcttgaattcacatacgtgaatattttgaattgatgcatattcaaaattcacagacgcgccgccgctgggagcgccacatcgccgtcgagggctgccacaccgccgcctgggaaccccgtgccgctgcctgagggccacgcgccgctgccgccgggggacctccgcgccgccgcccgggagcatcgcctcgccgcctgcgagtgctgccgcgccgccacccgggagcatcgcctcgccgcctgcgagcaccaccgcgccgccgcccgagagcgccgcctcgctgccgcctgcgagcgccgccgcctgggggcaccgcatcgccgccgccgtcgcccgatgttaggtttagggttcttttttcccccaatttcttttcttttaccacctctggatagtaaaaattggagcgagggtaatctagtcattttggtaaaaaaaatttctaacggtgtggactaaacggtaagttggctgtgatggcatttcggggagaaaagcgcttgtacaatggcattttgaggaagttgcgcttgtcaatggcatttctgggattagagtgcttgtcaatggcatttcatggattttctcttagaacaaacgaaaaatatggaatgctagctagtgcctagtagatgatttaaatagtatgaaaatatattccttttgagatagccctttaaaacaaagaatttattcctaaaaattcctttgaaatcttatagaatgagctatattataaggatctcagccaaacaattttgaggatttatgagtttctaaataatgggacatgtcattctattcctacgtgtttcatatgttactatgttccgatgatcttcccgttccaaaggagccacttttagagccacagcatcatggagttggagttgagaagatgagttataattgacaagtttttcatctctatataaaatattagaacccgagcgccaaacatgcatcggcccaggcccaccccaccccacatcccatcatcccactcctaccgttgtcggagtaaacgatttactcctatcgcgcggctctaccacccacctttatttgagtaaacaatttactttgataataaaaacaatttccctgcttccgatcccaccccacgtcccgcatcatgctccgactgttatcggagtaaatgatttacttcgataaaaacaacttctttgtttccggtatatattctatttttcctgttcccaaccaaccactcttgcccccacttcatttttttcttttctagtttgattacatgtgagtaattttatcgcttgtgtgtgattgagcctgtaattttttcattcatatgactattttgtgatacagatcaacaatactcttagtatcagtttttactcttatactgtatattgaactcatcagtaaacatattactacatggtggctatgagatgatggctatatcgagaggaatgtggtaattgttttactcgcagaccaggaaatctcaattttttctcaaatactgtgtattgaacacatcagtaaacatattactacacgatggctacgagattatgggatatatcgagaggaaggcagtaattgttttactcacagaccatgaaatctaaataatatttataatattggtaaaacaattactagcgttgtaagctggtagtaattattttacgaccatctaggtatggcgtcatacgatgtgaaggcattcatgcgagtaaatttgttacttttgaatgagcagatgtgggaggctgggagtaatgaaaaactccacagagtaaattcattacttttaaatgtggcgagataccagaaaaatgaaaaactcggaaagaaaaactagacggtaaatattttactaaaacacaaaaatagaataactacagagaaagaatgaaaaacagaaaaatctggatggttaatattttaccgggcctattgatgaagcacggatgagatgtaaaagagaaaaaagaaacatggaagaaaaacagaaaaatctggattgttaatattttacccggcctattgatgaagcgcagatgagatgtaaaagataaaaaagaaacacgaaagatggggagataaaataaaaaaaaacgaaccaagaaaaggtgggatgcaaaggaaaggtaggtggtaaaaaacgggaaaaccggacagagagggggttgtgcggcgctcgaactaatattccgtgctgtagcgcgtggattagcgctaccgataaaatattactaatatatgtaatattagtgcgtacgtacaggtgaatatatgtagcaaattaacttttccatatgcaattaacgaggcacacttgacattctctgatgtgtaggaacttgcatgcgtcgattaaatatatgtgcacatccacatcatttagacatttacttttctaaattttctcatattaatcctttttttattacttgcatcaaatggctctttgtgtggtctttgggaatcaggctatattctcaaagttaaaatttcaatttaaacaagtcaaaatttgaggacaacaatgtgttttttatgccaaacttttaacttcatacatatgaaatgaaatattttccggtgttataattttaatatatagaactaaacaaataaccacaataatagcttcaaacaaacatagttgctatttttctcttcataaagttagtgcatgacttgacgtgaaagaatgattcaacgttggaatagaatgttattcttcgcaagaagtgattggtgcaataactttgtttccttacgaacaaggagctaacaataaacagagggtattaattccatctcttgatatatatatgacgatggccagcacataagaattcctacaaagtttaatagaaaaatattagctatatatgacaagtggtaaaaggctcaaaggtatgcacatgtcttagttaaacgatatgcatgctatagaaggcttcttttctcatatcacaagatttgctagtttgtggttagctagccataacctagcttttccattatcaagaaaagtcataacctagctaattaattaactgtggcctgaagaacaccctaccattggattgcctccagaacccatcatagccatctgatctttagtttttcctaaataatatttagttttatatatgattgttatgtttttattaagtagccattgacggtcctaaaacttgtgcataggtgtcatgcatctacatctatagacttgaaaaatgcatcttaagcccctaaagatgcgaaatatattcatgcttccaaagttcgacttggaatgacacaaatgttaacatgaagccttcatcaacccaacgctgctgacaagtagggccagccattttttctttctttttctcttctccctcctcaatctcttcttccatggctaaaggcagctggcggacctgggctagtggcttgtgggaacaaaaagagtatctcaagttggtgaacccgtgggcacgtgagtggcctctccgccgctcggattccgcggcggtgcccctctcccgccctccgcccccggatgcggcggcaccgcccctcttccaccctcccctgcgcgacggcggcaacaacaacgacgacgagatggccaggatccggcggcacgcgcctctccgcctctccccacggcgcagcgcctctccgccactcggatccggtggcggcgcccatctcccgccctctgctgtccggatccagcggcggctcccctctcccgctctcccctgcacgatgacgacgacgatgaggtggccgggatctggcggcgaggcacctcttcgcttctccccgtgtcgcgatggtgacaacgacgagatatggcgacggtgacaacgagacgagctgtggtggcggcgacggctacgatgacgacgaacggcggtagcagctagggtttcgattatttttatttttattttttttggatttttattttcgcgtgcgggcgacataaccaccccacacgcgaaaatgcgattttcgcgtgcgggtgcgctatccgtacgcaaaaatcatgatttttttgcagaccttgggtgcgtgcgggccgccatcggcacgtgaaaacctgttttcaccgcgcaggtaaatccttttcctagtagtgacaggagcacatgcatgaggttagagactagtcaagatggctgttaatatttcttaaggatattactaaaaatataattcccagcaatgatactaaaatattcttggcatattatgatttacagatataatccgcaagcgtatgaatatactattgtagtatttcacccgaaagtattccaaggtatcgtatttatttaatcccaagggaagattgataagagagaactatgctaataatttatatgttacttgtataaatcagagtctatgcaatggttaattaattcaaaggggtaggatgacacgaagaaagaagaactaagatactctcaataaataaagtctaggctaggtgaagaaagaataagaaaagaatttattcctatacttctaatatacatgtatctttagtttacactcattagtatataatcatgtagccaataccccctaactatgctctcctggtattcctgattgccgagttccttgcgacaatccatcatggccatccaaccggaaatatatggaggactactcataccaaaaaagtgccttaggactatatatatactaacgtggaggaatacccgtactgagctgtcaccatcagcagtccacctctactgtcccgcaacatataaccccaaataatgatatctaataatctaagcaccatgctcacattattaaatactactctatacctcccggcaagacatagggcaatcattcacatgaacattaaacctacaccaatgcgtatctctgttaagctagctacataattatatgggcataagtatgaagtaaagtcgtaaaatatggaagctgaataaagaagaatattctattaattctataagtcttacaaaaagagagagaaactactagagtcatacctgtattctcctgaagactcgaggactatgaaaactattctaattctattccactagcattagcactagaacactaactaaacttgagagagagctcttgttcttattccttgagtgtgtgagggaaagagtgaggtaaaccctttatatagcctcccaatgacggttaaaacggttggaattgtcggaaatgcccaacaaccgctattgggagtgcatctagagcattgacctaacaccatggcatgtctggtacatgctcatgccgggctcctaatggccatattcatgaagatagcaataacaagataacaataaaagatgaggaggaaaaagaaaaataggacaaggaaataataaaaaagaaattttgtaagtgaatcccacttgtcagctgatttagggttagtgtgatatcacgtaagcgtccttgtcgtatgtcacattggattttggacgggtgttgacacattcagtaagtctaggatttaaagatgcattatttaagcttatggatcttgatgacaagtacacattatttaaggactgttggcatattttactcgtttttagtttctatccgacctttggtttttcacaactgagggcccctttgaaacataggattgtcaaaactcggaataggaaaaacgtaggaatagaatgtcatgtttattggattcctacgtgatttgaaaacacatgaaagtttccaaactaccgcttgatagtcacacaggaaaaccgtaggaatttaagacacgggaagaagaaaacataaggtaagacttcgtgctaatgttccttcaaaattcctctacaatagttcattccataggaatttcaaagaaattgatatgaaccaatcaatcctttctttcaaaggatttcataggattatttcccataggatataaatcttttggaatttctatgttttttctttgtttcaaaagggccctgaacttttcatttatctagatctttttactagcgatggttaccttttcttttcttttctttttagttattgttttcaaggttttgctgccacctgtaggcatgggacttgggaaggtgggggggtgggggggttagacagctacagagacaacgacctaaccctaattatggctagggaccttagtttcatcccaacaaggttaggaacttgcaaagtacgttttcatgttgtttgcagtacagttttccgattattatctttccagttagtggtatgtgctaagtgcactctcagttcatcaatcttatcaacaaagtgactcagataatccaaatatataagtaactagctagctaaattaaatgcatagcttctccttagtggtggttgactttgttaattacttagctagcatgcatgcttgcgcatgatattgcagataagtcacattgacaagtcaactaattaatgacagtctctagctgtcgatcatgtagtgctatacagaggcggttaagttttgacacatcgaattgacccctcaattagtgagacttgaaggaggagactaattaatataaaagcttttagcttttaattaatcaaccacagtggtgtaccgtacatagttgcaaggtaggaatgcgatgccatgcacgctgcattatcatctaggaaaagtacaccatatgaatgggctgacatggcacaatattatactgccgttctttcttttatataccaccaaagtaggattatgttgggtatgagtgcctgttgtaatattaatttaggacagaattaaattagggaggaagaaaggttgtggctaaaaagttcatcaacatttgtttaacaaaaaaaaaaagcaaatggtagagtgagattgatatccttctcacaaacattccttttggttacggaatgtctttcgtatacctaattaaaggtgtttgtataattaatttctcactctcttgtaccagaggattttgaggtctattacggtgttttttttttcttgctggaggggtatattactgttactagatatagagacttttaactaggaaaattaatttaaatctgaagtatgtcaattaatattataaccttgtatgacttaccattgaaaatctcagttgcacatagagtgtttgttttccactctaccaagaaaatttgggcacttctttcacacgatgaatattgaaatgtctgatgaagaagcaaaattaaacatgataccaaagctagagagcatatgtaacaattaaagtgcaagctcatagcgacaggtgagtattgttgtagataactaggacctccggattaataattgaggggaaagaattaattggcgtgagacggtggttaacgatgagcggaaagagatcaaattttaggggtgtttagatccatggcgtaaagttttggagtgtcacatcagacacacatttaaagtattaaccatagactaataacaaaacaaattatagattccgcatgtaaactgcgggatgaatttattaggtctaattaatccgccattagtaaatgtttactgtaacaccacatagtcaaatcataaagcaattaggcttaaaagattcgcctcgcaatttacacacaatctgtgtaattagttttttcgtttatatttaatactctatgcatatgtccaaacattcgatgtgacagggtgaaagattttgccaggggatctaaacaggcccttaggggaagagaggccagagaggagaggaaactaaaagttagacttgcaaagtgatcatctgctcaccaaaagaaaagctcaagctatagatagtggagaaagatgtcacacggctaaggttgaggctggggtaatgtggtgtggggagccaccactccccatatcacaaccaccaaccacatatctatatagctctggtctcaagtaaaatgccaagctttcagcaagagtgtgaggaagcttatgtgatggtccaattaaaggaatgcactggttaattaattaaactaattgaagtgaactcctagaaagcatatggaagtctatcactttttggagaggggctcattgcaagtaatccatattcaattctagtgtgttgacaaaattgtcatgattatcagtgttgctagatgtgtatagttatatgagtggtgttttgagcttgcctatcacttctgtgcaaactaaccactatgattggagcaaaaggaatgttctctatggctaggagaagaacaatttgtcaatgtgggatggaaacaaaaagtcatgtcatcaacctccccatgatctgagtccagatcccatagagaactcattactaaaggtaataacaacacaaagtagatttactggtcaattcacaatcaagtgcaagcatgcaaagaaccatatataggttaattagatagttagggaactagtctaaacatgccccacatctttatttcagcttaattggaggcagtttcaatacgaaacctaactacgagctttatcgcctgttctccaaaattgtccatgcatgcagaagttaattaatggcagacggcttgcctacatggcagttgatggagtcaagatcagggcatatatcatcgatgggggcctactggtgccatttgcacatggcagatagccgcttggatgcaatccatcttttaagttgggatccagcaatgatgctgcactaaaggagttgttttggacaatcggttatatatgacagtatctccagtagcaggacccaaaacaggttgtgttgggactagctatacacatctgtcgaaaaatttgtcaggtttaaatataattcaatcatagtatagttgcattgtaatctgtatgtaactataatacaatttatatatagctttaaaaaattccacggtaacagcgaaggttacgagactgaatctcctaacatgtgtccatactatgatttttcttctttccaactcgcacgaattttgaagtaaatataacggtttgaaattatgtgataggtatatataagttacgctgtagttacatataagttataatgtaattatactacaattatattatatttatatttaacaaattttatcaacaaatatatagcaatatcaataccaaatagtttttaggttgagggcccaaaactatagccccaatccgcagttatggtggcggtggtgggaggacatttccactagcccccgcccatcctccctaatgtgcaggcactagcgcaccgttaatcctactccagcggtttcaaaccgactgttgccttccttgtcctccctgcataaccaacgtgcctcttgagctcgactgatgacgttccaccatcctaatgccacgctaggagctcaggtggatgtgcttctaggaatcatccccaagcacctccacctcccaagctccaagccaatcagccatgcatgtcaccgcccttaccacactactacaaaattgatttttttttccgattgagactccctctagattacagttggaccataacagcccccatatgcaaaaatcactccccaaggatggttcaaggacatatgacaaaatcaattttcgtatacgggcgtctgaacatgtagcgcccgttccgtcgtggcgcctagcgggaaaattatctcttaaaaaccctagttgcgaaatttgtttccttgcttgttgtctagtgtccgtgccatctcagatctcaatccccgatctatcgtcgagtccaattccgaatccaaatccttccaaatcaatccctccgcaaaagtctattttgcctcccccggggtcgatgggccgaatctctctcggcccacctccccctccctcccggcgctctctctctctctcttcctccccctccgctccgccagcgcgccgcgcgcgcgtgcgcgagcgtcgcgccgagcgccctccgctccgccgcgccctgcccgcgcgcgtgcgcgtgagctggccgcgccgagccgagtcctcctttccgcttcctcgctgccgctccccgcgcgtcgttcgcgcgcacgcccgcgtggtcgtcgcccgcgtcgcgtctgcgccgtccgcgcagccgcccgatcccgctagccagcgcgcgtgcccgagccgcgccgctcaaaccaccgtgccgcccgttgtttccgcgcgcgcgtgccgtggtggccaaccgcctggtcgctgccgccgtcagccccctgccgcgcctgtcgctcgtgtcgccgctccgctccacaccgccccgccgtcatcgccgtcgtcatcgcctcggccccgcctctccgcgcgcaagccgctaagggacggaggcagagctccccctccctctgccgcgtcgcccccgctcccctcctccttttcccaaagaggcaagggacaagccccctttccctcccctttttttttctctttttccctctcgccggcgtcaccttctgtcgccgttttggccgctaaccggagcaccagctcgccggcttgaccgtccaatgtcggttcccctctcccaaaccgacattgccgcccatttaaacccaagcccctccccctccaatctccctcgttttcgtctctcgccgccactatcgcccctgttcgccgtcgccgtttgtcgtcgcgtgcgtgccggaggagccggtgcgcactaggatgcggaaggggactccgggcgcgccctcttcttcctcttcctcggcccgaggccggagagtttactcccgcgccgtcggcctctcgtcactgcgccccgtccgcatggtagtgcctccctccgttcttcctcctcgctccatctctcccctttagttttcggtagtagcacgagtagcctccccgtagctagccagcgccgccccggccgttgccaccgctcgccgtgtgcttgccgccgtcgccgcccgagctcggaagcgccgctcgtcgccggcctcgctcggcgtagcttcgcccaatccgacgctagcaacggattcccatagccgcgtagatgctctcgccgccgggaattggcccctcgtgacctcgtcgccgttttccccttttctctccgccggttgccgccgccgcaatccgccgccgacggactccctcctgcgaatccgagccgttggctcgtctcccctcatcctgagcaaccacccggtgtactcgctttcaccggtatcaccgtggttcgctccgccgctcgccgctatcgtccgccgtccgttccggccggcgacggcccgcgtggcggccacgtaggcgccacgtcggcgccagctcgccgagatcggatcgggccgatcccggtcagtccctcccgtgcgcgcgttccaccgcgagccgtgaggctgcgcgtgggcccgccgtatccgcgtccaccgcgaaccgcgcgcgtgcaccgcgtccctcccccaccctagcgccgcgccgcgtgctccctccgcacggtgagccgagccgctgacaagcgggtcccacccgggaccacgcgtggtgagcccggtccaccggccctctctctcctcccctcccgcgcgcgcgcgcttgggccgccttgggccggccggcccatttagctcggccggaccgccccatctctctcgggccgcgccctagccgcccgaggaaaagtctattttccctccctcttttcctttcttttcttttctttttcaaaaaggatttaattaaatccttttcctttagaccaaaaatccaataatcttagaaattcaatatcttcccaaccgtaaatccgtttgactccgttcaacttccaaaatttctcaaatctcgagatctatctaatggcacgcttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctttgaacatcttgagcctatatttgaaatttaattatgttgtttgaaaatattatgcattgataggatcgcacttaacctgttgtcccgtctgcaaggcagattggcggacctacctaatttgttgcatttaatccttcctttgttaattgtgataccatgtccccttgtaaccatctagttgcgcctcgatattcgtgcactctatgcaagtatcgacggtcgccttcaaacttaaaatctgagtaacaacttgggtaaaacttgggttttacaaaagacttggaaaacccgacacctgggtcggtgcttgcgaactaaatgaatttccgaaaccgcggaccggagaacgtaccgggtgtatggttttccgctcttgcacttaaggattgtttccttggaatttcatccaaacataagacaagtacgaccacatgggtggaatgggacacccctggctgagtaactagcttatcaggggagccttgatgccgagagacatgtggattcgccggggtggtgtcggggaggacccctgagcttcctggcacagtatggtctgggacctaacctattgttggtctgggacccctctcgtcggcatatggtaaacctgtgtcggctttggaaatgccttgtcatgaaagcttggaggtctcccgatgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgtaaaatctgcagctgatgggatcagctaggcccgggtggccgtttgaaagttgttggcccgggtggccgtttgaaaagctgttggccgggtgccaaccttgttttcaaattttaaagactgatacattgcacatactccgactggacgagacgcactgtctcaaccgtgtcgtttgagaagcactcacttagttgtttttagaaaagagttcaaataaaatcaactgcaaaaacaacagcctttccttgaagcctgcattaaacacttatttcccttggcttgctgagtatacccgtactcacccttgctctatataaataatccccccagttgctgaaaaagatgaagcggatcctgctgatgatgagttcttccaggagcaagccggctacgatgagttttagggtttcggcctagttcccaagtcgcgcctgtgttggttggtcctagtcctggtttccgtttcccttttgtaatgcagttgtgagctcgggatctgtccgtagcccaacatgactgtatctctactctataataaagagaccactgttgctgtgatattctgtctccctgtgataccagcactgtttcctgggacttgtatcgatcaacaggttaatttggagcgtcacgggctagttccggtcgggattagttcggggcgtgacagaacagggctattttcacatgcgggcttcttaagacacatcaatgcgaaattacccctctctctctcccactcccacttcaagtccactcctctcttctccccactcctgccactccctctccctacctctctccctctcccaacaacggtgggcagcggtctcaagcgatggcaggcggcagcgttgccattaaaggatagacttctctctagtctctaccctcctctctgtctactcctcggcttctcctctcctgatggtcaatgggcatgggatccacaaccaccaactgaggagtggtgggcagcagggtggagggtgaccatgacgacgtaccagatacgtcggctacaggctctgccggcgcggatccagcagcgatgggaggtgatagatcctgtcgggacgaatccaacggtggcagatccaacgaccgcagctcctgctagggtgggtccaacagcaccggtactgggaggcggcggatccgtcagccgcagtcctggccaaggtggatcccttctgcccctaccactcttcatctcctcgacggggacgacatctatgaccacgacctccttctcacgacgacaacgggcggcggcgtgggcctatcctgagtggatccagcgggctttgggcagcgatcgagtggcggagaatctggctagggcttcgattttagaattatttttatttttgcagggatttttttctttttgcatacgggcggcttaactgaccatccacgaaaatacaatttctgcatgcggctaatctaaacgtatgctaaaatactgattttcgcagacacttgggtgtaggtgggccacccacctatctacgaaaattgattttgacagcaaggaaaaatcgattcagtagcagtgtcatagtaatccccacctccaccatcgcactgccgaccacctcctggtgcctctccttaagctatagccatgccgctactctccctaccctagtatttgccatctaaatttatgaaaaaaattgttgtggttttgaaatttcgaatttgaatatgcatggttgaatcctaagcgttagatattcatatttgaattggtgtggttgaattgccacatactgattaccttggccaacgcaaccgcatacaaagcgaagaaattaaaaaggacaacgatcgatatatgtatatatacaccctaattaattttaatcaacttaactattgttccattagtttgatctggctaactaaagacgaagacgatagtcaagcaactgtagtatcgtaaaatgtctctcacccaaaaactaactaacgagatgatgggcttccctgcttattatatattaggtatcttgcccttcactagtaaaaaacgattttcctggacgaagagctatttagattacagatggaccgttttcacatctgcacgtaaaaatcggcctcccattttcgcttgcggacccttaagaggcccgcacgcaaaatagcgatttttacagacacttcgttgcagatggttagaagatccgcacgcgaaaatcacttccaaccacacggagaaatcgttgctgtactagtgcttccacaatcaatcaatatgagactattcaacagcaactagggccgatatatgtagcgctaagctatagctagcacaagacataaatttatatatggtgtggtcgtctcgtgtggccggccgggggcggtaggcgcgtagaaaaagacgggcgtgaaaagacggcgggtggtcgcgcgtgctccgggccgccacccaccagacatgtcctctcaacccaacccctctctccatcttctcttcttctattcgatcgttatttgttagttttcccggtcgccaccacctactagctgctgctgctgctgctgctttcaaacgccgatcgaatgcatccaaggaaataatcctgggctatagctagagcgaattcgtcgtcagtattccgtggaccatgcagcagcggcagcatgcatccacatccgtttcatgcactagcgtttgtttcccgccctccccacgctagcgcggtcaattctcgcctggccatcatcatgccacaccaaatgtttatcttatagtatatatgctatatacatacaaattaagttgtatatactcacgtatatctctactattataaaaattgatgttatttttaccggtattttaatacgtcatctgtttatgagtcagtttttaattttgttcatttttggaaacgcatatttgtatgtgagttggtttctaagttcgttcatttttagaaatacagaaaggagttctaattgcagctcataattttctatatatatatatatatatccaacggaatttttacagttaatttcatcttactaaaccatatataataataagactaaaatagccttcacccgttgtaatgcacgggcattttttatagtatataaacatatataccttgtgtatattgtttgaattggaacgaaaccgaattcatttatatgggtacacaagtacttcaatttacattagtatctccctttatgataaaaaaccattaaggcaaattttgctacaggacatcacgactttgtggttttagctgtaggacaccgcgtgaaatgacttttaggggaaaacaatatgtaagtgtagttatttgccacgagacaccgtatccattaaattagtatttttgtgctgacaaggctagaaaggggccacttttttacacatcatgatcgaattgcccctcttcctcttcctctctctccctcctttctctcttctctcttctccggcgaggtgagtggcagtgcgaccaccagagccgcagcagcacagggaaccactcctcacggtgccacccaaacgtgaactgtaggtacgccgcgagcagcagccatgccactgcgtgcaccgcctcgacaacggcctccagtagtatgttcccggcggcgaggaacaccgcgatgtcgctgagctcgacgcggaggtacaagaacgagtcaccggtggaggggatctcgtggtgagcagaggtcgacgcggagcatcgggggcaccagatctagcgcctcggctaagctcgaaccaaggagagaggggggcaggtgacgacggcgaagacacaactgccgctgaagaggccacagagctccctgccgccgctgaggaagatgaagatgacaatgacaacaccgcatcgatgagcaacaaccgaaggcggcgagcagcatgctggcctccgccgcctccgacgagcggctcccgaggcggtcaaccagccgtggcacggtggccgtgagcgcgccgtcataggaccaccagctcacgaacgacggctccaggaagggctcgcgagcggcgatagtaaaggagatagagagagaagagagataggagagctaacatgtgggcccaagggtatttttgatatttcatgtgatttctctctcctcttcaaccggaaattattattttaatgagcgcggtgtccaccagcaaatatccaacttttgagagtgtcttcccctaaaagtcactttgcacggtgtcctacagctaaaaacacgaagtcgtgatgtcttgtagcaaaattaaccaaacaattaatactgtctatgtgaatataagcttgtacagtatcatgcattctagtttttatgatcgttgagaggtaccaaaaggtcccaaacattttagagtaaaatctctcttgagtgatataagtcattttagaggtggagttggagctggagctggagctgtgccaaacaggccctaagtcatgataactcttggcaccttttgataaaatccctcttgggtgatataatggattgatataattaatgtgtagtgttcccttttaaataataataaaaaacttaaggtttatgaaattttgagcttctacgaagactaaggttatgtatgttatactatggattatatatggcatactttctaaatttctgaagggcacgatctattgcaaaaacattcttcagcaacattacttcgaaaactctttttaaatccacttttcatatttttctaatatataacttattcgtttctatactctcgaataactgtcataattaaccattcagcactttacactctatagaaaactctctagacgtcgagaatcaattggggcctgccgacgatcgaactgcatgcaagcgaagttgaagaaccctagctagctgagctccaaaccagcactacctaacactaacagccacacgtgcgcgcggctcgcattcagccagggttggtccaaattaaagccaaacagtgccgagagggaaaatgactgtgcctagattccattacgatccatacgatttgctgctgctgctgtggtaggcgattttgacactggccaccagcagagcatgcagctgcttggccggccacgggcgcaggtgcatgggtggtccttcttccatcccaatattcctcaagcgatctgcagatggtgatgctactgatggcgatcgatgtactccatcacaccgaagaaaacaaaattttacagcgcacattcagctagctcagggtcagagtcaggggcatatgcttatatgcatattgcagctgcaaacaaaacaatgctctatcgcactactggtgtgtactgctgcaaggacattcagtagggtgcgtgggggctcaaacgccggtcgtttatatatgggtcccatatgtctgcaggctgcaggtgtttataattcagctggggctttacctccatggtattcatagttggtagtactccctctgtttctaaataacatatttcaggttgtttagcaaatattaaagatattataaaaaaagattccctttcgacatgtcctagtgataaaattttgaattttgaattattgcttatattctccttccaatcatcttgttggttaaatttgcagagggtacactgtgaaaacaatatgatgattgatatatcacactgaacttagtaacaattaataggcatcaattttcatatattcatagggcgagcatgtacatgtagaagacaaaatacccaaagaccactagcgaagctagaaatgttcttctgatccagagatctgcttatcttacaagagtgattttggctcacaaaaatgggcagattaagcaattcctgctaccttctctcataaaaacctaaaaactaggatagattaaaattttcaacagtagggatggattaaattagccctagttgactctgaagagtatgtaagtgggtttgtagaaaagaaaaaacaacaccctttttcctgtcatagtgaggtcaaaattagttgtgtgccgcgtgttcattccatggtctcagatttttcttctctccctggggaatctgattaacctgcctttttggcgcctgcatatccatgaagtggcgatcgacatgagtatgcgtaaagactaatcttggatgttagcgtataaggtcagagatcagttaaaaggaatttcagctttgccgcaagattcaatgcaagcccacacacactactgatgactactgcatgcagagctagctacacactctactagcggctactagcttcttcagtgtgctgagctgcatgtggtcgctttcatgggcacattgtttgctcctttgacattcttctgtggtctttgctgcacaatacctcacctttagtccaaatcacatccatatcactcggcccttttcttttttttttcctttttttttctttgcaaagatgtgatacaccaacaccacatcttgcacacacacaataagtggcatctccctctcagagatgaaattaactaatgcctttgtatagtacaatattgacttttcatatatagctggtaaatatcaatgctaactatatatgtcaaccacaccaacctcctcgatcgttcaagactgagagtcagagagtgtgtgctagcttctaaagaaattgtggatatggaattaacacatgcacaaaatatatacttttggaagtaatattgcttataaatcaaatttgtaataaataaaaattgattcttaaactaagtttaggaaaggaaaaccgtaaagagttgacatataagatgcctcgttgcaaccttttacctagctatagtaaaactagctaggtgcttttataatgtcaatactttttttaaagaacatatatgtatgtagcgagactacagtcgctatttactttagaattttggctggttggagtacggattatatctgagttgacacactaagggcctatttagttcacgaaaagaaaattttttgtgtcacatcggatgtttgaccggatatcggaaggggttttcgggcacgaatgaaaaaaactaatttcataactcgcctggaaaccacgagacgaatcttttgagcctaattaatccgtcattagcacaggtgggttactgtagcacttatggctaatcatggactaattagactcaaaagattcgtctaacgatttcccccttaactgtgcaattagtttttttaatctatatgtaatactctatgcatgtgtttaaagattcgatgtgatgttttggggaaaaaattttggagaactaaaccgatgtaagcgggcgacaaacaaatgcgcgaggggaaggaggatgtggggctttacaaggcttactcgaaaacgcgtctgaaattattggagagcatgatgacaagcaatagatggcaatgttgaaaaaatcttgctaaggttgaagtctccacttgagccactaccacaacaagctagcatgcttcagctcacttacctttcttttttccactgcgcctttcggattccactacatatgagttgagcccaacgacagagaggtaggtcaaaaacttaggtaaagattcaaaaatttcaaataaaagcacttccgaaatcggagtaaatccaaatccaaatgcctatcatgccttgtgatgtggaccaccactaattgttttgttttgacatgctaaagggaaactgaaaaagatagatatgctgactagctgctgaaggagatatttacatgggtggaccaaagttaactctcattctggctatgattggctccatgaccaacttgtgatcaattgcagagaactttgtttttgcctgaaatgcatcacacgactctaaacttggcatgtagcacagctttgtttgtgttctgttacttaggttttagtccctttttctgctgtaacatagggtgcatgcatgcatgtaacaaattagttgtggcatggaatcgttaaaagattgtgtcctggttaatttggttggcatggcttccctcaacagaaattcccatgatcgatcatgagaagcatgtacagctggaaggacaccaccaaggagggcagaatcaatggtgatttctcttgtagttgcaataatgttccttcctttatccttgtatgtgtgcgtgtggtatgtgcgactgcgagaagtaagactaaaggtcgtatgccgacaatttcaagattctgggggtgctttctttgttaaaaaaagttatatgtgtatagtacatgataaggacaatacttggagtatttccttgcttagtccaaaaaaatgttgattttgacttggcttctggacctccaaattgaaattgtattttgcaattaatcttcgccatttcatgcatggtaagcaagatttatagaactgtactatattaacaaagtatttttcagattttggtggcctttatgttgtccttttacttaggattagttcttttctcgccctagggtctgtgggcatgtgcgccatgcctttgtctttttttgttttactagctaaatacatgtactttactacgggtaaaaagggaaaaaatcataatattgtctaaaataaatgaaagcatatttttcaggaaatatgttggccacatttttactatagagaatacttaccttagtttaattatatatataagctatccattcactagtggagaaatcgtttttagtcctgattcgtaaccccctatagtcccggttttcacaccggaactacgaatccaggactaaagatccctatctttagtcccggttggtgttaccaactgggactaaagatgggagtgggcaatagttttttttttcatttacttactatttaatctctaatttattttctcccaaattaggtgagatgcgtaccatcccaaatacacaaatcaatcatatacactacagattatacatcccaaatcaaaccccaaatcaaagaaacatcccaaatatacaaatcatacacaaatcatgtacatctcagatccatacaatgagattccaaaaaaaaattatacatctcaatccatacaatgaaccatagattcttcatctcaatctacacgtggatcacaaattctttgaaaaaaaaaagaaaaagaaacgaagcaaagccgccggccagctgagccggctgccgcctcccctcctccctggccgccgccgcgttgccctccaccggccgggccgcccaccccctcctgctgcgcacactggatcgagttggaaggggagttgggaagggataagaagaaaaagagataaggaggaagggaagagataagattaaacatggaggga

SEQ ID NO: 18222 - DNA, 9977 bp, Oryza sativa
  unsure (1)..(9977): unsure at all n locations
tacgctttgatctttaatcccggttcataacaccaaccgggactaaaaatcacgtgagctttagtccccgctggtgttactaaccggcgattactgatcatcgcgtagggtcattccccttataaaccgcgactaaaaacgatctgtagcccccgcttttactgcatccgagactgttgcagtacttggtagaccgggcaaagatggtttttctactcctgatttaaatttaattgttatattaatttatgtgagactacacattcattgccatcacaattagtcttttttaaaggagtatagattttgttttggttgtgtgtgtacttcgtgcagaggctggtctaggtgtaaaatggcattctcttaattatttaaaattaaagaaagaattactttagactgattttgcatgtttaggtatctatcttgtgtgcaatttcattgattataacacatcaatggtgaaggacttgaaatgttctgacagatgcaaataatcgagaaattcacttttgaactggaatggtatatatagtttacctaaaaaaataaaactacaaaagaaaataaggaaattataatccatgttttccttattctcaaaatggcatttgtttttttcatgtaacatcaagattactggcctacatccgctcctattatcttatcaattaaatttaaaaatataactagcattgccttcgtatcttgacttatactccctcttaatatatggagtagtttatttttttaaatagatttgaccatttattttattcaaaaagttatatgtaattatcatttattttattatgatttgatttatcatccaatgctctttaagtatgacttgttttttatatttgtaaaaaaaataatttgagcaagatgaaagatgaatggttaaacgtttgtcaaaaagttaacgacgtcatatattaaaaatgggtggaggtagcatatctttagtagcgcgcatgctctccccctctctctctctaacctcaattgacatgagagaataagttaatcctaagccctactttgatcttcctcttgacaaggtaaacaacaccctgagctagagcgctagcgcgttgtttatatatgctcatgcatgcgtgtgcgttgcaccgtgcgcttgcaatgatgccacaaatctccaggatctcaggcgcaacaaattgtaacggctgatatatatgtgtatgatgcatgcatgagcggtagggtcagatgtgagagagaatccgatgataaaacagccatctgatcgaaaggtgatccatggcacattgcagctttgcctttaatttgtcttttcttctgtcaatcacacaccacatttatattatcatgcattaatttcaaatatctgtagttaaaagtcgtctcactacttaaaacacataatatatactcaatctgtatttaaatgcataacattgttgacgctattaataacaatatataacaaaattataatattgtaaaactactatatataaagaaaaattgatctaaccatatgaatttttacattttcaaactaaatatttttatagttttaaaggcaccactgaatatatactcagatgcatatatgcactaaaatttttcatgtaatttttgggggatgatattgtattggatcctattatgaaagatagtgtattggatcctgttccaaaatagcaaaatattatataggtaccaagtacatgttagatactacatagatatcagttggttcctacatggttcagtcttgataaccccaatattagggattcggttccagtgcagtggccactgtgactgcaagttaagcggtcataagagcatcattggatttaaaacagatggcccagatagcactgtagcactgtagcgttttttaataaaatgtacggctctaattttactgtagctcacaatttagattattggatcaataaatagagggttgagattgtgtgcagttgctattgtgccgtcgcaatagcaactacactggatctcaattccaatattaggtttaaggttagttcatgtgataccaagcatgctacccttggtagtaggcatgatatcctctttgtatcaggctaatacatatttagtgtgaagctagatccaagaaaaaaaaaacttattggcatagacgatgagacatttgaataaggacaagatctttgacagtacgggtcatggcgcctcgtgccccagcaccgctgtgctatatataggttgttgtagccacgcttctctgtatctagcccatcgctgatagagtcaagcagtaggggttccgacagccagacatcgtagacaagatcctccatcgccaaggccaatgaccccctatatgagcccctccaccgccgacagtggcggaggtagcgtgggggctacaggtctttagacctcctaccccctaatgaaccattagaggccccattaagacccccccctaaaattaaatccatatatctattacaaagaggctaaaatagactttgtccgagattgttataaggtccaaaaggctgaggagcccctactataattttatcatagctccgccactgaccgccaaggtcaacaacctcctggacgagctcctccaccaccaagccgacgagctcctctgccgtggcaaagtccatcatcaaaccaagagaaagaggaggcttctagcggtgatgtgtgctcggtggacggggatatggccatagacggtgacgagcagtgtgccaaagcgcatgtggaggagtggaggagataccgtgtgagggccactagcatttccgatgatctcactgtttttcttatacttatacttataagctaaattttgaattttaaaacttagttttgaatttgagtttttgggttttttttcatcgtagtttatattacatcatttgcctttgatcgagtcactaagggcacatatataaatgttttacttacaaaatatttttttaataagttatttggataagcatatgagtaagcaaaacaatggggttactagtatgattaattttggccaggcatatgtccaggggcagagagataggagtagggcagctagggttgcaagccctactcctgatcctaaatattcattgattagaaaataaaggaaaaaactatataaattcaactaattgagtccggtttaaaaaaattatggctccgccgctgatatgcctagccttctatagctggtcacataacagccttcattttaaccggacttacgataaacagacgactgaactcctaccaaattttcatgcagtaaatagatgtcaataaggcatgcagtaattaagtagcaatagtagtaatccctccgtcctataatataaggtattttacgtttttgcttgcactgtttgaccacttgtcttattcaaaaaaatttaggaattattatttatttcttttacttactttattatctaaaatactttaaacataactttttattttttatatttgcataaattttttgaataaaatgagtggtcaaatattgtaagaaaaacttaaaatcccttatattatgggacggagggagtccagtacactaccactgcattcactctcacacagtacatatatacttcctcactaagcatacacacacagtacatatcgctggttaattacataaccccagccagccccaacctgaagatgaaaactagttaaagcttgagatgtctacagatgaattaatttattcaattaaaagatgatgaggacagacaaggacaaattccacagtaaaccatttggtgacatcaccctcacgtacccatccatcccccctccttttaaaagcccccctcacacccacaaactcctatccctctctccttaatttacttctccctcctccatttctccttctcgatcctcctccttcggccagccaccaccacgcgcatgcagtgcatggcgcaggagggctccgaggcctccgtcgccagctcgccaccggcgccgccgcccccttcctcctcctcctcctccgccgccgccgcggcctcctggtggcgcgacatgcaccacccgtacggcgccgcgtcggcgccaagctggctgccaccgccatcggccacggcgccgcggtggcctccgacgatggcggcggcgcaccaacaccaccaccaccggacgtcgtcgtctggcgccgaggacgacctgtcggcgtccaacgccaccatcacctccttcaccaacacctccaccaccaaccactccggcctcagcatggactcctccggcgaggccgccgccgccgccgccgcagccgccgccgagagccacctcatctggaaccaagtactcatgtgagtagagtacacgtatatagatgtttatttgcatatatatcatataaaacaattaattacatgtaagtatataaatttgcatattcgaagagggcgtgaaaagaaggcatgcgtccactaccctttgtcccaatgcgtccaaagcgccctcactttgcctagattctaattaatttaaagaataaatttgtgcatgcatctctctctagctaagctagctagctactgacatcaatccctaataaccctgcttaattcccagctagctaggctaataaaaaatgaattaaaaatggaacaagaatatgtgcaagtatattagaagtgaatatatagtatagccaaccaagcaagatagctagtttctagtactagagagatagagagagagagagagagagagagctaaagcaaagcaaagcaaagccaagccaaagaaaggagcttttcaaatagtgtgtgatataggggaggcttacatgtgtgtctaggcatctattatgattctttggctataaggttctctaattatctctctctttctctgatagattttttcctagctagatagataggttctttggaattggaattagcatatgtgagatttcttgcatgggataagatttccccattaaagaactaaacaaagtaaattccatggtgtaatatatgcatgcttgcatggttaattaaattcgtgcctagctatctaggctttaatttggtagaacaaacctctaggtactctagcttagcaatgccaaactagtaggctgattagagataaataattaagtgcagaagcaagcaactactaattgcaaggatttgtttggtacggatcccaaaaaaagtggaaccatatcaacagcatccatgtctccatataacttgcaagtactttaatcccaattcccaaagatgatccctctctttacattctccacatgtgtactagctagctaaccagatactttaatcgattgcctaatgatgcaatggattatcattagcaagcataataatatgcaattatatatatgtgcaactcgatggctagctagcttgttcacttcagctcatatatagctcatctgttcgatgatggccaggggcgccgccggcggcgaggtcgggaggagcatgccggcggtgcacgacgcccacgacgacagcgagaacttcctcgagctgctcaactcgaggacgctcgcgccggagctcttcgccgagccgccggcgtgcgactacctcaagaagatggagtacggcggcggcggcggcggaggagggggaggctggcccnancaccactgcagggcggcggccgcgctggagaagcacctgagctccgccgccgccgctggttacggcggcgcgctggcgcaccaccaccacgccgcgggcgcgccggagcggctcacggccaacctctccgacctggtcagcaactggtccatcgcgccgcccaaccacggccaccacgtcggcggcgccgccgcatgcgataacccagcggtggccgcggccatggcagcagcccacggcggcgggaacgtgaagcagtccggcagcagcttccttgacagcggcgggggcggcggcggcgcgatgctgcagcaggagagcagcagcagcacgggcaccggcggcggcgggcaggacttcctgaggccgatggggcttgccgccgggtcgtcgtcgtacagctccatgctagggctgagcagcaggatgtacggcggcggcggcacggccaccatggacgtgccgtgggggagcagcaatgccggcgcggcgaggagcctgtcggacctgatatcgttcggcggaggcgcgatggccacgccgccgccgccgccaccgtcgtcagcgccggcgaggacgtcgtcggcggactacaagaagcagcaagggcagcaggagatctcgtccccagtacgtaatgtatatatacataatatttctatccaaaatgtattacgccgtcaactttccatataacgtttgcattattgatcttattaaaaatttagtacaaatatataaaatttaagttaagttatagttacattaataaaagaaaatcataccaaaataaataatatttacataatatttttaataagacgaatagttaaacggtataaaaaattcggtgacacgaagggagtaatatatatggttcatcgccagtgatcgagcgatgcacgcactgatgatctgatcatatacgtgttgcattcacacgcaggtgaagacgagcagcagcggcggtggcgggaaggaggggaagaagaagaggtcggaggaggcggcagggtcggaggggagcacgaagaagtccaagcatgaggccacctctcccacctcttctctcaaagtatgcccccatcatttagtatgaatgtgtgtaaaatattaatcattcttaaaattcttcaattataaaaacaagtaatatattataaccaaataaataatacttgcgcaaattttttttaagatgaatgatcaacagtaacatatatgaaaacagggtagcacaatttgttcctagctcttacgcatgttgcactggttgtccttcacgtgcatgagcaaattgcaagttgatcattataattgatcagtcatatatgcaatatacgcaggtcagatgatggggtttaattaatttaatttctgccagaacaaattaatgtgcagtgattaacaaagtgaactctacaaattatttgacctaaaataaatataaatatgatgtttccatcgatcaattatccatcatctaatagtactatcctgtaggacttttctttttgaaaaaaaaagacattaaggcatcgtcaagaacataaattttacatgtatcagaatttccatagaaatctggaaaagaaatcccatgttttgaggagggtattatcctgagaaatcggagtgttgcatgttttcgtagtagtgcaagctcatcgacattgttacctagtagctcataccatgccagcatgctgcaggcctttatttgtataacagtattcctagaaaactctttgcaagttttttgtccccaaaactttcatatatatacttgtgaccatcagatcgctttgaggtttgtgcatgaaggaaaaaaaactgctagaaaaaaaatttcagacatgtcacccgcaagatcctaatgctaaccagccaaaccatagttgaatataggttttatataagttatatcataattatggtgcagttatagtgtaattataattacaattacattgtagttacagtgcacttcaattatactattacatctcagaaaacttgcgacagtttttgtatactctctttgtataatgcccaacgaacagatgaacagcttacttagaagaaaataattaacggttgtcaaatctcctcgcaatgacactcatgcattatacattatatacatccttactgaaaaattagcctgtattgtaaatatacatgtgtaagcaattatctctacgtacagcagtgcagcagtacataaggtgctttttatatagcttttatatatctatcttttaggattgctgatgctgcttggtttaacagtcgcaggtaccaaaagtaaagttaggggacaagatcactgcactgcaacagatagtctcaccatttggaaaggtaaagtccgattccaatatgtacaattcgttgtttttgtggtaatttttacgtataaactaaaatgtggtcaaatgatgcaaaattttacaaatttatactaattattcctatactgatgcaataagtttgaagagaggggggggggaattactcactcctgtacaatatttaatgatctgttgacatacgtacaatttaagaaaaattatatcaattcattacaaattcttgtctgttttttatgtgttcagttaaacttacagattatacataagttacctcaaatatggatcccatctgaggaacctaaaatttacttttttaggtgacctataacatttatatttttatgtttgtgaaatcaatttctttatagtgaagtttgctatttatgatctgtttcagactgacacagcatcggtgctatatgaggcgataaattacattaagtggttgcatgaacaagtgcaggtaaattgcagaaatttttttctatttttatttcttctcaaatgcaatatatacatgtggtcactttttaggtcagtcctcaaacataattgtaaatatttagaaataaccgctcatgattgtcaaaagaaaagggtaaagtcaacttttggctctcaaactcctcttggagtccaattatcccttatacataaaagccaattattgctcacggttaactttcaaaaccaggcaaataacacctcaaaacttgtttcatggtggttttgattgatatgacgatagtttttggtaacacgaactcctattataggtaagttatgttgatgtaaacctaactaagtgacatccacgtcaagaaaacatatatagtaggaatttgcactagcaaaaactaccatcatgtcaaaaagaagaagaagaagaagcaatgcatgtcaatagggtctagctagtactataatgcgttatttgtttgggttttaaagtcgatggtgaaaacaataggtatcattttagggccggtgaaaaatcgacttttaagactcaaaggccaaaagccaaaatttaccagaaaatacttttctttttttgtttttagaaattcctagctatggaatatactgtaaagaatgtggattagatcaatagctgtgtttcccctttttatgttacgagaagaaagaaagtatgggcttagctttgtgtcattgcctacattttaatttggtaatggagaactttacacaacctttttatgacttgtgtaatataatgaatgcaattattgctttgtcaaaaaggatgtttttaagaaaggccccatatatatttgatatttccattggaaaagccgcatctaattaagattatataagatgaattgctgcaccaccaattattgggagacacgtgtcgaacctgcaaagcctagctcagctcatacccttcctagagggcccaggatagccttccttttgttcgtattttgcacaacatgagtgttactagtgctgctgcttttgtgtaatggaattctttgtcatggccccgttacacacaccctttttgcagttcggctctatcagttagttattcattatatgcaacatggaaaagtttctaagaatcagtttgtgcgaccaactatatacaatttaatttgactccttatttcatgcttaattgttgcagttgttgagtgacccatacatgaagtcgagtagtagcaaggtaagctacaaaccttcttaattgtgcactcctccaccaacatataattttaatttaaatacatgtatatgtccacgtcgaatatgtccatcaaacttaatttctagctagctatagaattttgatcacactaagggtcaaattctacatacgctcactccgtcttaaaaagaatgcaatttctgcattcaaattgtacatcagaggggctgcaggaat

SEQ ID NO: 18223 - DNA, 2085 bp, Oryza sativa
cagaggttgacttgagaagtagagggctgtgcttggtgcctgtctcctgcacccctcaagtgtacagagataacaatggcccggactactggacgccaccctatagaagctgcttataccgatgaatttattatatattattggtgttcattgtttattattattaattactgaataatgtgtggtggatataagattaattattagaagaaaaaggatattcatagccaagtaagtttaattaattagagctctatttgtgtacggccacaaattagttgaactttctcaatgtatcttcagctggtttgttgttgatttgtaggtatatatggttcgtgtgatcagcatcgagctattaatcgattgctttcctgtactgatttaaccttttttttttacttcggagttatttgatcaatttaattgagtgatagttaagtgtatatattgtttctttatttgtgcatacgatacagcacaggtggatactagtatgccacacatgattcatggcttcatgcagcgtgatgatatcagtttatttggggcgccctaaaatatgcttcgccactttcagatcatcaaagggataaaattggtgtgtggatgcttgatttggacagtttacggatacgaattatattcacctggaaatgaacttaattactccttccgtttcaggttacaagatgttttgattttggtcaaagtcaaactccttcaaatttaactaagtttacagacaaatatagtaatatttatattaccaaattagttttattaaattaataattaaatatatttttataataaatttatctttggtcgaaaatattactattttttcatataaagttagttaaacttaaagcagtttgactttaaccaaggtcaaaacatcttataatctgaaacagagaaagtagtcatttattttttaaccgagtatggatgcaacaacaatattatctagaaaaaaaatgtggatatggattatcaggagtttgacgcactactaaaacaggatttttttttcatacaaccaaaaacgatcttcgcaaggggtcgaatagcctgcctacatacaagtgtatgtggaaacagcgcagtagccggcctaaccgcatgagtagacccattatcgtaggcgggcctcttaacgtagctgcctacgaagatagattatcgcaggtggccgcattaagaggtccttcttcaataatgagttaattttcatatgcggcctatataactcatggttgtttgggaaaattacgcccgctatctaattttgcattccccgttagttttaatcgaaatttgaaatgctacacacaggatctaaccaagttttcgttcttagcacagcaattagaatctacaataaacaagttttcaatatagaaaacagaaaacatttatatacgtataaacatgtttgtcccatatactacaaacgatcagtgatgtcaaagcttatatgaacagtaatgtgagagaagaatatatgccacgtaaattgtttttttatgtggaggcgagagagtggggagagaaattattgtttgttaattaccaatctatctgacaaagtggcaattatactctctatataactaaatcactataattgtagtatgtacataacttattatacggttatctgtatgtttaagtataacatgaaaatactacatacagcggccctctaaaccattgttcccattgttcatgttgttaactcgtaggcttatcttactctagcctgaattttttaatttttttagagagagggaattcagaatatttccattaacaacacggtagaaggtgagtcgccggcaacaaccaaatcaagcacacgatgtttttttttaaaaaaacaaccacgagatagtggtgacgtttctattgatatagcagggaaaaaaataaagtctatcgtattggagactatagtcaggaaaaaaaaaagacaaacacaccacgcgtctacgtctgatcctattgctaaaacagaacaagcatacaacgctactatgggatgggtattctaaacaatgccactaagcaggaaaacga

SEQ ID NO: 18224 - DNA, 6924 bp, Oryza sativa
  unsure (1)..(6924): unsure at all n locations
taggttcttccctaatattcgtgaagacatgtgcgcgttgcgggtattttgtttttcttctcaccactcatcttcttttatttttgaaacgagacagtagtattagcttgcaggtgcatatatgtgacaatagttgctgaaaatgttgacatttttcttttgcataaaataatttatttatctctgttgatttggcggcacagtttaaaaagtttaatgttccaaaaaatattcatgaccatatatactatttgttttcatttttatatccagggtacattagtatctgtatcaaaaaaaaaagaaaatatatttgtatctgtatccacacaaaaaaatgtgagagcaaataattattctttacatctcttctctaagaagatagctccaaatagaacatttcctagtactacatatctgcttgtttgtttgtccagatttatagtactctgaaatatcctatttggtcctaggtttttatattttaggacggatgtagtatcttgaataaaacaaaacaaaatcactaccttctggagagagatacctcatctcatgaattactggcagcatttatgttcctcgttacgccctttgtatgctccaggtccaggatgttgatccttgttcaaattcatgtattccagtttccagatgggaactgaaattttattatgcagctcttcttgtgaaagctataagcaccgcaaaaattatagctatgatttacaattaatcatgtgtaacaacgtttgtaaaccaccaactatatatcttcactgaatcagtaaacttgtcaactattctataatatcaacaccggctgctgattgtaatatcacttctgccagactttctgatctggagtgaagtcttacttgtcagtctcttacgactcgcatccatagcgtagaaaagaagcacgcaagccaacagaacaatcttcattctttcttgtaaaggtataattaactgacaagactatctgacgatccagtattattgcagcttatgccaagttggataaagaagcatcacttggccttagtgagaagcagaccatggaaacatgacttgccaacataagtgaaagatttgatgttcaagataaaaccatactacgtaccaaatgattttatagtagatttcaccagcaagctgacagtatgatggtccattatattccaaccacggctgaccagacaaaggtaatagcatgtctaatggcaccaaaccatcatatcacagtgctgaaggtttcctagctcgggtcaatgacggtacatatattctgtaacgttgtcaaggataaggagtgatagcctgcgagctcagtcgagcaatatctgaaattcaatttcctcattttggataagacgtatctagtctctgttgttcgctgaggggatcaagatacctcaagtagttgagcattgcactccagaatgtctgcgccaccaaagtcgtgctctccaggatgttttgtcgcctttcgataagatgaactagtgctatcatatatgttctgtcagaaaggcacaaataatgaacaaaggagtactccagtgtcaagggcagagatactgtcgctgctgatattttactaagaccttatccaactccagaaaggcagagaccaactgacaacaacttctggcagaaaatcaccttggatcacttgcagtttccatgaggcagctgtcaacactttgcatttcgcatggagccatgggcattctgaattcctttgcagcacagataacaagttatcagaaatgttcatcggatgataggagggcagtggaatactggaacgaatttctgtcagcattgttgacaaggatgaaggataagttaacagtcccattccatcaatatctgcaggaaattgcatgcaagtctcagttgtagaaagatctaaaggaaatggcctcatttaacatacaaagcaatgaagttttctgcatcttccatagctcccacatgtatttgatcgaaaacactatttagaaaagctaaaactagaggcggacagccaaacaacagcaacagataattatggttatatgactattattgaaaactggtaaaagccataaagaaattggttgaaaactggtcaaagccataaagctgttgcaacgatactatttgcaaaagggaaaaaaataatccatagttttatggatcttataaagtaattttgcctatatgctgtcaatcgagatcaatgaggaaataagtgaactgcacttaaagaaaacaaagtattaataacagaagacattaaagactgaaatatctgggttatcaaaatatagagacacttacacagtattttgtatccatcttgcattatatatcttcaattgattgtctccaatcagtatcatccagtttcagagcccaaaacaaagacaacttcaccttgtgagcatatcaggtgattgagtgaactgtatcagcatctcatttcttaactgactgataagcaagaatattgctttcattttccctgcaggaaaccacagttttatgtagggtaatatcattgttttggtgtctgagaaagccatttgcacttctaagacctcccggcattccatattccccatagcaagttgtcaaatggatgtaagtagctgtgtccggtttcagccccaactcatgcatctgcatgaataaactgaaagctttatccacctccccacaggacgcataaactttgaaggcaacattgcatgcacactgatctattgtcaacacaggcttcatatatttctcgcaaatatttaatgctgcagcatgcatgccagctatcaaaaacaagaaagcgattacagcttgactagaagagctcctgttgtcattatatgctgattgtaactgtgaaacttcctcaggtgcaatctggattttcttcattatagaaaatatcattccaaacgttgaggcatctggcaaaatgttgccttcctgcatttgttgcaccaattctgcacattctcttagcttgcccttggccacaaaacatgccataacagcattgtatgaagcacagtcggatagtaagcctgaattctgcaagtcatgagcaaccctaactgactcattaagcaagcccatgttcttgtacagggatatcatgctagtatatgaaacatcatcggcctgattatttctcctcaaacagtcaaatatttccttaaccttagtgaccatcccaagatttgcataaaggtttagcatggaattagaggcaacaatatcagggccaccatccatgctcttcatccttgaatacaaatcttgcgcttccttccagcaattggctttactgtaggccttgataagagaagttaaaacaatttggttaggagcaattccagattcttccatcaagttgttataatgcaatgcctcctctagttgccctgtctcagcaaatgtatcaatcagcacaccataaacaaccacatttggctcaacacctgaggccttcatttcattgtacagatatatggcttcagataccaaatagttgcgggagagagttgtaatagcagcagcatatgtctcgcactttggtttaaaccctgcatatttcattttacctaacagcttcttagccctctgtggatatccacccgtagcaaacatctgaactaaagagttaaaggtgcactcatctggtgaaataccagactcattcatgtgctcaagtagaggagagactctatcataccgttttgctgcaccataagccttgaccatcacattgtattcaactatgcctcttctcctaactcctctatgagagtagaaaacatgttcggcttcctcccataaacccctctctgcaaaagcatccatgatggcagcaaatgtcttggaagagacctcatcacctctgcaatgtctatcgaagaatgcatttgctttatcaagcaacccctgatcaatatacatcttcatgacaacaggcagagactgttcaggaacacaagtcccagacctcataatccccacaatcacatcttctgcttcatgtaccatctttctctcacataacacccggagaacaatcccatagctcacagtatccgcagataaacccattttcccaatatgatagtagtgcttcaaaactccctcaacatcacccttggatgcaaacaatgtcatcatcacattaaacgtcttaacatctggattagttcccctaactatcatgctagcaaacagtgcctctgcctccttcacattaccacacgacccgaatatgttgatcaatgtattgaaggtacatgtatccgccgcaaccccataatctggcatacccataaacatgtccatcgcatccttgagcttcccggccttcccgtaaagatcaatcatcgtgttatatgtgacagcaagcttcggaattctagcaactccctgaatgccagatgcaccagcatcgtcgacattgccatggcacatctcctcaagcaagaactgcatcggtccacctgaatcgagcgcgctgtagtcaagatcaatgaacccaacctcgaacctgccgttgcaccagttatcgaaaagagtggccgcgtcggagtagcggccgacgtccttgaggatgcggacgaaggtgctcatggaaacctcgtcgggagccacacctcgggcgcgcatgtggcggagcagcaggagggagtcccgcgcatggccggccttggcgagcgcgtcggcgagggcggcgtaggcctggttggtgggcgggggcgcgccctcgcgcgccatccgcgcccacacgcggcggagctcgccccaccggcgcgcgccggcgaggtggcggaggacgacgccgtagtggatggcgctgggcgcgtaccccgggagcgcgcgcatgcggtcgagcaggtcgcgggcgcggcgccagtgccgctgccgcgacagcagcgccgtctgctcgcgcggggacatggtggcgaggtgctcatcggacggatcaaggtcagcagcctctcctgcgccgccgccgccggtcggggtggggacagaggggtggctcctggaggaggacagcgcaggcggagcggggagaaggtggggcaggtggacgcgggaggctgaggggaggagtctggactgtgttgcagagatcgatagctcgccggagacggcgacggcggcggcggcggcggtggtaggagtcaacatggtggtgggggaaaagggaaggagaaggagacaagagaagggaggtttaagtgtgtgggacccacttctcagtggaagaatctaaagttctttttctttttttttgagagagagaggggaaagtggaagaactaaagttatttattctttttttttccttttgttttttctgagagactaacaggcctgacgtgtactactcgctcgttcctattttctgtttgtcacgtagtccgattacaacctcactaataataaatctcaaatggtagaattaatagtacgacatccttttagcatttatatttcttctaaaaaaatattaatagtatcatgtgttaatcctttctttctataaacccaaagctgcctcctcaattcgccacgtcatcaatattatatcagccattcaatctctttcttccatgtacacgtcctcagccatccgatcgtttggctcactttcggtcaaaagcgggcgagatccgaggggacgcaagattagccgatcaagtagctgacgagctcacgaggattaacaaaaatcattagatccaatcagcactagggaggtcgacctgacgtcaggagtcattgcctgaaaccggtcgactgccttttccattacaagaatctgtacggacatgaaattaagttgtgccaagctatttactaccacttttattcacatttaatctcctttcctctcatctcacattctcacttccactcctccctgtcaaagcaccaagccctgtagctaacaggttgcaccttcatatcgctttgccatggaacatcatctgctgccgtatcactgttctcgattacctgacgagacgaggggtttactctatgagctctccgtacaaacatgccaatctaatattttatggtgttcttacttctttctgtttgagattgcagctgaattttctatgttagatgggacaattcagtaaaaaagagtagaagactgaggtaagttggctttgacacttcacattctaattaactaggtgaaaccccgcgcattgctgtgagaatttagtatgataacaattaaaaaaaataacgtgtaagatagctagataacatcagattaagtaaattaatgtggtttatgataatttaaatttaaatagtatgtagaatggtgattcaaacgtaaaaagtaaggtgatatgactttatggaagaagaaaagtagggagatagtttatacagtagattaatcatctaaaggctaaaaacaattgatgtaatatgacttaattagaggaaaaagggagaaagataatttggaccatagattaatcatttaagcactaactaagtgaggatgaactatataggatatcctgaaacataataaagatatacattgaaatattatgtgaattatgttggatgctaatttaacatgtttatatttgaaaagctcttaaattataaaaactataaagatatagcatgtttgcatgatgtttaaatgtgatgattgttagtggatgatgtggcatcgttgtatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18225 - DNA, 3084 bp, Oryza sativa
  unsure (1)..(3084): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnaatatatggcggcacaaaatccaatcgtccacttcagaatgttgtcttgtctcgtcttgacaacgacgttggatacgacaaaggtgtttctcatgggcacggcccagtgatagaggtaactgaggttataggttcaacccggaagaaaccctcctctcaatgtcgatgtttcagtgtattacaagtgtttttaaatctttcccgctctcttcttttaaaaaaaaacacgtcacaaacgcaaacgctcacaacgtttgtgcactcatctctataaacgcaaacacgcacgccccacttttatgaacacctatgaaaaactaggtcggcatatcttgcgcgtgcacacttatccctatcaacgtacatacactatacccttatgagcacctccagaagattgggccgtatatcttgcgcgcatagattcacccctataaacgcacacaggtacatcctacctccataagcacctttgaaagactaagccgacatatcttgagattaacgaaatcaccacagatgcctcgctgtcaacgggtacatcgcttaccattgaaagaataattagccataaatatgaacatccgagtcagctttaaaacttgaacttaggtggctggctccaccacaagggactaggggtgtcaatttctccatcggggcgaccctaaggggccgggggcaaggtggaattctcacccgtgggtagggggcgcaaacagagttcactccctcgccgtccgccgcctcgttgtgccccctcgttggccacctcgtcgtcgcaccccctcctcgtccacctcatcactgagccccctcgccgttgccacgtcatcgcctgcaacctcgccgtccacctcatcgacgactttcttggttaggttgcggggcctcggggcgggtactgattttcgccctgttcatccctcgggggccggggacagggatacccgcaagagcgaggggacgggagcgttccagcctaacccggccccgtcccggcccatggccagtttgcaacccttacaagtaatctaacaagttgagctacgctctattcttttgctatgggttggttacaagggcaaaaccatcattttgctaagcctagcactcgactaatataattttgtaaaatcttcattttttatattttttcaaatgaattttggcctctttgatttgtagagaaaacaacaaatattggaggattttaatcctaaaaagaaaatactaagaagtcttttgaaacaaatgatttaattatattcttcctctaaaattcttatgtaagggataattctatagagatttcagaggaaaattagcaagagctttaaccccttgaaaatatccttgaagtctctcactctcatttgattcttgtgttggtctaatcaaatgactatttctacattcttttgtgttttacaatttgttttgcacttgtatttcttatatttttgttaactagaaaaatacccgtgtgttgcaagttgcaacagccaacaggtgaaggctattttaatttttattattgttatatggtttagttaaggtgaaattcattgggggagttcgtttggatatatatatatatatatatatatatatatatatatatatatatatatatatatatatatatatatatatatatatatatatatatatatatatatatagagagagagagagagagagagaaaatcctgtagtaggagtctggtcgtctcaaattagcatgcgagtttttttttagagaaattttttatatgactccttctgtattttcaaaagtgaacgaacttaaaacccgacccatacacggatgacgtaccaaaggaccgtaaaaaatatctttaatttttataatagtagatatatttatatgtttttattcatctttttttttctgtcaaagggacgacggaaacatgcgcagggctccacccctgattagttaggtaatactaacttgctgtattttttcttcttgttatacatgtttggaatttatagtccatcgagtaaaggaatggtactgtcctagtttagaagtggaacggtacatataagattttcttactaaaagttttatgaacaattaaggacatgttcttttctttaactctaaacttcaacttactcatttatgttagcacgattttcaaactattaaataatatttttttgcaaaaaaatatatgtagaagttgtttaaaacaaattaaataaatctattttttcaagtttataataattaatatttaataaatcgtatgctaatgaactttcttgtttcacgtgcgtaaaaattttccctctaatatgagacgagcgcagccttagttctatttaattatctaatataacgtgttctcatccataccttctttcaacaatgggaaccacgtcatccccttttcctaaatcttaagagccattttgaatagtagaaatagaaaaaacattgaattcatatacgattgtaaaatatggagaaaatatagaaataaccgtttgattggaccgtatgaaaaacgtagaaataagatgaagaggtagactcaaagaaaatttttcaagaggttataactcttgctaagttttctctatctctattggatcttcattccatagaaatttcaaatgatacgataagatttaattctttataatctttattataaagatattcatagaaaattattttaataggattgaaatcctccgaactttctattgttttctataaactagttgga

SEQ ID NO: 18226 - DNA, 13209 bp, Oryza sativa
taacttggacttttattttttgctgcacggttttcttttttacaaagtttgagtaggactcttatttatatttgtccaatcaatctcaatggttaaattatagatctatcataattcaatggtatagatttttctctttttttttcgattaatgtggtaatatgtagccttcatagcaaatatggtgcctcctttcaaagatgcttcgggttatcattgagattttaaaatcgagcatgattatcattgttttttttactttttagaagttccgaacctttaaaaataagaccttgtagtttatagagtttattgccttgttgggttttattttttataatttttagaagtcccataaaacgatgcctctatcctcctctacggcacatccgccgcctactctttattatcattgtgattctagaaatcgaacataactatcgttagaattttttttttattttctagaagtcccatcaaccgttggcggctctgcaactatactcctatacaccccgctcattgcttctccttagtcattgagattttaaaaatcaaatatgatattcaacgggttttttttactttctagaagtcctggcaaccgccttgctcgtttgcttcacggcccgccgatcgtccctccttttaatcatcattaggatctatttggtgttttattaacagttttttatatgtcgtatcaaccgccaccactctactcctttataggcatgttacttaatttatctcgtcatgtgttttagatggtattttctttcaatagtttttatttttatcacaaattttagttatttataaattatattcctaattgaaatcttatttttctttctctaatttcagaatttatttttttcaaattttaattaatatcgtattgtgttctttttttttcaatttcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagctatcagacgtaagcgggcttggcctgggggaaggcgggacgttacaaaatggtatcagagccgactctcgcggtttcacgggcgcgtgtgtcgcagttgcgcaggcatggtgcgcatggctggtgtagaccgggagtggttacacagcatggcacatgcgctggcactagacacatggacgtggccaagagaggacgttcctggcctagggttgatcgacaggggcgtcgatctctcttaagggggtgagggtgtaacatcccggcctagggcttaataggattaatagaatactcatatcaacaagttgcaacttcttttccggaagccaatctccaaagaactccagggttaagcgtgcttggcatggagcaatttgggatgggtgaccgaccgggaaattcttcccgggtgcacacgagtgaggacaaagtgtgcagaaaagacatgtgttggtctgtgagggtagtctatgacctatgaaagccaattcatagcatagccgatcaggtagatctagcatgtatcggctaatactccgatactactctatactaagattttaaagcaagtaaataaaagtagttaaatcagataagatcggctgaaactccgatactaccctaatcagcaaccagaaagcaggctagagattgcaattctaagcacgactactctatactaagattttaaagcaagtaaaatatactaaacataagcttaatatacttatatgcgacaagatcttaacataaagggcagatttaacatgtcaatcaagcatatagaataaaagtagttaaatcagataagatcggctgaaactccgatactaccctaatcagcaaccagatttaacatgtcaatcaagcatatagaataaaagtagttaaatcagataagatcggctgaaactccgatactaccctaatcagcaaccagaaagcaggctagagattgcaattctaagcacgacttaatatatcaaacttaactgatgcagcattaagtatgaaaagaaaaacaatatctagacaatcaagccgctggaagtttcatagagtggtagatatatcacatagtctaagttaacatcattatctaacctaatcgactaccttccattaacagatgttagccgattataggttagatgaagatattatcaaagattatgtgagatatatgataactcgacgaattatatagacaagattagagtgtcataaagatggaagcactaatcttgagaacataagtcctcatgacaagttttacctcttgttgaagatcgaaaccgatgcagctcaacccgagagcacgaactcatcgaaataaaagtaaagcataaagggtggcgatgcgccgagattgtattggatgtctcctttttacatagggctcgggtctattatacccgagaaaagatacgtccataacagacatgactattatctctaacaaactctaagataccataagtctttacggcagacttttgcccaaacatatctctaaggaaattacatagaatatcctaattaatagatataattgccttcccatgactctatccatgcatggcaatcatcttgaagcacatcaacttgaacccgatgacgtacaccgagtcaaattatcggaatcggctgtatcggctaaccccgtccgactcgaactctgccaacctgaccttagccgatttggactgcagtcgattcttactctgtttccgcaacgatcttcatcttggattccactttgatctgatcttcacctccgatgccaatagtgatagaatttaccaaatttggttgttaacaggttcttgtatggattcttctttcaatattgcttatttttaattccgaatttcagctaattttaaattttattcctacttgaactcttcttttattttcttttgctaatttcgggttttatttttatttttatttttaattttaattaatctcgtattgggtttttatatggactcttcttttaatatttcttatttttaattctgaatttcagctattttaaaattgtattaactatccttttcttttctaattttggattttattttatttttattttgaattttaattaatctcgtattgggttctcatatggaaacttctattgcttggactcttctttttttttctaattttagattttatttattttaattcgaattttgattaatctcgtattgggttcttatatggaaacttctttcaatattgcttgttttaatttcgaattttagctatttttagattgtatttctacttggactcttctattcttttcttttctttttcttctattaatgtgggaatttctagtccccacagcgaatatggtgtctcttttcaaagctgttttaataatataatagatagatagataacctccgggccaattcaagcgagattgatgggggcagccgccgatcctgtgcggtgtgaagagtgaacgagctctaatggccaatggacgagcttagcgcggtggagtgcgaaggcgcgagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagcttagctcttggagtgttcccgtcgggcggctatagcttagctctctcctccattatttgcatggccgtttcctcccccctcacagccctataaattccgaacccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccactgaacatgacccgtttggcctctttgtgaagttctcaaaattatatatatatatatatatatatatatatatatatatatatatatatatatatatatatatatatatatatatatataagcaatacacgtcctatggaattaaaacttttctatagaaaataattaaaatgcccttagcttagaagcgagacgtcaagaacaattatagttcaaaaatatctaatcactacagatatcttaatatcaagctaacactacagaaaattctcacccatcatgccatcatgggaaacaccttagttttgaaaaagaaaacaaaaacctatggttggaccttcaagggggtaaaatggaaaaacaatctattattgatagtgtggcgccaatattttctacaaaaaatatattccctattgtcaagtatagaaaattaatcctatcccttatgagattatttttttatcccccttccttatagttatgtctttgagaataagataaaacccatatgaaaagaaaaattgtattcaccctagatgttcaaaatatactattgttatacaatggcttagagaccaatgatgcatagtagcactcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcagagcgcagagcggagggtagagtgcgtcattgcgaacctttggggattaacctcgccgacgatgaagccttcgaccgtgctgcccgagaccgagagcatatgccctcacggccgcctgaggtagagacgaggccatggaaggcggccggcggccgctgcgtcggacgcgttgaggggctcggggatttggaaatttgcgtttggttttcgcggcggagagccggagataacacagagaaactaaccaatagtgttgccaaatcggcatcaatgcggatctgagtggtggtggtggtggacttggtggttgcccccacccccacccgt

SEQ ID NO: 18227 - DNA, 11528 bp, Oryza sativa
gtactacgcgccttgagagtaaaatccttgtttcccaagttgtgaaaaaaccagaactgaaaaatgttgatgtgatactatgaaactaataacagatcaaactctaaatattgataataggttcatttgggtctaacttctccctttgtttctttgacttgtcagagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgccccacccgtatatctccagagttcctgtccaagctgcagttcttcacttctgaaggcagtagcagttaagtcactgtactcatcgtcataacctgcgataaatcactgtatcccattttccatcgtattgtctttgttcaaatgaaccaattgattgaagcatttgacttcagtgacatttctaatctgtgataaatctaactgcattctttatttgattttcttggagtgagcacgcgttccaacgtttgaatacatcgtccaaattcagcaaaaactttgaatggctatgttgagctcatggatatgatgtgagaaactttttttttttttttgggggggggggggggggttgagcactggttctttctgtgctaggttacatatctatgagacccggctttagtcaggcaagggctcaagttctattcataggagatctgaggtttctgaaccctttccacacaatggatgaacctttcagtcccaggcatccaattactagttgtgatagagtgaatgttcaccaattgactagtataagtagtgaacatctcccaatggaaaaaagctatcgaaattttaactttatgcaaaattttcagttttgagttaaaaatttgcacattcttagttcaaaacatctactaacattgaacatagtagttcagatttttttttatttcactggttagctcacaatggctgctgtgtttgacatgcgaggaaaagagaagatcgaggatacgcaaaacaagataagccattagcattagcgtatggttaattaattattaattattttaaatttgaaaatgagttattaatatataatttttaaagtaacttttctatatttttttctaaaagaatactccctccggtttcattttaattgacgctttggacaatgacacgctctacaagatatacatttgaccttatttttttattataatatatacaataaataaatacatgtttatttttattatagtgttttgaaagacaaatctatatatgtttttctagtttctttaaactaaatatctttaaagttattgatggttaaagttataaaaggttaacattaaccttgtccaagaaccagggggagtatatcgtttagtagttcgggcaatcaatcaaaagctaccgaacgcagccgaatacatatggcgatttcggatagcctcgccaatatgctactacgtggcaatatctagaacgaaattacgtggacaaatccactaggtaacctatgcgaaagcactaaatgaacccacataacaggatcagcgagaacgtaccgtgccggggagaaatgtttccaaatggccgcttgaccgcaaaaagcttagtgcctttttatcccttaacaagaattcctaaatatccactccccggaaaagaaattcaaggtctgccgcactcggaaggtcttgtttgtgttaaagtcggatttcgcaatggatgaaactagggtttcccaaaccaccggggccggggttatcgtgccccggcagtaagcacggtaaccgtaaaaaaccgtacgaaaccgtgcaaaatttatcaaaaattcaaattattttttaaatttatttgaatttaaggaggttaccgcggtttttctattaccgtacccccgcggccggtaaccgcggtaaccgcacggttaccgacggtaagttgaaccctggatgaaaccaccataagcttgaaattttggccaattaagattggattaaattccactagccgaaaaaaaaaaccgaatacatcattggtatacctttttagccgtgtaggagtttgatatagactatatttaggggagtttaaaattcgcaaaaaaaagttagttgatagttccgttcctgagaatatgaaaaagctaaaaatcccatcttcaagtttctaatttattttctaaaaattttttagttcttggagaagttgtatatgcaaaagcttccaaatagcgaagtgagcgttggtagaatatgtgtgctagtatttacccgttaacagcaaggtgttcataataatttcatcaatcacaatatacgtcgaccaatattttaaaagtgcccatccgaaatatatccatactaggtcgaacgaaaacaccccggataaaatcgggcagtctcttgatgcgcgcggtgtagctgcagggagctagcaggagaagctggaggcgcaccgcgcacgcccgaccggagccagccatggagcgggcatggcgcgcgctccgcgcatggagcgccgcaatacgctctctctctctctctcgcgcgcgcgcgcggatggcatgtgccttccctgcaggcgaccttgccggcttgccgctcgtctccccttccgcccgccgatggcgaccagtctgtccactcgttcgccttcgtgccgctgctgctcgtgcgtgcggcgccctatgttgaaccggatcggggggacgggacgacgttccaccgttcacggcgcgcggggttgtcgtaaagccatcacattcatcggaatggggaacctgcctagctgctgccctcgtgcgccgtacccccatcgaatcctagccgtcggttcagctccgcctgatggcccagacggtccagatcagccgatctcgccaggagagctggttggtccaacgtgacggcctctgacgcacgcacgcaaggcaggcaggacgacgagaacgcgtccatgtacacgtaggcaacacacagctggagcttttctttgaagagaaaaatagcaaacgaaggaaatgattctgctcgttttagagaaaaacatataggttacgtgcatatatcggcattttcttttgaaatccacattaacatgcataaatatattgcatggaccttgacaactctcgctgtcataatgcatgctcctgtcagaacctagctaccgactaagtactctaacaatgggataattaatgtcagattactgcgtagggtgcgtcaggtgaaagagataactagccaaattaattgtgcgcgcacgaaactttttcctgtgtgcttgatttccacatcatcatatataggtcaacctagaaaatacaccactcttccttgaattttgctcgtggcatagttccccatttaaaaatgttattactaatctggttgtcaaattgcggtaagtggtgctgtgactaagtgtgaattatcagaatatatgtgacgtatgtggcacgtgcaccagtacatggtaaaaacctttactgtttgagcgggaatttgtttgctcgagagtatctagtttttgaaacatctctctggtgcagaggaattgtcgtgtttatgcttattttttcctccttctgatgaaagataggatcactattgtttgcagcatttttcataaaaaataatcatgtcgaataagcgtgtggctagttttcgacgatgaggaccagcacgttttttacagcagaagtcaaaactcgatcataatgtcctcacgcaccggagtggattttaaagtctcgcgttaattatatcacttaaataattacgatttttttaaaaaatatgaagatgtattaatatgtgatatatcactctacaaatatccaatttagaattcaacatgtcacaacggaaaaaataaatttgactcaacttctacattactaaatttgttttgtcttgcgacatgtagaagttgaattgtaaattttatgtttatggagtgatatataatatattaatacacattcttaaattttttttatacctgttcaagaggcatgcaaacaacgaggggatttaaaatagtatttgtcacggtgcaggccttgcctctaacgaggggatttaaaatgatttctgtcatagtttaccctttgcacgtgtatataggcttagatgtcggtgtcccatgcacacatgtgaatttccttctaatatagacgtataatttttttgcgcgatcgtgaaaaatgcacacatttagcatgtagtatatgcctctttgtgtgtgtgaaattttacagagtgcatatgaatttcacacgttgcaaatttgtgtgttcagattatagtaaggcatggcaattgctaagaatctgcgtgtgtgcagactgtttccgaaagatcaaatgacgcaacctagatacgatatctcacagacccactgtacataccccaacctgacaaatcaacactgtcaggatcggagtaacagtattttaatgcttcccaactccatcaccgcaatatcgtatcagccctaacggtcgacgaccggccggccagccggtgacccccatgggccgtcacttagctgggtgcgccaccagcgacggcgccccaatactctggtcaagaaacgtgccactacactgtggtttgtgcatatggaagcccagttcattctctgccgttgtctcatggtgaccggtccgacgaccaggaaaggtaaaatccagcgcgcgtactctgctctatacaaccgaacagtcttcaacgcaaaaaccgcatgcgagcaaactcagacttttgagggtagagagaagaacggtaatcacctagctagcttacacgccggattggactttccgttgcaaaaactacgtgtgcagcgttgaacagctaatcacctgtcctttcctgtcccacggatcatcacctatataagcgccatgcatgcaccgccatgagggaaatatcacagcaatcgcttcatcagctcgccgattgcaacgtgagttctactacacactagcagttgatacacacacacagttcaggcggcgataagctagcctgaggcctgaatatatatagcagctagagatactagtactgaattcacaatgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggtcctccttcgatcgagatcatttcaccaatctactccattaatcattaatttcctcacttcatttttgaatatatgcatgacattgtaaactttcagacattgatatttaccatcttactcaattttttaatataaaaaatactccatccgtttcagggtataagatgttttgacttcagtcaaagtcaaactgctttaaatttaatctagtttatagaaaaaataataataataatttcaactcaaaacaaatttattatgaaaatatatttaattattgatttaataaaactaatttgtaattataaatattagtatatttgtgtataaacttagttaaatttgaagtagtttgacttttactaaaatcaaaacatcttctaacctgaaacgaagggtatatcatacctaaagtacaattaatgttaaaacaagtccccacagaataaataatacttacttacataaaagtccttttaaataaaataaatgatcaaatatcatgtctaaaatcaccatcatcataaattcatttaaaaatggagattgtaatttctattgttgatcttttgatatttcagagaaaaaaaattaactctgatgttttgggtattatgaaatctctcaggacgaaggacgggttttacgaggtcgagatgacggtccaggacgacgagcttgacgagtacggcgtcgtcaacaacgccatctacgccagctacatccacagtggtaagctaatacatctccaaaagtaactgaagcatctgcatgctaaacctgttataaataatctgaaccgtgcgtttcatgtgtatcaggccgtgacgttttccttgaaaatgtcggcgttggcgtggactactggacgtcgacgggcaacgcgctggctctttcagaattgaacctcaagttctacacgcccttacgggtacatcttctttcttgttttacttattactattttggacatctatctcccaatcttgatcaacttcatgtttttatggtcacggcacacacaccgagaaaatctaacaaacatttgccttgcgttatttccagaaggatgatagattcgtcgtcaggatgaaggtcgtgaagatcaaaggtgtgagaataatcgtcgaacatttgatcgagacgctgccagatcgtaaggtaagcatgaatacacagggattctacagctaattcattctctgttaatttagaggtgattttattaagaggtattatactttttagtgtaaagcttgataccttgggataatttagtgtaaattttaattatctttaggtacttttcaagcatagtaaagtttctctaattttagctaatggtgatcgatcgatctcacacaatgattttactgctgcttctcccagctcgtagtggatgccaaagcaaccgccgtttgcctcgacaacaaataccgcccaacccgtgtgttcccggagttgtcgacaaagttacatcagttcttcctgtcataaacggctctttgttgctctcatgacaagaagtggatgaaccttatgtgctctaccggtgtacagagcaaggcacaatttgtttgatctacattttttttaccagaattatgaagcatactgtagtaaataaagagtgaataagttagtgctgaccggcttagccgtgagccgctttatgtgaggatgagatgtagatacgcaatacaaatgtgcacctgttcagcagctttcatttcaatgggcattccattaaaaaaaaattatgatcttccatcgtgccttggatttacagtttgcatgattgtttctcaacaagtgaaaagctgcgtatttttatcacgtataaccgtagactacactcgagtacagaacagataaaactcgatcagatgtataatccacggaacaagtattagcacttcagcaggtgaacccacaaacgcacgtgttgctagatgagaacacaagcaacagcaagagaaacaaatgtacggctgcttgaccgtttctaccacatggcaataccagtcgttttcattcaaaaagatcacatcaatataataccacaacaaacttctgccaggtaatgacaatagctaaaatataaagaaacacagctagtaagtagtaagacagttcctgtgtgcttgaattttggcggcggctgtgcttttctgaaactgaacatggtctacacatgtcataggtgcttcgacccttgccagttcaaataccaaattcagaagtcagactcaattggagaacagaaacagtttttaatgccaaatgattattcaagtcactggttaataaatttgagaagtgcatgttccacaagcattagattgaaaatctacctacacaaacattagattgaaaatctacaaggtatgttgaagaacctggtctttatgatttcaaccagtcacttatatataggtatgtgacgctgagagccagttttgccaccaatgatcaatccaacagcaccaatattcaccatgatgcagataggcaccgtcattcttcgtgtcagtcactgctaccctggcctgggcacacatgatggagatacagtgtataaattcgaaacccaagtgtccatagcttcaaaatttagattctttcgaatttgaaacttaggtgtccattgcatgaggtgtaaagtactttaggtgtatgatataccactagttaggtgaatttgaatttgagactaagtttcaaagtactttaggtgaatttgaaacttagctgtctattctggtatatcatacatttaggtcagactttgaaagagccattgcataagtttcgaatttatacactggtatatcatgaatttaggttatggattatagaattggtgtccataccttcgaaatttaggttctctcatgttgaaaacgaaactatgttcctcaattatttcaatgcataagctaactaggtccagtgtataaattcagagatgtgttggggcatgcaacccacatttcaatcctagttcacataaagttaaggttaactgtcccccaaagcaaacaaaattgatccagtcaaatccatgtcagataacaatatatcagaaaagttcacaaaattgttcctatcaattcatcaagtgaagcctgaaaatcaaaggtgcaagaataaaagcagaccacatgattgaaatacagtcaataaggtatggatttacctcacatgctcagatggcttgccaatcctgcgtgctgacagggtccctgcatatgtcatcatataatagtgaaatatcattatctacggtgcccagattcatggtctatgaacagttaatgatcttgcttaccatcttcatgtatctagcacttttgtttcacttgccagctcatacagaaagtcagaggaaccgctgttcgcctcaacaaacacttttgttttacactcatagatttgttgacaaaaagtactgcagttcttctcatccaagaataactaaaaagctcagatagcaagattgcattcactgcttcgctttcttaataagactgagcttatgaaacttgtgtgctctcctacattcactgcttcgctttcttaataagaccgagcttatgaaacttgtgtgctctcctgattttttttttgggtgatttttctctaaacaccatggcaagcaatatgtatcttacacccgctgcttaagctggtcttaaattggactgatggagtatcagaatttaacaattcattagaaagccaaaatagacatatgtagtgttatttccttttctgaagtaatagtaaagttatacacgaaatagaagcaaaaagttgagcaataatttagcacaacacacaaaaagcatagcatcgacttccaatggatgccacaagaacattgattcatttcacctgagagtggctgatgttgaaacgccgaccacttcgagtccactacaccatacatgtcaatgtacaccactacactatgctgcgatgaagccaaaaggtttctctgctgcgttcctgcttcaacccattgcatatttgagagaatcaccagctccttggaagaacaggcatgatagagcgaaatccgcaacgaaaatcccaactaaagaaacgaccactgcagatgtggtggactctccaacgcccttggctccaccatgggtggtgacaccccaagcacagctcacaacagcaataatggcgccaaacacctgagattttagcaaggaactgatcaagtcccatggccgcagcgcccttcgcgctgactccagaatgatgctggtactgacaccgaagatcgaatcagctaagaatgccgaggacgccagaccgagcgcgaagctcatgagggttagcacgggcagcgcaagcacacaagcgacgacgcgagggaccacgaggtaatcgacgggctgcgcaccaaggacgcggagggtgtcggtctgctccgacacctgcatggtccccagctctgcagcaaacgcggagccgacccggcccgcggcgacgacggcggtgacgaccggggagagctcgcgggagagcgcgagggcgaggacgccgccgacggagcggtggaggccgaggcgagtgaactcgcgcacgaactggatggtgaaggccatgccgacgaatgccgcggtgaggagcgagacccccgcgctcccggggcccacgcggcggagctgcgcgaggaggttgcggcggtggacgcggccggtgaggacgcggtggaagacctgccccgcgagaagcagcgccgagagcccccgccagatcgcgcgcggcggggaccacctggagaagggagggggcgggggctccggggacgccggcggaggcgagggcggagaattattgctgccggtgggggccggggtgagggagaggcggggcacgggcaggcggcggcacgaatggtggaggcggaagaggaggtgagacttgtggttcgcgctgtcgccggcgccggtacaggataagctgatgagagggtgggtggtagcggagattggacggagtaggaaggcggcgccggcaccggcggacggcatgacggtggccggagatcgggacggtggcggtgggtgggtggtgggcgattgggtgggtcggacggacggaggtgatggggatggcttcgtgctgcgggaaggtagtggttgttcttgtgggcttcttgatgttgggctttctgagctctcatgtgatgggatcactgggccaaggcccaagataagtcaactttgacaaaagttaatctatgttttaaaacttaattttagcatgatggttttgattttgtttttcgtagtttattttttattgctgacttttagttgtttagaaaaaatattatttataaattatttttattggaaaaatattatttataaattatttttattggttcgtttaacttttcatgctttgtaccatagcggcgcaacaactaatcacaaacacaatacggaacgggcgcacacgcagccacccgatccggaacagaacaccattaacacacgggtataagcctccattaatccttacttgcatcttcatcctcccatgcaaaattcaacctgagaattaattcacgtacacgaaagattagtggcagtagtgaagctgtggctatctcgctattgacttactatctcaataatggggcttgcatgtcagggcagagtcgcacatgcgttagtttgccgtgttcaactgcttgcaagttgcaacagcgatcgatgccaagctaataggtacagacactgcaaatctgcaatcctttgggcaagtacaggtacgtacatcatgggcatagggatggcaatgggtcgggt

SEQ ID NO: 18228 - DNA, 3451 bp, Oryza sativa
ggcaggtacccaatagatctcacatgaataataacttgaaagatatgtaatttaagaaagagaaataaaatcaataatttaccaaatcaccgtttatcaacaataatttgaattacatcacaacttagtatcagttagcatcacaaatgaaccgagagaaatggtataagaattaagaaatgagtcaaaagtagttaatacatatgtatcgggttgagcatgggttactcacgggtaaaaattgaaacccacctattgcccataacatcttcggatcttggacggacgtgcctatgggtaaaaagtcacacacacgcccatgcccgtcaggtcgggtatccatggatacccagactcatggtaaaattgccatccctacatgggcagctcagttgatcgtcgatcacctagtcaattcgtgggtgctggctgctgaaaaggacgatcctctcttctgttgttagtggctggaagtagggactgatggctaccggacaagcaaaaacaaactgattctctgtcttttcttctcccttttttttttttttgaactcttctcattgatgcttcgtgcctctgctgtgctttcctgttctgtgacattgtggcaatgatgtagaacaagctatctcctttcggcatggcatcagttgagcttttatgggcaaagtgagcaaaatatgcttgatatattcccaaatgttggtaatatcctcgtaaacaacaagcagcacacagaacaccgacattggctaacttatagtttcgctctgctggaatataaccagtgtttaattttgacttgcaggttgttgataaaactgtaagatagcaactagttcaacatttcctacaagtgtaaaaccaacggtacagttacaggagctttaccatatgcttaaaagcctgagatgtcacattaattaactgtaagttttaaatttggccgtccatgcttgaagaaaggctagccttcttggctacccatcaaaagagaaacccttaattggttttcagaaaacatgctgtctacttatttattctttctccaactagctccatgacatccaaatatcccctccatgacttcatctgtaatggctgcatctatgtactaggtcgaggctaagtccttggttactagcttaacctttaccagttaccaacttgaaggaagataagaaacatttatgccgtctacttttcttctgtcttttaccaacctgattcgttggatgcctacttgtctagtcacactatcgatgttatttccctgagtgcaataatatgttatcagctccggccactaaaaatctccataaagcatgctcgatggagtagagctacaagcagcttgctcttgctgttgagatttggcttcagagagcatctttcccatccttaagaaggtaccatgaggtaccaatgtaatctgaccgttgatttaggaagggtatgatggggctaaacaaattagggtagcgttaatcaccgcccatcccagccaatagtctgcggcggccgccaagcgccaatatctgttgccggcgtctcatcttgtccgccgcagccgccgtctcatcgcaggtattcccccgcggccgacgtaccctcgacgccaccgcggccgcgcgtcgaacacgcgtctgccgccgtcgaggacgccgcggcagacgtccaacccgcatcccgtcgtcaatagcggcgcatcccgtcgtcgcatacagcggcagcctccaccccggcgcatccatcccgccgtcgcaagaactcgttgtctcatccagccatccgcaggcgcatcgactcatccacgacgacgccaggcgcatcaaaatcgccgcctccaccctgccgcatccaccgtcgcatccagccggaatactcgggcgtcgcttcctgctgttgtggtctctgttgttcctgcatcgtccgacgctcttgtgtgtgcaccttacatttgtattccagccaactaaagtttcttaaactcatttgtattcatgccagctgcttctgttctgtgtgttttcagcccaattaagtatagtattccagcaacaatcaagatgaagcttccgtagcatgtttttagttttcagaacagaacgggcagccattttaattttgtagcagtgattccaacaacaatcaacaactccagtagcataaaaactgtacacttgccatatcagatttgaagtgatgcaaacaactaggtaattttagggaaatagatgataaatatattacatcagaataacattgtcttaacttagaacataagctgctgcatggcctccattaaagttgaacaaaagctgctgcatagtatccattacataaggtgcagatactacactaggagggggcatactactacattatgagggggcacatcaaagttcttcatccattacactagttgagaacctcaagagtaatacataggtcatcatcaacttcagtgaacagaaacacacaaacatcaccaagctcgaataaattggcttgaaccaacttgttccatctagttgtaaaggtagcccgcttatctttggatttcttcagtctcatctcaaaggattcagctgatccaaccagagtcacaagtaaatcatcaattggtgttgaaaggtggttgtttatgtactgcttgctaaatggcaaactgaaggcctaaaaaatataaacaagacatttagactcaggacatttatgtataaacaaatgcaaatacagggcagtcagatttgtgaaccataccattttcccttttgtcaaattagtcatctggatctcatacacatagagtggaatggtaggcaaattgcttacagcaatgtgagcaattttgtactgcatgttcagtcccataccagtactacctatcaaatccagggaaggtgcgaggtccatattgacctgaaattggaagtttgacaagcacatcatctgactagcagtacctaacattctgtacatttggacttattaattatttatatgaaaataatcacctctttcaatggagcacttgcgcacgctttgatatatcttagcaacttcatcatcatctacaataatatttcccgtgtttttggtttgtaagcaccattttagttcgaaacaaagaagaaaggacatgaataagtaggaaaaagaatttggtttaccatcttcactgtcagaaatcaaaatgactggttttcccctcggaacgttgtccatgctggtattgtcatgaataaatcataaaactcgaaaagcactgattgaataaaaggacctcgaagcagtacacttggaccttgaagaaggacgggagcaggcacacataccttgaagatccacggcggcgacccggattgccgtgcccccgctcgccaccgttcgggggctgcatggtcaacggcgagctagaccctgagacgccgcgcacggacgcgcg

SEQ ID NO: 18229 - DNA, 15627 bp, Oryza sativa
tttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatggcagtacgccaatgtgaaacctccaagcactttcttcaaactaattgttgatgctatactatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgagttgggacaaggataatagaattagtatcatcctcctagtatgcaacaaacaagtaaacacagattattagattgtgtatctctattaattggttagaaacatgaaaatataagaacttactaaatatgtgcttttgtggtggcctcctctaatccaactagatgtacacaccaaagcttgtgctgttgatgggagtaaagagctgtgataatcactaatcacttgaccccctgtgctgaaagctgattcagatgagactgaggtgatgggaatagtaagaatatccttggccaactttgccacaattggatactttaattcattcatcctccaccactgaagtagattgaaactttttgcaggaatatcctcaacaggatcatctaagtacctctttaaatctgacttaggaagactagcagcattctttgatttcatatactcatgaaattggctagcagcaaagaaatgactactagtagtgcccagagatgtactagtagattgagtggtggcatcattttcctttgatgtgctctggagttcactttcatatgatgcatgcaaagatttcaatgtggattccacatttgcaagtttcttaggaagtacagtttcttcatacaaagcagggaatgtgtagttaatcatacccatcttaaaccttgggtctagaaccaaagcaactgcaaacaaagtattgcattctgggccccagtacttctcaaatttttcaagcattgcatttgccatttctttaagaattgggtctttggacttcatgtcacgccccgagctagtcccgactggaattagcccgtgacgctccaaattaacctgttaatcgataccagtcccaggaaaacagtgctggtatcacagggagacagaatatcacagcaacagaggtctctttattatagagtagaggtacagtcatgttgggctgcggacagatcccgagctcacaactgcattacaaaagggaaacggaagccagggcttggaccaaacatcataggcgcgacttgggaattaggccgaaaccctaaaactcatcgaagccggcttgctcctggaagaactcttcatcagcaggatccgcttcatcttcttcagcaactgggggggttatttatatagagcaaaggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacggccacccgggccaacaacttttcaaacggccacccgggccaaccactttcaaacggccacccgggcctagctgatcccgtcagctacagatttttcaaacatcaaaccccttttcacaacagcaatttcacaagcagtagtcaaacaaaactacgctaagaatcacctcacatccgcccatgaccgtgggcacggctgttcgaacagttagttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggctaggtcccagaccatactgtgccaggaagcccaggggggtcctctccgacaccaccccggcgaatccacatgtctctcggcatcatggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttagaaattcatttagttcgcaagcaccgacccaggtgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattaggtagatctcgagatttggggaattttggaagttgaacggagtcaatcggatttacggttgggaagatattgaatttctaagattattggatttttggtctgaaggaaaaaggatttaggcccgggtggccgtttgaaaagttgttggcccgggtggctgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgtttggtccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaaggttgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaaataaaaataccaactgctatcaatatatattctgcacaaggtaaggaatcaaacaagtacaacaagaaaagcattgccatcaatttaccttggcaaatggcaaacacacggtgttctgcaaccttcagtctttcttcagaagaggaggacagcaagataagtactactctatgtctccacctagtccataaaattcaatgtaaatcaataacatccatcaagcaactaaacactacacaattaatacatgtagggccctagatacatgtgggtgcaaaagaaataaaaatgtaaaacaaagaaagaagaggaaacttactcagatccgagtcgtcggttcgtcactcacggcggaggcggtgggctgctgctgtcctccatggggttcttcctggacaggagaggcgaaggatggacggtgcttggctagatccacagcagtggtcagtggagcactagagcagcctaggattgtagatctagaagagaaatgtttcgaggaagagagcaaatgagctagggtttggatacgggatggggatataagggaaataaatggttaggtgatggactgctgttggtggtaggattttggaattggagtgcgggagaaattgggataggtagcgggagtgaaaatttcaagcttctgccgaatagctcgagctcggctcggtagagctcgcgagcttcgagacaagctcgagctcggctcgaatccttgccgagtcgaactcgagctgagcttgcgacgagccgagctcgagctgctcgcgagctccgagcttttttgacagccctaaccgtcgtcgatgaatcgccgccacaaccatcttcgagctcccgacggttggccgatttgggcctgccgctgatgacctccacccatccctgatctagccgccatcgagtcgctgatccaggattcgctacatgcccctcctcccgccgccatctagggttctttctctcgcttcagcccagcgcttcctcctctctcgcgaaacagcgaagaaacagatgccgcgtgcgtgaagccgtgaatcggtatacaacgcgaaagtacaaaactaccctccataccacggtaccgcgtcaatgggaggtgcggtaccatgaggtaccgacgccttttggaccgttggatgatctcgaatcaacagtcacgatttggtactgcagttgctcaaggacagtaaaaactcggcttcagatgttcatttccagacttccagtgaactatccttactgcttacagttaaaacgcagttaaagcatatgtatctgactaaaaaatgataacgggcaagaacaagcattcattgtagcagatttgatagcacaaaaatagggcatacacataatgtcttacaagccaagtttcagaattagcccccacaaaggtgccttttactcctttcgtgcatccttgacagtatgttttcttttccacgtagcagagacagcactaggctattcttttccctctaggatttttatgatattgaatgtgagggaatccaagttcgctctagttgatcacttgctcgtgagatactgagatctagagacgaagattggagagagggccggcttggctgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctcgtctaaaaaaagcgcaagggtaagcgccacctgatcgcagccgtccaaccatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaaggatctgaaacggcggagagctccacgtcgtcgaacggcgccgggaggttcagatcaatgaagccgttgcttttaatcatggctggaatatcgtcgcccgatgcggccgccgccgcggctgagcacagctgggaccgcttgtggccgcccagagcttggccggacgcgaacacgcggaagcagtaggggcactcgtgcggatgcggcttcgcgccctcctcctcgccgccgtcgcactccggcaatggctggagaggcgtagcgggagaaggaggagggttaggcggaggcgcgcagcagccgcccctgccgccgcgcatgtggctagcgcgatggccgccgagggcctggtacgatcggaacaccttcttgcatgcggggcactggaaccgcgtccgcttctgcgcggccgctgcggccggagccggaggtgcgtcgccaccgtcgctcccgtcgtcgtagcctgcgccgcggagacggtagggcggcggcggcggcggcgtggctggccaggtgtcgcgggagagcatcatgagggacagcgctacgtcctcctccgacgtggcgtcggacaccgagctcacctgctcgacatcgcccgatccggtgttcgcgcgcttgccgtgaggcggcgaggagtagtactccgtctcgctctcgcgatccgagaagtcggactcggcgaggcggaccctccgcttgggcttctcccgcagcacgtatccctggatgggcctcttggcatcaccgccgccgtcgtcgtcgccgaccgcgacggatgtggacgcggaggacgtcgaggagatctgcgacctcgaggcggcgactgagtgggagcgcatgtggccggcgagggcgcgggggttgccgaagcggcggtagcagagcttgcatgtgttcttggccatggcgagagcttggatagagcttgatgaggcacagagcttaggagagctaaaaatacgagctttcagaggaaacggagagagatgaaagcgctgcttccgtggggagttagaatagagcggaactgccagcttcctctcgtttattgttttccttttatttcccccctttttttctgggtgactcattgtattcttgactggttgtatttgcagcatttcttttactgctcgtgtagaaccaagcccaaccgtatggaagatttcggactgatgcttgtagttaattgttagtacggatgaaaggaatgagcctattgttcttttcgatgaaatgagtctaatgttttgccatgtaccatcatgtggtccagtgcgtagtttttagcagtagcggttgtattgctgagatggtggctattttggtgatcagattagtcctaattaaaaatctttatttgctaccatacagaaatggcttttgcatacgtgccatatggctttctatgcgagggaatgtactgtgggatgctgctgtactcaatgcaatagctctgaaaattacccgccttggaagatgccactacacttcatggctgtcaaattgcccttttgatggatctccttaatatagctttgccttgttaaaccaccatttttatatcctgatcatccaaaggccacaccttggtgcagctcaggcgttcagtaagttgggtgagatatgtctgaatagagggctcagaatgagatgggaacaaagagtaggtgacaagaaggttgggaagatgggtagaccagtgagaacaaagcgaacacagggtggagtgtggcttggggaatcagtgatagtaataagtggcagattaatcagccggggtctaaatcacaagagtcacttacaatgcaccactgtttttatacctttctcattaaattaagatctgggtatggtgggaacaaaagatctcgatacggtttaggcaacgattaatcccttattagcagcacgttagttgcttacccacaaagcctgaccgagtgcccggccagcatgcatgcatctcatcagcggatctctcagaattatgcccatccaaatccagcctcatcttgttcttaatctccctggaattactcctggcctccccttcacattatcttcctgccaattttaaccaccaggcatgcatatgcaccagctgctgcatgctcgttgagagcttagcacttagcaggcaagcaagcaaagcatctgcgagagctagcctttccaactaaccgctttagggatctctctggttatgatgggtacgcattaggtgcgcccccgatttatgtacatgatggccattcaccccgaataaacacctaccagctagcgagctagccactcaggatcatatttagtactaccatcaagtagcgaccaagtatccagcatcattgttgatcaagcatttgttatgcttgctacggctgtcatgttagtagcatgctactgtgctgccgatgcatggtgttcattgtgtttgtgtgtttctgtgtgtttctgtgtgtgtgcgtgtttggacttcggtaggtaatttccaaatttccatttcactttgtagctggtactgtcagtactgtactagtacagcgtacagatacggtacaagtcaagggggatcggctggctggcttcaattccgttctgaacactaggcagcgtggcaggcgatgagatcataggcgtgtgttggtttcttgcttcgctcctcctctcgtatactctactggagtgtgaagtttttccccctatctgtcaccttcttttttcttttctgtcatcttggtgctgtccttgttctgctcttgatccctatctccaacctttgggagtattcattggaatcatcatcccgaattcatgatatgatatcgaagtgattagctctgaatacttacaaaacatgcagtgttctccttttcctttccttgggcctgcaggtgaagcagatttgtattctcctgtaaaatgcagtggcttggcaatcagtggaagcaaagggttagtgtcttcctatgttactattccacaatggtgtgtgccacgatgtctttttttctttcatggagaaaacgaaaatcgaaggaacgagtacaaatccgcgattcggtccagtactccggtcattgtcctaccctgtgaacttcacttgcagtcgcgtcgaggatccagaggaccaaagctttccgtgcaacggaactgtttagatggtactccagtccaggaacaagacgcgcgatgcgatggcgatgaaaaccacacgttgctctccggcgcgcatggccgtcttgtcctctcgcgctttcaaaacgagcgtgcgttcgtgcgtgcagcggagcggagcggggtaaagaacggaagccgcgagggctacgagagggctagcgtgcagtaatgtccactcgcacaactccttggattcagcaaggctggatggacgggagcgcgtcaggcgaggacgaacgggattgggtcagaaaggattacggaagaagtcagcgtcgcgtcccggtggctgcctgcctcgcgctcgaattggagtggagcgatccgagtcaagcgccgaacgaagcgaagcccccgtcgtttccgccgtcgtcgtctcgctcggcagcctcgcatcgcatgcgccggcgctcgccagctgacgagagccgcgtgcgccatcaagcttaattgtgagcagctagctggctgttcgacacgtaaaccgatgaacgaagcgaagaagaagctaccgaatgctgatgcatttgctgtagacctgtagtgcatcgtgtagaaaacgaaaaaggatcaaacatataggccgtgtttagttgtaatttttttttcaaaattccaactttttcatcacatcaaaactttcctacacacacaaaattccaatttttccgtcacatcattccaatttcaaccaaacttttagttttggtgtgaaaacacagccatagctttgttgtcccctttaatgccgggttggttcggaaagtttcgttaaagagggtttatgatattcctacatgtttacttggtctttttgagacggatttgctacatttatgtcgccataaattttcgttgattacagtcggtatacatgcctattggtcacacagccgcacaggcttcccactgcatgtgcttccatgagagagaagattattttcacacatatatcgcgtgatgatagacgattacatactaattacactataattacatactattttatgacttacatatacaattttgaaacttacattgtaaatacactaaaattacatatgtaattttgggacttacatatgtaattttgagacttacattataaatacactaaaattacatatgtaatttaagaacttacgatgtaaatacatatcgactattttttggtgaaaaatatggcgtcataaatatagctactgatataagaacggtaaatatattcggtagtttgacgtgagggaaagtaaaactaggtgatgtgaaagacctttttacacatcgacggataaattcgttgtagtctagctggttaggatactcggctctcacccgagagacccgggttcgagtcccggcaacggaaatttttgattttctattttctggtcatgcaggcatacagcttcaaaaattcatatcttaaataacgatttcagggtgcagcatccaggctgccattggcccacgtggcactctacaaaattttccagggctactctgaaattatgccacgtgtcctcccgtatacataattaaactgcattcttctgtccacttaactctcaggaaaagtcaggagtcaataaatcaccttgcctaacccttgtgaagaagttggatatgtaacccttccgaagtctctagaaaaattaagatagaagttggatatgtaacccttccgaagtctctagaaaaattaaaatataacatggttcttcacgtgtatttatacgcacaaactatgtcagtactcacatagtcacatattgatttccaagacctttgatgctttaactttttaagactggttttaacttttaatacaaagagtaatcttttaatacaaagactggctttggatattaagctgacaattagagtcattagcctaaaaaattatgccttacataaatttcgtaattttcctataggttaacaaattctgtaaattatactaattcaaaagacacatcttccaaagtatttgtccaaaggtacttatagacgcttaaacaagttaatctttcattagcaaaacttttttcaagttgaattataatatacagcagagaagtacggctatctaaatgtggtagagaagaattaattagccatgcatacactaattaaccatattactctatttgttgataatattgctctaactatgttcgattgtacctatgattagcttgtattatttttaagatggagggagtatcgtatatgagactacagagaggagtaggtgacactggtatgttagcagaagaaatttctcttagagagacttgtcaaaaaatatatcctttagttttcggtccactaatgatctaatcttaccaattaataataggtgttaattactctgtctaatggaagagaaaaacaaaggtttgaaagcaaataggcaagtactatacataatttttatacataattttgctttatgtattaattcttttacaacgcttaaatctttacataaatatggttattactataagttaatcgttcctcagtcttttcaaaattcattaaataggttcttgtaaatctactgcatttgaaactctagacaacaacaacaataatttttctaaatgagtaaatatatccagctataagttggtgtgccgatggtgcgccaattttctaggatatggaagca

SEQ ID NO: 18230 - DNA, 16953 bp, Oryza sativa
ttataggataaacaaatttgagatatgctaactcatcctacgtgatactttgaggagggtcttgcactacgaacgccctaagagaggtggtatagctatagttttccgaattatacatatgaggctacgaattgtgacatctaaatggtgtactactcgcaatagaagatatggaggcgtgtccctctccattcacatgtggctcttcaaatagtgtgtgaactatgtggtcctctcgtagtcatgagtcatgactattttcgactactgagaagataagcaaatatttggaaaaaacagagagcgcggtagagatacaaatgataagatttttaaccatcgaggatttaataatgtaaaagtaaaataaataaagagaatttagaatgttatacttaggctgaaagaaaataaaaatatgggaagaagaaaaagaaaaaatcatttcccttttttttcataaccagttaaaaaaacaattccaactgttagtgctattataagaaacctctagttattatgagtaaattccctgtgtacccctgaaaactcactcaatccctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaacaattgaaaaaattttgtttgggtgcacagtatgtgcattttataagactaatgaaactaaataattagtgcagaaaattttgacataaattttgaaaataaaataaatgtaataaattaaaatttttatttcaaattttaataggacaatggatttttttatcgggagcattcataaaaaaaatgttgtgaacattggtagtcctatctttatatgaatgctcctcatttttatgactttttttaaaaaaataaatacgtgttttttatttcatgatctaaaaatatttttgggataaataatgcatcgcacaacaaactcataactataatagtctcatgcgagaagcttttatatttttaataatgtaattcatgaatttctttgttcatccaagggtaaaatggtcatttttatggaaaatagacggtcaactaacggtcaactgatgggaggggtatgcaagggatcaaaatcaaattttgggggtatacaaggaagtaagcaaaattcaggggtatagaagagattaggtaaaatttcaggggtatataagggattttctcaattagtatagtcccaaacaattttcatataaggcttcaccttttagccttatcttattaataataattaaatcgaccatcaaccaacatatatttgacatcattttttcctctgtaatttaaatatttacaaatataatgtttactcagacttgtaggcataaaattaaaaactgctaaaatatctctttaaaattttacgcttttacaaataacaataaacagtatatgtagtattaatatggtttgctatatggatggtgtgctaacggcgcaccaattttctagtatttacctcttttgtgaaaaaaatactcaatacttgcttctcttgagaagaaacaagagaagcacctatttctttaaaattttctggtcatacaacttaacagattaaattcatatattacctcttttgtgaaaaatactcaatacttgcttctctcgagaagaaacaagagaaacaactataactttaaaattttctggtcatacaacttaacagattaatacattatcttgtgtgaaaaaacaagagaagcaactatttctttaaaaattttctggtcatacaacttaacagattaatacattacctaaattttctggtcatacaacttaacagattaatgcattacctcttgtgaaaaaacaagagaagcaactattttttaaaaaaatttctggtcacgcagcttgacagattaatacattacctcttgtgaaaaaatactcactacttgcttctcttcagaagaaaaaaaaatcctacaagtctactgcctcttcccaaattcatatgttacctctttgtaaaacatactcactatcttgagaagaaaaaaaaacctacaagtctaaaagaaaagaaaaagtcacaaaaaagaaggcaaatacttatatgctcatgcgaacaacatatatgcaattgcaaacgcatggaaataatgtaacagtatatatgtatgtactgatcaattcgcagatcaatcactccttgtcgttatcatcagcacccccgcgagacgaggagccaatgccgacttgcagccacggtgtcgtctcccctgccatgctcacgtccttgagatcgctaagcctcgctctcttgacggtggtgctgtccgcctcgtcctctgctgcggcggtgcttaacccgaccgcgtcgttggcgttctggctgccggttgtcgcggtagccttgttccgttggctgggtatcgccggcgacgatgggatgtataccggtggtggcgcgtcgagatgaaacgagctgccgccgaccttcggacggactgttgcggccgaggccagcagtggcgggttcgccgcgatgctgaggtcgagagcgggctccggtgcgtccaacattggccggaacgagagcgggacaaggtcgtcggctaggggtgggactgaggcggtgtgatccgccgaacttgacgtcagccagtggcaccgtttgtggcctccaagcgcctgcccggaggtgaacagtcgatggcagaccgagcattcgtgcatcttgcccttcttcttcaacggtgcagcggcgagcgcggcgaccggcggttctatgggcacgatggccatcgacagttctgccgcggcatcgctcgtgccggcgtttccatcaccgtcgatgcttgcgtgcacgttcctcctggcatcagaagtggccttggcgggattgtcctcgctccgatcagcgacctctgcatggtgtgatggctcagccacctctgcggcgttgctctccagcttggcagcgaagcagcccttcaccttcttgtggctggcacggtgcccgccgagagcttggtgagaagagaaaaccttcttgcacgccttgcactcgaacatgcctcgaggcacggtcgagacatactgtggcgccggcgccggcgggggaagcgccatcactgtatccagtacatacgtcgtcggctccatgaacgtgatcagtctcttatgttccttactcgcggaagaagatgaccgttgttctgcttcagtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctccccttgtttggcgattctaaaataaggccttcccggggaattttcggctcctttcgccatcctgcgtcaacctgctgatcaatcgaccgggcaagtaacgcaccgccaggtccgtcaacacgagttgggctgtaactggatccccacacacgtgcccaactacatgggccggaacgggattcccatctgccgcaattagttgggccgggactgtattcacacgaacgcgcaacatgaattacagaggaataagttcactttgagtccctcagtcgccgagtccaaaattagtcccttgagcgcaaaactgagtagaacgcatccccaacatataaaaccaatacaaacgagatccctcggtggtattgtcctcagttttaactgacgtgacacatacgtggctcctttgacaaggtctttatcccacgtaacattgacgtggcgcttatgtggcaatttgattctgtaaaaattaaaagacgtgggacccacatgtcagctacacacaagataataaaaaaaaagttgaggcccatgtgaccccacgtgttatcgtcactcctccctcttctccctatcccctctctccttcccctacactgcaaggagaagggcatagcggtagtgggtggcgcagaggagctgaagatgaccaccgttggcaacgcccacaaagcctcatccatatttccgcggcgtgcactgtgctcgggaacagctctgactagtacacatgcgccaacttcatttccaccaactccgactcctcctgtggctcctaggccagccgcgtgagccgccacacctccttccctccaaaaccgcgtcgcacctcaacttccaccatgccatgagcacatgccccaccaccgccacaattaccacgatcaccaccacggagtccgcggacaacgacaactcaaccgcctcccctctcctctcacccttctcccctcctcctcctctcgtctcctccctgccacatagatctcaccgccccacccaacctcttgcacccaccagatccgcgcgccaatacatccactccccctcactatagccaacctgtcgaaatctagggctcccaaattttcccctctctcctcttctctttcctacccatgttttgtttggtctttggaagtaacagagagacaacaaatgaagaagaaaaccggcggaatccacttctagtctacgcacttgggggtcataatgcggaagagcaccacgagcaccaggagcgtggtggccttggaggcacggtcgaagagggaaggcaccggtgaggtcgccgcccaccatcggttagctccgtccgccacctgcctcgcttgcctgctccgccattctcctcgctgcccacccccacccccacccccgtccgccaccttggaagagatgatgaagagaggggagatggaagaagggaggagtgaggatgagtaagaatagagagaggagagagaggggagagggcaaaagggtggaccggaggagcgcggatgacatttggggcccacatgggccccatcatttttaattgttttgtggtgtaactaacatgtgggctcatgcttttttttattacccatattaaattgtcacgtaagcatcatgccaacgtcacgtgagacgtagtagtcaaatgaaccatgtaggcgtcacgtcagtcgaagccggggatagtatcactgagggatctcgtttgtactggttttgtaagttggatgatgcattgtacctgattttatggtcaagggacgaattttgaaaattaagggaccaacttattccaatcacagattcacagccgacgtgcctccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccggaaagcaaagttgatcggtcgtgacaacatgaaagaaaatcaattttacttgtccccgcatcagttcttttaccaatcgaggtagagaggaacaattgcattgcacaattcttactcctatcctaagtacacgagcaaaccataactatttacatccttgatctttctgggcactcgagtggcagctgccggcgatcaaatcgtgcggctgctgtgccggccgcctgtggcgggcaactggcagatcacgcgcgaatggcggctccggagctgacgtctactgggctgccgccgacgccgcttgcctctgctgcgcctgcgcctcgccggagcagacgagggccttcttgaggcacctctccacctggtacccgccgccgtagctcacctccctctccaggtgccggcagtagctctggaacacgctgacgctcacgttgagcctgaactgcatcaggaagaggaagtccagctccagcgagctcagttccgcggcggtcagcccgcccaccgcggcgaagtacgagttcttgtagttccggtcctcgacgaacttggaggcgacgaggatggctgtggtgagcagccgctgggcgttggccgacacgacgcgcacgccgtcgccgcggcgaagccggtccaggtacgcgtacgccacgacgtacacctgcggcgagacgttcgcgtaccgggagaaccgctccaggaacgcgtgaaggctcatgtccagcaccgtgccgctgtcgaaggcgcgcgccctcctcgcggcctcgccgtccgccgccgccgcctggtccctctcgttccgggcgatgtgccgctccagcagcgacgcgaggaccgacacgaccaccggcgtcgacagcgccgtcgtgccgtcgtcgccgcacgggagcgcgtacacatccgacgctaactcagtggacgccatctcctgaagaattcaatggcaaaagcttggttcttcacaaaacctatgctacacaagtacacagagaactcttgcaaatgcagacactttatacaccagagggaggcaagcgtgggggcaaaaagaagctattaacaatggcggaactgaacagctgaaggcgacacgaggaaggagcaaagaaacaaaagatatcggcataaaaaaactcagcacgtacacgcaaactggagctaaaacaaatcgagacacggagatgaagccttcaggcaccttccattgaggcccctgacccgatcacccgagcttatttatgatcaagcggacgacaaatgcatccaggggcagatctgattgatggctggtactgcactactgcggttgggggcggcatccgtgatcgacgaggctggatttatgagggaaaaacaagcgcgagtggcgaattatcgcgtcggtgcccggcgaacccgtacacatttaactatgcgagacttttcccgcgtacgtgctacctgctgttcaggtacggcgtcttgtgtcacggcgagacgcgtggcttgtgggcaagtgaagaacagatgcctctgatctttttagtcttgccttgccggttgataagctagtttatgatggtaatgggaacttctgttaagacgtcgaagcgaccgatggatgcaggagacgacaatggccgcggcgttgtaacaaccggttcttggagttgctggagaggagtggccctttctgccgacagatttgcactattttagtaggttggatgatcagtgggaatactgttcttgggtactcataggacagcggcatcgaggtgttgacatgaagatccagagaggatataaaaatggatctgctgatagtttttcttcatcatcagtactacttgcagaatgatgaggttaggttgcaataagctgcttcatcgaaaataattaaagttgccaaaggttaatttatttcatttgtgaggatcattttttggaaagagatgtctggttggtatatgcacgcacataaagcttgcaggaataaagcagaactttgctttgctttctgataataatgatcaaagttatcatgcccctgatcttagattttttttttgaactcctgatcttgattggatattggtatttctctcccactggacaagtagcttttgtttattattgtcaggcgtgataatgtacagcatgatctttgccaagagattccactctgggacatcgaatcaatcggccatggcttgcgacagtgctcatgcgagcggatggtaaacaaattgaggcatgtgtttactagagaatttttaaaaataaatttcatgaaactataggtgttttaactaaactatccaaaattataaatttaaggcaccatatcacaaaaccacatatttaaagtacataaaaagctatagatttaatattaaagttaacataaaattatatattttatagttgaactataaatgttatagttttgtgattaatatgatgctaaacttgtagttttaggataattttgttgctaaatctgtattttttgatacttttggtttgggataactttagtgataaatctaaagttttgtaattcaacgtcttaaaattacatttttttcgatagtttggttaatgtataccaatatatagttttgcgagatttattatttttttcattgaagcatgttttacattctgctcttcacttgcttacggtgaccaggacaaagatcatctgaacgggacagagtaatgttagagagcagagtgacagcctgggggggggggggggggggttgtcataatacgtagcagaaaccacatatataattgaaacctcaaaactaccgttagattaaaaatggacgcctaagatttgttcacgcgcacgtggacgaatcttatgtccattttattttaatccaacgataattttcaggttttcagtatataagtgatttacactatttttgcaaatagaatacgtatttatcaagtacttccttcgtccaaaaatataacaacttttagtctttagaatttgtcctaaaatataataatttcttcattaacattctcctttcaaccaatcacaacctccactattcaattttctcacatatctccacttattctccagtcagagcactcccccatttaattctaccaactttcttaataaccgtgtccaactctaaaaatgcttatattttggaatgaagggataagctagtttcaagcaagtgcatgtttggtgaatgaaattgtctggtacacaataaaaaggtttattcaccaaaacaaacaacttgtctagacgtatcagacccaaaacaaacgtattataagttaatacactaacttaagtccgtataccggtaatgcatatttactcttttacattcctcaaaaagttcatgaacgatcacatcatataaaggactaagcataataacaaaagctatggttcaacgaagatatgtaacatccatggtgtcatggtgtcatggttatggataccacatatctaatagtagttgactaaactcggcaggacccaccacatatcatgtcttatacggaaacaaacctcgtatataaaaagagttccggataaggaagaataaatagagttctatatgaaaacgggaaggactactcggattgtatccatatttatctccttaatcttacttggacaagggggcacttatgggtataaatacaagcccccctaggagaaaaggggacacgccacaaagccacaagacataacatacacataagccaagacgatggcagctatataggttatcccaaatattgtatttgtgtgatccagataaataaagagcaacactggtttcggctaacaggatgtagggttattacctgtcagataagaggcccgaacctgtataaaaattcatgtctccatctcttttatcttaatctcgcacataccctgataccaacgatccccataccatccaaataccctagtcgtgactatcaaacgtcgacacatggggatgccatctcaagcgtggagctgcaatgatgtacgattgagctgggccggagcacggaaggcacagaggtggagccgtggagggattggacgactggggccacaacggcggcgcggctgccattggagacagaaggggcggagggacggggtgctgatgtgttgggctttttctcaacttgggtcttctgggctcaagtaatagcgctgtttcggaatggagaaggcttcgtattagaatagaggaacaagtccatttgtcatccctcaactttgcaccgagtttgtatgatatccctaaccctcaataccagatatcttgatcctagtcttcaaaaccgtgcaaagttggtcccatgacggtatagatcattttcccccttttttgttgacatggcatatggaggtcccacttgtcagggtgtcgttggtgtcactgggagatgagggaaagagagaggagcacctgctgcagtcgattgaggagcccccgcggaggggctcaccggtagtctccccttccctctcccacctccacctcccttgcaccaatgccgagcaagctcaagctcagtggggctcgtcggccacgtcgcccctttcccgcctccagtcccctcacatggaagctgagctgacaacctccccctctctgtctcaccgcatgtagctcatgacccgccaccttctcaacctgtcggacaacctcctccccagcgagctattccagccgccagccctcgacgggcacaaccatcgtctcaagtggtcttagtgtgcagacttgggagagggggagatgtggatgatgtgcactctccttcggcgagtggagacggcggcgggcggtcgaaggccctcgaagaaatcgtccctgatccgcctcgacctccaccccacttttctcgctgccgtggctacagcagcggctgccaccaccacatcacgcctcttccgccattcatcatcatctctgttgccgcgccgctcacctcaccatttgtccgtccctcatctccgagccgctcacctcgccatctccgtcgctgcgtcgctcagctagcctcacctggtttgggaggagaggccgagaacaaggggaagagaggaggaaggagggagagaggcagccgaacaaccccggcagctcgccggagggccagttgtccaccagtgccagctcctgcagcctcgtgctcgccggaaactggtctttgctgttgatttgtcaaacaacggcactgacgacacactgacaagtaggccccaccgtatgccacgtcaacaaaaacaatgggaaatatggtctatattttcatggaaccaatttttcacggttttgaaggtttgagggggtcagaaataatttctggtattggagattatgggtgtcatgtagactcggtgtaaacttgagggatggaaaatggacttattcttagaatgactagcgcgtgggccttccccgacttggatcgcaactactggtgtcgttgcccttatttgtggccaacgagaggtatatgtagtatccggttcggcggttgccatctcggcaaagtcagatcacggcgtatagattgacgtaagctgattcggcagagaacagaagacgtatcatgtatatatatggacgttggaaaataagaaatcgcttactgcatacgattatgccggtagctaaaacagagcaagaatagaggccgtcacacggccgggctcgtcaaaaccgagctacggttgccggttggggcaggcccgggatgtctccaaccatgtcaacgcaattatacaagtgcaaatcgcaacgcagaattcggttaagttataaccaagcaagagacgtcactagaagcagctctgcaaacggccacggagggagaacacacatcacgaacacttaacactaacagatcgaactcctcttttaccgcggctgcgcacgattcccggacgcgcacacaccgaactcacttcgacgaggcgagcttctgcctcgcgatggatctatcgcggcgacgttaacaaacacgcgcgtacgtagtcgcgcacgacgccgccgcattaggcggcgtagttcacggtggatcggtaggtcaacccggcctgccacccggaggggatgacgttgttggcgacgagcaccttgccggagcccgaggtgagccggatcgagaacggcgggctcagcggcttcccggtgttggagttgaggcgccaggtggcgccccacgactgctgcatcgccttccacccgccgccgccgcgggcctccatgatgtgcaccgcggcgaggtcgccgtcgccgttcgcgtactggaccaggatggcgaggtagtacgggttggagcccgcgtccaccttgaaggccacgttcatggcaaacctgcacggcaccctgcaggcaaaagtaaaaattcagtaaaaatctgcacttgtacattgcagagtggaccagaactccagaaataattttgcaaattcaatggcggggcacctcttatactggatcttgaggactccggcggagcggaggcggtcgcccatgccacggttggccatggcgccgaaggcggtgccgctcatgtcgaagtgcgccgcctcgttcaggcatacccctccagggcaggagtcggtgatcacgacggtcactgggcggccggagcacgcccggttgccggtgcacttaatctgtacatctaatttagttaggaatgctccacgtcccatgcatttgactggtaaaacatacaaatacactactgacttggtagcatgagccgcagcctttgccattcttgaagagggagggcccgccggcggcgatcatcgacgagaacgggcgctgcccgacggcgctctggtaaccgcacgcgccgcctgcatttggattaattaaccaacatggcaacgtgagtacttgaggtcaaatacgcacatgcatgcagttcatactaccacttgacaacgacttaattaccttcgctgccgtcgccttgcgggccgccgtaccacgtcgcgccgccggaggaccagccgtagcctctgcccagcgacatggtgctccgtctgccggcagtgtagttctgctcgtagccagagacggggagtgacagtatcggtagcgccactaggacggcaaaaacgaaagtgccccggctaaccattgctattttcttgttgggcaatcggttaggtagctgggattgttaagcggagattgctcggtgatttttaagatgatttgatttggttggtatttatagggaagattagcggtcacaaacgtggtagcaaattatgtgtacccaagcattattgaggtgaacgtggcaacttgaatttgtacatgtgttgatgtgtatgtcaactatgtgtgtgtgggatcgaagagtatacttgtggactttacggaggtccttgcatgaaggaggtgatcacgcagccgcaagggtttggataaactattctcacaaggtagttgtgttggttagaaacgctttgaaaattcgcaatttgatattcgtcttgtgtcatccgtacgtttgtcaaatggctactccataatgtgtacgacttgagcgtgagctgtacgtgcgcaacgtgcctagcaaagtagcgagtatcatgcccggccactcgaatgtttgtacatatggtacatatatagttcctttttcttttggagaaatatatatagttcttttagaggagaatgttgtatagtaacacttagtggcagcaattcaatcgaactagctgggtagcccgcgcaattagcacccatacaaaattatctattttaatatgatttattcaaaatttgttaaatagctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcattttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggatattattttattttttatttaaaattttaattaatctcatattgggttcttatatggattcttctttcaatattgcttatttttaattccgaatttcagctaattttaaattgtattcctacttgaactcttcttttattttcttttgctaactttggatttatttttattctaaattttaattaatttcgtattgggttcttatatggactcttcttttaatattccttatttttg

SEQ ID NO: 18231 - DNA, 24036 bp, Oryza sativa
tttcatcctttaaccccaaaaccagatataatttgtccatgactgtcaaaaccggtgcaaataagctccctcggcggtttggaaagcggtttttgctgacatggtgcctacgtggctggtttgactaggtcttcatcccacgtggcgctgacgtggcaattatatcttaaaaaaaataaaaaaacggtgggcccacatgtcagctacacacaaaaaaataactacaaaatggtggggcccacgtagaccccacatgtcatcctcacttctcccttcttcctctcccctctcatttcttcctctgcgccggctgcatcagggacgcgttcgacgctgccatgaacaggacgaacaggccgctctgcgagctccgcaagaacgtcatgctctactacgactgcttccagctcctgttctccgacgtggactttgtctccgggtacggcaacaagccggagtagccgctgaacaacaccaacgtggtggacaccttcatcgccggcaggttccgggagcacgtcgcggtgctgttgaacgctaccgtgcacgatggtgtacgctttggtgcagtgcacccgcgacatgaattttattttatttttttcaaatgttcaccatatcctgattaatttgtttctcttgcttggttgctgcatgattttggtcgtggtgcagaacaatcgggttctgatgtcccctccggcgttgtcctccacctcggcgtcgccctccgctctcggctccaggaggccgttggtgatggggaagcgacgacgccggctttggtgaagcaacaggacaacacgagctcgtggctcgccacggctttagctccttcgttcctcttcccctttcctatacgcgcgtgccccggggggagtcaggcgcggggacggcggcggctccgggacacggagcagaggggcgccgcggcgggcgagcggagtcgtcaacgcccgcctcccccgcagcagcgtccggcgccggccgaacctgtccctcctggccgaccgttgcacgaccccgcgtgagctcgccgtcgtccacgccgccatgctcgtctccggccgcctcgccgacgacgccttcgcggcgacccgccttctcgccgcctacgccgtgctctccccttccgacgccgtgctccgcctcttcgccacgagccacgagcggcggccggaattccatgcgaagcgccgtcgcaacaagctctgccgcctcgtgctggctgttgcgtcggtgtagaggcggcgcaggggaaggaggatggaggcggtggtccggcgagggaggagcctggcaactgaggcggcggcggcggcggcggcggcgaggttgccgaggtcgccgcctcgcagcctcgctcgcctacgggaagaagatgaagaaaagggagagggaagaaagggggtgtgaggatgacatgtgggcccacggattttattatttttctgagatataattgccacgtctacgtcgcgtcagcgccatgtcaatgtcacgtgagacggagacctagtcaaaccatccacgtaggcgccatgtcagccaaaaccgccttctaaaccaccgagggacctcgtttaccccggttttaacagttcagggaccgtttgtatttggttttggggtttaaggacgaaaatcggattcggtgtaaaattaagggaccttagatgaacttattcctcggcttaaacccaaaactgcccccatactttccaaagcctgggcaccgaatggtatgggaccattttaggtacactctaccaaactggtgtctagtggggatgtccactcgctgtttgcatgtcattcaaataattataaaaaattaaaaagattataaagatatattaacatgtgttatatgatatatcactctataaacatgcaagtttaaattcaacctacacatctcgtaacaaaaaaataaatttaactttgaatatgcgttactagttgtagtttaatttatttttttttgttgcgagatgtataagttgaatttgaacttgcatatttgtgaagtgatataacacatgttaatatatctttttattttttaatttttttcataatcatttaagtgacatgtaaataaggagggataaaatagtttcatggtgcatgccgagagacatgtatgcacagtcaagacacaacaacacaatgcgaatatgttcatatatagcacgtttataagcactggtcggctctgttctgatacaaataatacacacagtaaacacgtataacgataatcattgacacgtactgcggcgaggaggggagaactagtaaatcatctgcgcctccgcctctgcatctcgccgttattaatttcacacttacgacaaacctgtagccctgtagcacacatcgttgttgcaccaacgaataaccgatctaacatatgcctgcagactgcagacacatgcatgcagcaagcatgcaagttgagatattgcttgcgatcgttagaagttcaccgtcgatatgtacgacatgccgggcttccacccggaagggatgacgttgctggcgacgagcgtcttgccggagctggacgtgaggcggatggagaacggcgcctgcagtgccgagccggcgttcagcttccagacggcgccccacgactgctgcatctgcgtccaggcggcgccggcgccggtctgcatgagctccacgccggagaggtcaccgtctccgttctcgtacttgacgagcacggcgaagtagttggggttcgagccgacgtccacgacgaaggtgagcttcactccgccccagttgcacggcacgctgtacacacatcacgtgcgttcgatcggatcgtttgaaagaaaccaacacgagaagaagaattgaaggacagttgcatgcatggaggttatagctgaagcagtgcatgtgccccggtggccggtggtccatgcgtggtgataagaaaagatgagtgaagccgtgataactgcaagtgttctgctgcttggccgacttttggccattgctgctgcagcaatttttgcacggaagtgaaagatgctcgcttaccggttgtactggatttggaggacgccggccgcgcgcagctggtcggcctggccggggttcgccatggcaccgaacgccgtgccgctcaggtcgaagtggaccggctcgctgaggcacgggcctccggggcactcgtcggtgaggacgacagtcaccgggttgcccgagcaagcgctatttccagtgcatttcacctgaaaaattatattgttgatttccaatgttagatgcaatacaggcatatactccctccttccctaaatacgccgttgacttttttaaatatgtttgaccgttcgtcttattcaaaaacttttgtgaaatgtgtaaaactatatgtatacgtaaaagtatacttaacaataaatcaaatgataggaaaagaattaataattacttaaattttttgaataagacgaacggtcaaatattttttaaaaagtcaacagcgtcaaacatcttgggacggagggagtacatgtatgtgcacagacttaattatactagatatatattctgatctgtcggtatatatgtacctggtagcaagagccgcagcccaagccagacttgtagatggaaggactgccggcggcgatcatagacgagaacggtgcctggaagacggcaccctggtacccacatgcaccacctgtacacacagatattgcactgttaagacatgacatacataggcatgaattttcttttcgaagaaactctcatctgatgacaacgtatttaccatcacttccggcgccatttgcagcgccataccacgtagctccgccattggaccagctggagagcttgcggtggaactcgatggaagcgcaagggcgtggaagcatggtgacagcggcaatgacaacgaaggtcgacaaaatcagctggaacctggaagccatggctgctatacctgcttagctaaacttgctaggattgttgttgctttgcaaggatttggaagatgcaagcaaatgagtcgatgagaggtggtgtgggctgtgtgtgaggtagctagggaaaggaggtgatctatttataggcagcagacgatgggtttgtgtgggcatatccctccgtgcatgcatgcgtatgcagacaaatcgctctgcttgcttgctctgttggatagttccatatccatgctaatgcacatggctagggtcaacatgtttaagtacagtcgaaaagtaattagctatttacgtagtagtaggccggtccttttgtgtgtagttcacttgtccaatcctcaattcgatcggtatcgggaccatggcagttttaccggtattattactagctttcagtttctgcctgcctggctagatctggcaagctagtgaatgaagccataccatttggctggagcccatctttggttaacaaactcgtgaatgtagcatacatgctatgtgtcattgcaccctgaacctccagggcggcatgcatgagagaaaggtgctaatacaattaatgtgcatagcttgtgttaatctgcaacagagggtaactgtacatgattataatttgtgcataacattgtcaataacttgctggacgacgacgcttacgtttgcgaatcctgcctactactattggcaaaatggaaagtcaaaagtgcacaggagattggccgttatttcggttgatcactgcacgcccgcacgcccgcgcgcgtgatgcgatggtgaccgcttaagcttgcgcatcccgagacgtctcccctagcctcgctctcaccacaccagcttcattcttcctcctcccgggtcaaccgatcgaccgtttcatccccggccgcatccccaaatccgccaatctcgtccccgtcaactctcctgacgagcgagcgcaccgtcggctcccgcgagcaaacaccgggattcggggcagctttgccgggccatggcctcccgggctacggctctctacatcagcgagaattaggcggtcgtacgtacgccatcggcggccaacatgtgcgcttggccggcgggagggcgggcgagctccgggtgccacgcgtgaatgtaggtaggctgcacacagtcgatcggttggtggcaacgacttggcgttggcgatcgatgtgcaatgcatatgcatgaaagtgtgtgggatgacgaaaggcacggttgcatgtaacttgcacgagtcgtcgtgcagtgttaactgcgggggatagctgttttgagtactgtggtcgcgtcaaaaatcgatggagtgcccgggtggctaattttgtccgccttgatttctgccattaacccgaggatcccgccatcccggtgaatctgcacggcacgtatggcatgacgtaatcacaggtgtgaaccggcctgctctgaagggccttccattctagcccattaacatttaacctccccaggccgaaacaggagctttggggcctaagcctaccaggggtttttccgtactggcttcactgcgtttccagcatatccattggctggaggtaattttggttttacttccagctggtaaatgtagcaaacgcagcacagtagagttcacagacatgctgcctcactctcaaaataaaccaatctaaaattgaaaaattgaatgtgacataaactcatataaatgttatatctagataggactttattcagatttatttcgtcaaatcataccctagattcgcttatttcggaattaagggagatcacaacatgaaccaacgcagcatgaattccatgtgaaattagtcctcattttgaaaacatagtatctttaccgcaacagtctgcaagaggtcctcgttttaaaaacagagcagctttgcccgcaacagtcttagagagtaaaccgtgacggtcgttccaaaatagcattaaacacaatacggatacacattctcccggaactccttggtacaatatcctaagtgaatgtctaattaaagacaaacaaaaaacttacaaacattctaggggtctatcacaaccatcacacatagcagatcactcgtgatcacaaaaatgagtgtcaatgcttgttactcttcgttcccgctctcttccttcgtaagtttgatcatgtcatcaatcctcaggatagtaatggccgcctcagtggcaaactgcaagggaaaaaaaaaggaaatggcgtaagggcctcagatttcagtcaaacatcatgataagacctatgctaagtataccaacctgaataatctttactttactcattgctggctcaatgacaccatattcaaggttgttgcgaatgataccttttgaaaggtcaagacccatgctgcagcaaacagaagtgaatttactggttactctattgataaattacacacattcaggaacacattaacttcttccttttaatagatggctgactaacattaactatatgtttaatgccaagtatcgcgaaaactacagatttaataataaaattatcacaaaacaacagattttggggttcaaatcattagcactaatggtatgtttgagttatcaacgtccaagttttgtgattaaattgacattaaacctgtagttttggggtaattttattattaaatctgtagttttgcaatacttggcatcagacatatagttttgtgataaatttattgttaaatatatagttttgtgatacatcacctaaatctgtagttttgcgataatttgctcaagtatttgtagctttgtgaaatttactctataacataatatctctagaattgtcccaaaagttcatcaaaaaagaatttggagagcttttcaaagatctagaacatactatatgtacaagataaaagaaccacatcttattcagataacaacgaagacatgttctgtaattaccttgaaaagtgttgcttatcagcctttgtttgagcagtatgatgatatgccctaagctttgctacaagctcagttgcatcttttgcagcattgacagaaagaacctgacatcacaaggtcacacttcacattaatattttatgtcatccagtatgtaaacacatagaacacaagtgatcaaacctttggaatgattaacaaagattccgcgaattcagcaatggccaactgttccctggacccaagggttgtagcaagattctccaagtatacagacaatgcagcttcaactgcaccaccaccagcaacaacctgcatgatacatacatgtttaaagcgccaccaaagttacaatgccagaactacattcacggctaatatgaagtatacactgccaacattgttctgtggatggaatgcaggcataaatgactgaaacaagtgacaacacagatagaattgcaccaagtggctcagttgtgaaaattttaactgctttggttgatttggtttgcaaaagcatggaagctatcctctgaagaaatgtaatggcaaacatggtcatttggcattgtacagcataagcaattgacaaaagaataatgatggggcactaaatacaactaatcaacatgttagtgtctaatcaaaggtctcacgtggtaacaggacaacagtagtgctcaaatgaaaaaaaaagacatttttttcttactctcccaaaaatcttaatataacagtgaactttatatattcaactgcagggaaccaacatgttaaggaacagaagcaaaaggttataccatattggattccagagttctcttcacaatgcacaatgcatcatgcaatgatctgtcaatctcatctagcatgaagtcatttgcgcctctaagtataattgagacctgcataaaagaaatgcaggcgtgattcccctaaactcttgctggttttgttatacaaaatataagatttgcattggaattgaaaagtacatacagcgctggtgttctttgttcctttcaccaaaattacatcatcatcagcaattctttcctcaacaacttcatcagcatgtccaaggaacgatgaatcgaatgtctcttcaccttccatatcagcaaatgtagatacctgcaatttactaccaaattaggacagcaccaaacagtttgtgtagcattaatattaggactagaagcaacaaacttaagactaaaattacagtggtatcgcaagggaagttgcttcatcatttattaattctattagtcatctgcacaattatgtattccaatgttgttacaactcgataaacaaaaggtgaggcataccatagttgcaccagtagccttggcaacatggcgcaaatcctccttacgcacacgccttacagcaattgctccagcctcaacgaagaaatgaaatgatattccattgaacagtcataaagcagatttaaagacagtagccaggaatcatcaacatcatacatatacaaagattaacacacaaacaccacatgaaccaagtagctctttcaaaataatcaaaaccaattcaataatgaaacagctctcttcagagtaaaaagaagtctaactaaaattatgaaacagaagctcagtttggacgaccaaaaagattcaatgatgaaagaagtttcctgaggaaattgataatgaataccccacaaacacccacgctcaatcaacatcaacacaataccgtccatgtactagtattcaatcaataacagagctcttaccagtccaaccgaagtcaatagattatatttaggtaataaaagaatgtttctacttgaataaaacataccttcagtgacatatcatcaattcccttagtggtcagtacaacattagcaccagccttcagaattttctcaattcgctcctttgttatgtcagattctctgccatgaaaagtaagattatgttttacaattggagaccataaattataatagaattatgtgtggatccaaccacattccacaaaacaatagaaataaaaaaacacaataaaaatataaaaaaaataaaatgtgcaaatcagataaaagagaacaccccaattgttgactcattaagtatacaaaacaaatgaatcagaatgcgttggaaaaagtaaatgcacatacctctgacgaattttctcaagttcccttggatcagttacaaggacttgaacacccaattgcatttttgtcttctgaaggttaaaatcaagacatgcaattcttgccggggttactctagtaggcattccttgagctgcacggcctgtgtttagtgcatacccattcagcaggtaactgtccttggcacttttaccatgggctttcaaaatattaatgctctgcagatcagatgagctatagttaccagcaaatttctgtcgattttgttaatataaaaatcaaaaaatggttattgcgaagtacttttagagaaataacttgaatgccatgtccatacatgaatggttattggttaacaagaaagtcaatgacataacagcatataattaaggtagaagttaaactttattagctctcaaggtgtccaatatgttatacataaccaggagaaaagaacaaaggtcacatgtagcaaagctcacaaacaagtgtaatactctacaatttccaaacaataatagaggctacagaaagagaacaatcagtgaagcacaagtgcacaattcaatatatctcattcagtgtattgcaattgcacacaacaaagttttgctttgatgtataacaagaatcacaagcatgtaactcaccttgataggatacttcacttctcccttagcgtttgtggtcttcacagcttggactgcatcgacaacctattaaacaacagccatgttaattatacagcacagtttgaaggaaagcttacagaaagtgaattaaagcactagcatttggctacggatatgcctaactgtcagatagagacttaacagtgaagcattatagcatgctacgacattggaaagaaataaattggactgcctatatatacagatatagagtatcaactaaatatttatttaaatttaaaaagtatcactaaaatcaaacttacagctgaaaatacaaatgtatatatatggcaataggaacttaccagatttgcgaagaaatcactgtcactattaatcagcttcgaggacatgcttgtcttcgcacagtttataagagaatcctttccaagtttatcaacctgaaaatgttgatagatactagtgtcaggtgtcaagaagtaatctgctgctattcattaagcagatagtattctcttaccttgacagccaacttttcttcaacatatttgcaagcttcacgcatagcaagctggtagtaaatgatggtaaaacatgttaagcaatgtgggtttgcagctggaacattcgttttaaatctgaaattgtactgcagctgaattatgaagtgcaaaactcaccctgtagccactgataatagatgtcggatggattttgtttctcacaagatcattgccccgctggtaaaaagaaaaaaagagtgtcataaatgcatatttagaatggtaggcaaatacatagggaagaaaagactgacacgaaagctccatttcattacctttagcaattctgcggctattatcacaacagatgtcgttccatctcccacctctctgtcttgaagctcagccaactcaacaagaacctaacaataacaggaccaaaaaacaactaagcacaaaacaacaaccaggggaaaaaggagatggcacctttaagctgcctgacatcaccttggctgctggatgctcgacttccaacatcctcaaaatggttgctccatcatttgttatggtaacatcaccaatatcatccacaagcatctacaagaaggatatgctcaattagctcattccagccaaccttttggaattatcagggattggtgtggtgcagaactgatctaagtctaacttcattaatcctgattaggtttagtgatactgatgcacatactgttgtaatttcatgatttcataaaaagtttagtgatactgacagttatttcgagcacataacaacattagccgcacacatattacaccgttgaatcagtaagcgactgaactacatctggatcacaatgagcagctcataaaggagaaaatacgtcattctaagtagcggatcacacaattttgaaacctacaagttcgcatccttcacacacagtaacaatttatgcgcaaccaagtagatcaaatcgcaaggtacaaaccttgtcgagccccacgggcccaagcgaggacttaacgatgttggccaccgcctggcacgccaccactgcaatcagagaaggaaatcaaatccccgcgtccggacggcgagtcgtgccactagatcttacaaaaacccgccgcgactccacggaatctggcggcggggaagggcttgcaggagggggagagacgagttaccgttttgcgtgcggacgtcctggccggactggcgctcgccgaggatgtcgggggtctgggcggtgatcgccatggcgacgacgacggcggcggcggcgaggcgaaaactgtggaggcagcactggagagttcgaggcgggggtcggcgtctgcaatggggggttttgctggaggagccgcgggggttagggttcgatgcggttgtgaaatggaccttggacttgatgggccttgatgagcccagcccattataccggcccaaactcctcacgaaggcaacgcgagctcgcctccccttccccccgtcaccggccaccacccaaaccaaatcctcgcccatggcgccactagtctcccacgcgaaaattctcgcgccgattccgaggggcaaccgccgcctcgcccccgcgccccctgccgccggcggcttcctccgcgccctcttcccctcacggcgctcccgccctccgccagagaaggacgagctcctccgcctcatcgccgaccaacgccgcggcctcgacacccagtccgacccctcccgcctcgccgacatcgtctcctgcatcgacgccctcgccgccgctgctcccggatccgataccgtttccgatgccgacaagctttccggtacgtggcggctcctctggaccaccgagcatgagcagctcttcatcgtgcgcaacgcccccttcttccgcaccgccgccggtgatgtgttccaggtaatcgacgtccccggtggcgccctcaacaacgtgatcaccttcccgccctctggcgcgttcgtcgtgaacggctccatcgagatccagccgccccagcgagtcaattttaggcaggcttcctccagctttttgtttaggcttaacataatcatctgttctttccaaaaagaagacatcatcgtctgttgtttcatcagcttgtggtaattagagcaactgctgattgttttattttatgtttgcttgttgcaggtttacacgcgctatgttgagagggagcaattgggaggtcccgtttccgccctttgggaaaggatggtgagtggaagatattcttcaattggtagtatcatgcacttcactcgaataatcttacaagttgagttccaatgaaatagcaaaaacaaaggagacagaaaaaaatgtggaagcatagcacgagatattgtgcattgtttgcaacaattttcaaggaatgaaatcgtatctagcattcatggattgatattgtgttcacgtaatcgtaaaccatttcattaaatcaaatacattactctcgcagtcataattattttaggtaagataagaattggtcaaacttttaaaattttgaccataaattattggtcaaatgcttagtttaaaagccaaaaaaggggtatacttagatttgactcaaaaatatatatatcataaatttattctaatctaaaattaatcatccgagttttaaaagtttaaccgaatcttgtcctaagtgtcaaatatgtatgaccagaaatagtttttggaactgtgctgcataatcaacaatttataagtctaacaaacttttcatttttgttactagatgaccaaatcatcatctacaagggctttcctttcccacctccatttttagggatggtgtatatgttttcttcacctgatcagtagagagtgaatgtaaataaagctggactggaaacacatttttaccagttaggtctttgacatttgttcagtttatcagttctgtttcgttttatcagtttctggtttgacaccatctatttggaaatttggcttgtatgtgttaggtcttttgacatttacataatatatgcctctactttcaggtttgacactgtctatttggatgatgacatccgcgtagcaaaggacatacgaggggactatttagttgttgaacgcgctccatattcatggaatggatagttgttaaaattcaaagttgattgaatgcatagccagtcttgtgatgtgccttgtgaatataagaagcagattgtcagagccttgtgctttctcagcaaagtgttaaccatcgtgctatgacatttcttttcctagacaatactatgttctcccggaattagatggtaagtttgattagtaatgcatgtgcagcaaggttcttcttccaaggaattgtctaggttaaataatacctaggtatcccctatgtgagagaacacaaacttgccaagtatttgatgtgcttttggacatatgaaaaagatgctgcccattacggtgaactacgttagcgaacttgacagcatattgttatggcccacgatatcaagagccatgatggaattgttgactgtttcagtaccttttgttagtattgttttgcctgttgcttccagctttaagtagtagtttttcacattgaagcaagttctcagcaaatcaggtcaatgaatgccatcatctgattaagatagtaaactatgtatggtcttgctttatctgtatcagggttccttttccttttatactcatgaggagtcaatgagatcaaatccaactttgctttgggaaaagtagcattgtagtgtcgcaagcttaatgatatgaaacattagattcagtttctgtaaccacttacccatgatttctaattctaggggtttcagatacagtgttatgtttcattccatctatcaattgaccactgaagatcagatcaactttttgcagggatcggactctatccttctactgcccccttggaatgctggcaggatttgtagtgcaatgagaagagaattcaatttgccatgtctgaattttcctggttatttttgtttgctcgtttctttatctaggaaaaattctgctcaatacctggtttaatttttgctgcatcgtcaatgctccctgtcatttaagaaaagtaagtgaaaaggtatctatgtgatagattgattgaacatcactacttctccatgatattccaggcctgaacagaagcactgaagcaaaatacttttgaaatgctttcgttggtcctactgttgaactgaatagcaagttctcctttcaacagcttgtttcaagtgtctagtctgataattgcttccttgtactagactactgcaggttctagtcgcagtcgaacaacatatggtgaggctttaggaggacaggttggaccatggccctgggccagactacattgtgtgatgttgggcagtttgtgtacgctacgtgtgaactcatcagctcatcacgaaccagcatagaattatttttcttagtttgcttttgtttgtttggataccatttccttcaccttgagatatttggttaaggtggattgaacttagtaatgaagcaattcttttgtaatagcaggccctccctgaccaagtactggagccacttcaaaggatagaaggcaaaggctccccatgtgaaaaaggacgctccatgaccctgccatgtgtggtcatctgcgatttggtgtcccatggacagtgatgcactgattccacccttcgagtcttaaaagcaatccaaggttagtttacataccttttgcagcttagaaatactgaggataaaacgaagatagtatatcgtacacactgctggtctatagatgatctgctggtggccacaaacctttgcgtgacacttaatttggtggagtagtattttgatcttactggtatccttatatatatttctgaataaactagtatacaatggacaaagtcagttgatgtttccaaagaaaagcttgtgccgacatcaattaatcattttaaagttgcaaaaggagctataatgcttgagcatatctggaaaagtatgattaaagtatgcatccatacaaatcaaccacaatatattcaagattgaggatatttgaacaacatttgtagcttgtgcatgtttaacgggagcagaattattagtttctcttttttttaaaaaaaaccgaaggtagccatttgaatatattaaagagaaaagctaaaaaacaaagtgcatgcccaagcaccacacgctaaccacacaagcataaaccactgagagtttagagcctaacaccaaaacgatccccactaaacgtgaccaacaacaccaaaacaagaccggcttcactccacctcctcatgccgaggtggttttcgccgagctctttggcctcgcagccaccttcccatcttgccgctagcttaccatcggcatgctccagcggcggcgaggtggaagaggggtggagatgtggcggcacgggtggctagaatttcgccccgagccgcccacgcgaggacgacacaggggagggagtagtagattgctagcagcaaccattttttcttttttatattagttctttaggaatgtgagcaggattattagtttttctgtttttagatgaggatcattactcgtttttcaggaacgtgttcacagcttttctttcttttctttttctttattttttttgcatgcaatacggatatgttcgtcagagcgaatggtgtcatcctataatccgtgctgcaaattcaatgatccagttactctagagacggaaggcacgcgtcatagtatcatactccgtactttgtttacactgtctctatactctgatagacgaaaggcacacagcacactggcatatcgttatcctctgtcagtatagtacagtaaagcaacagccgttcggcactgcaaatctactactatcgtaggagtatactgtatgtggattggatagatgtacataatgagatggaacggctttgcgttttgcagccgcccggatggtagccagcagtccagcaccaagagctccaagacacggcggaccgagccagccggagggaggggatgattgagacagcggcctctgcggcgacgacagtggatcgtgagcagatttatcctgccacgagataagtacattgtactgctgactccgtttcaaaatatagctatttttagcataatactttgttctaaaataaagctatttcttcatctacgttctcaatcaatcacaaccattcttttgcatctaccttttcttttcaatcaatcgcacactttctctaatcattatccctaattttttaatacccgtactaacttaaaaatatttatattttaggatagaggaaatagtagcagataggtgcggctgctgcatgctatgctgtgcacccctacgcaaatgcgtctctccaatgatccatctatccgcatccgtctccatccgcggcggcgactgggggagcatggcgtggcacggcaagggggccggccgaccggcgtggctgtcgtaccccccaagaaagggaaataaaatccaaactggcagcggcagcagcagcggcaggatcggatcggagcggccatccatctatcgtcgccacgctcgctgagtcaggtccgtgatgatatgatatgatcgggcccccggcccggggtctctccgccctttttctttccttccttttctctatgctgtttattgtgggaactggccagcggcagccgcagtggtggtcctggtacttgcgcacgtacagccactagctttccctgcagcagccacccactgcacctgctgctctctctctcttcccctctccctgcccatgtccatcccgctttgggctaccatctccccgcttttccatcgccacaatcatgaccgcacgtagccacctaattacgccttggatcacctccaaattaatcgcccttaatgtgctctctttttcaatgacttagggggtctgttcactttgatgttaaaaaaaaccttaccaaatattagcatagttgccacagaattttttatatagttattaaaatttggcagcaaactaaatgtagccacttttttagcaactttaccaaaacttgttaaggttgaaaatagcatcaaagtgaacaggacttttgatactctgatacgctacggctggtggctctcgtaagctggatggccccagctttaattagatcgagacgagtaaaccggttagagtatgttcttatcaggttatctgctaaacaggtttcaattctgaagtatcgtacgagaagttggagatctctaattagctagctactactccttccataaaaaaacaaatttgaagggatataacataacttaatagtgcaatgaacatctagattggttttttagataaaagagtagctaagaacctaattaatctgaaacaggagtagctccccgtttttaggcacacgggaccatgatatcctcccctgtctaggacgtcgacgtggttcaagacgaggatcgatcaatagtacacccgtcaataatgtcatgtacgtacggcttatgcctactccctctgtccaaaaaaagaaaaatcctaggtttccgtgcacaacgtttgaccatacgtcttatttgaaaaaattataaaaaaaattaaaaagacaagtcacgcataaagtattaatcatgttttatcatctaacaacaatggaaatactaattataaaaaagtttcatataagacgaacagtcaaacgtacggaaatcaagggtttgtcttttttttggatggagggagtacgttaagtaagcactcacgcaggccggcaagtacctactccctctatccttaaaaaaaaccaacctcgtacttggatgggactcgtctaaaaaatctagtacgatgttggcttttttggacgaagagagtacgtataacataacagtgactcgcccatacttgttttgtcatagtacatgagatatacctcgtttatttacacattatttaaatattttttaaaaagaaaatgtattgatatgtaacattaccatacatgttacaatttaacttctatatgtaaaaataaatagattgtagctaattaacgcatattcagtcaaatttgtttttttattacaacatgtagaaattaaatttaatcttacatatttgtggagtgatttatcacactaatttatcttattagaaaataaaataaatttgtaactgctccatccgtctcaaaataaatcaacttatggaatttaaactttatcccaaaataaattaacttctaccttcttatttactttggttcacaatgaaataagagaatttcttccatacccctgaaattttagccgatcccttctattttcctgaattttcttcactcccttgtatacctctgaattttgatttggatccctttcatacccttgttgtcagttgaccgtttaataagtatcaaaaagtcagttttacccttcaatacgtgaggaatatgtagaaatttgtaaactatattgttgcaagtatagaaatttgttgtgtgattataatatttgtaagtttgttgtacatagaaattttaataaatattaaaaaagtatgtgtaccattttctttaaatgataaacatagttttggaaaacattcctatatattatataggacatgaaaaaacacgttgaactaccataaaaaaaggatacatatactcttttaataagtaaataaatattaggtttttatgtcattatcttaaattaaactttgccattaataagttgcatattactccctctatccataaacttacacctatttcatatttgagtttttccaaataagttgtttctatttgtagtctttatgcattcaagacttaaatgaagatataaataaaatgctttattagaacccaatgagtcatctaaatactcattagttgcatacttacattcacttcttgattttgtaacatccaaggtgatttaatttctccttggtcttggtgtcaaaagtaatatgtgtaacttttgtggatggagggagtatgatagtttgttcaatgataaacctactagtaacatcaattttatctgattgatctttttagggcccctttcaatcaaatgaattatgaaggaatttcatagaattgaaaccctatagaaaattttcctatgtaacctttgattcaaaggattaaagttttctaaaacgtacaaaatttctatggaatggcttatttcatatagtttttggagaaaacttagcaagaggtccaacctcttggtaagaatcctttgagtctatctcatccgattcttgtgttttttatatggtccaatcaaacgatgattcatgcatgtgtttttcctgtgttttgcaatcatctgttttatatttacattcatgttagaattctatatgttttctatttcttcgtttttttattctcatgattcgaagggacctttaatatttttgatattaaaagttaaaaatgtttgggactgagggagtaaagctaatggagtactcctaccttgtagcaaacggcgttgctgaggccatcaggccaatcgtctggctggccgaccacgatctacactgccctagaagttagccctgtcagtggagtagtactggtagttaggccgcgcgcgtgggtcgccaattcaccctctctatagctacaggtgcgttacaggtgcatcgccggccgtgcagtgcaggctgcatccatgcatcgtacacctcgtggcgttcgcgtggcgtgcatgtgatgagctcgagctgcgctaacgagctttccagagcaaagcgacgcgcgcggccggccggggctgcgcaggaaaaccccgaacctccatcagctgattctctgagcgtaaacctggagctacctggtagtagtagtattacgaatttaattacgatacaccgtcgcacgtcgctcacagccggcgcacacagctaaccagccagtacataccagcggatagatcaggcgaacggcatatactacgtgccttctgtatagtgttcacgctgtgtttagatttaggggtaaaaatttttatcgtgtaatattggatttgaagtattaaacgcactctaataacaaagaaattatagaatccacctataaactatgagatgaatttattaagcataattaatctgccattagtaagtgtttactatagtgctatattgttaaatcatggagtaattaggcttaaaagattcatattacaatttacacataatctgtataattagtttttttttctatatttaatattttatatatgtgtctaaacattcgatgtgatatgtgaaaaaacttatcaagagatctaaacatgcccataccttagtatatgcgcccacagaaaaaggcaaaggggaattaattagtacttgaatacttgatctctagatatatgtatgcatgattctgcgtcgaatcgtggttaccgaaaagatatgatcgagagctaggagttaactccatatagtagttaattatgttagctaagagctaggagtactcgtacctttctgatctccttggaatgtctttttctcgatgaccttacgtgaaagcgtaacgcgatcgagaaccgactcagccgagactcatcgttgcgcacgtacacgcgcgcgggggtggacggccggcgtgcacggttccgctgacacagacctgcacaggcgggcaaacataattagatcgagtagcccatgcatgttgattataccagtaagtttcacgcacgcacaccggtccattgatttctcgccgcgcttaatttgtcctccgatcctctcctggtctcgggtctccggaagttgaaattaaagcttcttcgatcgcgtgcgccgattgattcggattaccaaacttcccagagattttagcgatcgaatccctgctttgagatcgacgtgtactctccctccctggtcactggatttaaggttgtcgcgtgccccctccccctgcgacgactgcgagcctctccttcccttccaccttttttcttcctctcttcgcatgcacgcacgtacacactcacatccccccttttctctctccagatatctctctcatactatttaataaccggactcgtagtccctacctttccatgattccatctcctccattcccatccgcccgcatctccactcctcctctccccacctcctcatcaagctagctaagctagctctcccaaccatggctggcgccggcaccgtctgctccatgtgcggcgacgtcggcttccccgacaagctcttccagtgcgcgcgctgccgctaccgcttccagcactcgtacgtaacgcgcgacccggccggtgtactctctaccactgtaatctcttctctatctagagctagcagcgaacacggggtgtgtgtgcgtgtgtctgtgcggtgtctgtgtatccatgcatgtctgatagacttgtggcgcgcgtgcagatactgcacgaactactacggtgacgcggcgcccgccccggccggcgccgacatgtgcgactggtgcctgagcgacgtcgccgggaaggcgaggtactcgtcggcggccgggaagcagcagggcgccggaagccaggagtcatccacgacgacgtcgagctcctccgccggaaggggtggcggcggcaagcccggcgccggcgagcaggagagcgggcggcgggggaccaaggcggccggccgaaggtacaagctgctcaaggacgtcttgtgttagtttgtttgtttaggtcacccatgccgtcacccagtactagtcgtcatcgcttaggctatatagactcgttagctagccgctagtttgatgatcgatgtgcatatactacgtgcgtactccatattgtatctagttgtgtgtgttagggtcttttaagggggcctgttacctgaaatgttgcactcttggcttgtgtttctcttgcgttatgcttgcatgcttttctagtatcttggataatttactgcatatatatctcttgttatcttcccgggttctttctaacagcgatttgctagtagctcatatcacatgcatgcatgtaggtaatccctacatcttttgatcacaccttgtgtgtggtggaatatttcagatgagctattaatttctcctgaacttgttagaaacaacaggatgcatgcatgcattttctttatctttatacttcatgtagttttggggccggggaactgaggagcaactggccatcacgcacgttgcatgctgccaagccgagccatgtcgatgtaggggtcaacgaatcgtacccaaagacccaaagtggccgacaaagacatgctcctacacaaacctcaagctctgcacggcctcctctctacgagtagctagcttgtggccaagatccatttagcccctgcttttgcctcgattggatggcaatgcaaatccttctgctacctatagcaacaaactgcatgcgcacaacagcccagtatcagcaacattgctgctccagaatgccatcactgatcatgttctcccatttgtcctttcgttgatactcctaaatactctgaatctctgatcaatgagcctgttgatacagcactgtccgttattcaaatattttagtcagtcttgccgtacctgatcacttggcgattatttaattcctagctagtactctatatattgattcagatctctactgggatgaactgtagccataagacaaaactttaattatgaggggaagtttagttaagtggaattaatagtagatgacggcaggaccaaattagctgtgtgtggtagctagctctagctcgcccacagtaccagcggtgcagctgaccctactcttgtgcatatgtacaccatctggtcctttttaggtgtcatgtagctaaacagaccagacatcgcgggatcgtagctaggtttctttctccctcgtcttctacactgtatgtggagttatctttcttctccctagcctagctagctacctatcttgcacgtactactaccaaacaagcgttgttccttaatcataaccgaagtttaattatttcttttgacactgtttgctagctagctcatagcatctacttcctccgtcccaaaaatatgtccagatttatctctagagttctagaggagtactaaaaggactactcttttcattccaatttgatcatcacatatgatttttgagttatccctaaaatgatcgtactcctatataataagtgcctcttcatttatttgtgaaaagagtaaatggacatcactgaatgtgttggtatgcatgtaactagttaagattaatttctattggttcaactccatgcaacatttatagtgtgatgcaagctgtgggacacaaagcgatggaacacattgattagtgataattaattttagagccatcgaggttttattgtctttggactcgatgctctttgctttggtgataatcaaattggaattgagagagtattatataagattgtagttgcaagtatagctttaaagattgtaaacatactgcaagcagctaaacactacaaataaaaggggtctattgtgccggttgtgaaccctcgtctattctgggttcccaaccagcacaacaatcgatgcaatgatggcctctcgacctcattgtcgatgtagagaataggcactaatgggattgacgagctaaaaaaaggttgagccagcttgaattgagatgacgcggtccaaatcacatatcatgtatcgatgccc

SEQ ID NO: 18232 - DNA, 20033 bp, Oryza sativa
acaaaagaaattgctcgagttctcaaatggatagcatgccaaggtcggcgaagccgttgtttctcgctgaaggtcaaggacgccacagctctcactgcttgccgaggctaaggctgctgctcctatgattgtggagatcgagagagaatggagacaccaagagggaagagagtgtggttgtggggatgtatatgtagaagataaggtagagagagagagagagtggatgtgcaggagataagggagatatcaactcgagtaaaaaaccattagctcggttggctcaagtaccagttttacttaaagaccccacactaatgagtaatgactaatcatcagtgacgatttataatagaaaatgacactcataagtagactacttatctatgtcggttcttagctatattgggcacagattgggtgggtggatgcgaaactccttatcagtgccaggttttcttcatccaatagtaaaaggactgtacgaataagttgttctgtagtagtgtaagtagctaatcatatccatcttgtatacgttgtcatacaataaaactagacaaggactctagccagacattccactcgtaggtatcgcctacacgggtggcacatgggtgaaacctagctactaatcgttgtcaatctccaacccgaccctcatagtctcagctagccatgggcggcatcccttttgttgggggtgtgttgaaatcctcggtcgtgggagtttgtcaggcctcctttatcatccgtgggcggacatcgatggaaagatagtccagtgtacctaagtagcagtggatgcggagtgcgttttttggatcttgtagcccaaacctagatgtttgttgtcttctattactctctccattattgaataattgacattttgaccatagcatataaaacaagacaacaaaatttatggccaatttgcccttggcaattgttagaagatgacgctaaaaatgaataaagttgaggtagggaaaggaattgagggaaaagacaactatctagatgcttactctatggtggaagatttatttaggcccaaaagtgtagatataggatagtaggggcaaaattgggattttagtaataaaagtgtggtggtgacaactattttgaaacaaatggtttgatcaaaactatcaattattcaaaaatagaggtataggatagtaggggcaaaattgggattttagtaataaaagtgtggtggtgaaaacaattttgaaacaaatggtttgatcaaaactatcaattattcaaaaatagagggaatagctattcttcagcagcaaaccggtagcatcactggaattgactggaagctatgctaggtctacaacaagcaggcgcccaggcaacgaatccatcatcttgctgacgcgggtcgatggagttcaagtgcgcttagtaattggcgtcagtggggattgtattctggactcttaagaggatatccccttgtttctcctatgtcatctatatagttatgaaagaaaaactcaatcatgttttttttctttttgcatgttgatcttggatgctcaaaactagttggaaaacgactaaagtgtcgtacattaatacaaaagtagtatttatgggagggttggtgtgggatattaaaggaatcgaactcattgttttgtggacttggaataggtgagaagataaaaataaagttatttttttgtaaaaatgaaagaggctaaaagcatgcttattttggatggatggagtatgcttgtagtaaaaaatcctagtctaactgtccaaacaaactcaacctaaaaattgtttcccgtgttaatggtggtgcagtggatatcttagtatcttattactactagaaaacaactcgttgtggctgtcgcagctggtggatgcgcaattgctaatctctacgaacgcagtttctaaaggaaaataatcctaattaattaagagaccgtgtatttttatgcagttgggatagagacctatctaaagatgtaaatattagggaatgacctaatatcaaataattagaaaatgttaggcttcgagcctaggtcatctagcccactatcctgtggagctgcccaaacaccctagacgtttctcggatagagacctatcttacaatacatgtttgttttgtttctatagatttctccatccatccgtgatttcaattctactgggtggtgagtggccgggattacattaattattttagctagctgccatgacaatttacttatggctcattcaaaatacatgaatttcataggatttttatagggtacacttcattcttttaaaattccgataaaattgctccaaaccaaataagcccttagtactccgtacgtttgtttttttctcaaaatgtgttgttgattacttttgtaatggcgtttaaccatccatttcattaaaatttagtgcaaataaaatgtgaagtcatgcttaaaatacttcgtaaaaaaacaagttacaacaaaataaatagagctcatataataccttaataagatgaataattaaaagtcatatttaaaatgtgtgatcgtgtcaaataattttaatatattatgtgtgtatgtacgcaaacctagcaattaattagtttttttttataaaagagatcaggaatggatcccaagtgtacaatgtgtagtgaactagtgattactacatgtgtcggccggagagagccaaagacaatgagctttaattattaatttgtttctaagcagttaataggaaggatcgattttttgaagcacttgctagagctatcctagcttgctcccttatattagtttgagcagataagaatcgcagctacgccgggcccaacgacgtggacggaagatatttgcatttgtagatacttgaatctatcgtttggatagtgctcccctgcactatgccatgtaccatatctttcatagtgtcaaagcatggggaacgatgtgtccctgtccctgataacttcgatcgagtgccatgctcacattcatgtactacgtgttcattcattgcccgttggagattttttttaagcgttttggcaagctaattaatcaagtccatgttgtgcttgttcttgtggggtcgatgatatgccagtatgcacagcatgcatgatagaacaaatagcatgccaatacccatctctatgcatgcccgttcaccactttgaatgtgataggttgtggtggccaaatggcacatattggttgctttgtaaacagttggtaaggcaaacacaaatggctagtcatccattcaaataacgttgtggagtagcatgagaatgccattagtcacaataatatggtaggacattgtgtcagaaatgatactagatagcatcaaccttccatgacttcgtatcatacactgccggagaaatgctttgtactctcggattgtaatcctctattgttccggttatgcaaccgaaactagagatccgggaataaagatatccatctttagtcccggttaaaataaaccggactaaaaatcattgttagtcccggttggtaggactaagggattttttttctgtttccactgttgttttgttgtttgcatctcgtgcacaatcgcacaaaaatcacacaaatcatacacaaaatcacacacataaatcatccacaaaaatcatttacaaatcatacacaatacatgcccatccacaatccacaaatcatcacaaaatcatccccaaatcaaaaaaaaatctacacatcaattcactgtccatccacaatccacaaatcatcacaaaatcatccccaaatcaacaaaaataaaaacctacacatcaattaaaaaaaataaaaaatgctccacaggtcgccgccggcctcccgccttcagccaccgcccagccacctcccctcccggatccgacggaggggaggccgccgccaccctcgcatcgccccagcgccaccgcagccgccgcctcccctcccggatccggcggaggggaggccgctgctgccgccccgccacttccccggttgcttggctcgccgcccgccggctagctcgctccgccacctcccctcccagatccggcggaggggaggccgccaccgccgccgcccctcccggatccggtggaggggaggccgccgccgccgtcaccgcgccgctgagagagagggagagctgaggagccagctaagagagatttttctaagtgtttgttatatagtaacggggcggggagaacgatgcggagaggctgatccggatttttattttgtcccggttggtataaacaaccgggactaaatattgatctttaccaaccgggactaaagataatgtaagcatgacgccggcctgacgatttgtagaactgggactaaagatcaaaatgtaccctggctttttgaaccgggactaaagttattctttagtcctgtttcttacttagaccgggagtattgtgaattttggtcgaccgggcaaagatggtttctccagtaatgatatctacacatgaactctcgaaaaagcaccctaatttaagagatatcatattacaatgtcatttgtatttgggacttgcatacaaattaaacattgtcaaaataaacgtctgtacgtgctaattaatttttttcttatatgagggcaaaatgttgtatactcctaataaattgcgaatatatagcccagcatggatgcttggtttgagctacgggagcaaagttggaactagctaggttgcctcctatactaattattgatcagccggggggggagggtttgttttttgtttctggaaaagtcaggggggatttgttgcatgtttgccattataatgttattatagatgtatgcaggctcaaaaccatactttaatgccctttttcagttgcacttttaatgaatgaaaaaccgatggtgtgtgtgtgtgcgtacacatcatatggtggttatttaattgggtgttcaattataacatgcatgaataattcttatcttgcaatttaacatagttatgttaatatcacatcaatgcacatatctcaagctaattttagagagtatgtgcaaaacatgcaatagttggagcatctctatcacctctccaaatatccatctggccagcttgccaaatttatctttcattccaataaccttttcatttcactctcaatccaacaatgggtatcacatgtcaccctctctttacttcttcctcccttcttctatctttcccatcccaaccatcttccctctccacccgacgacagtagggggcgacaacgacgaggtggccaacaaggggaagcagggataagggcggggcaggtgaggggagataaggcgtcatggtgttactgctgccgccagcagtgggaatcgacacagggaagagcaagaaggggcggtgacgcacgcaccagcaatggagatgcagacaatggcaatgcggcggaggttggggaaaacggtggcaacgacgggctatggtgatcctctcatcctttgttggtcacctcccttccgagctcccggctcccgcttctgccactctgacacccttcaccgtcgcgtgcaggccaggccaagccaggccactgcctccacgcggcccttgtggtgggagttgtcggtggcgtggggaggtgattgccgagtgaggagtcaagcttagggatgaggaggttaaaggagacattgacgattggccttcttcctttacagcgatgcatcagcgcgagggtgggcgttggcagagaagagaggagacggagaaacggattgaaggtgggactgataatgcgacccttcgtttggtaaatagaggagcctggccacatttggccacccgaggaactcgtttggaagagagttttttcactgtgttggctaaaatttaatttgaagagccatctaatgtggtgacagttgacagaacatactgttgtattccggagggctgacgaacctgctgatctgtgccaagtgtagccggtcttagggtcactggtacaaatagctaggccaggagcatcgatctaagacaaagatgtgttggtcttaggttcctgaaaatatcagccggtgcgccgtgcgcgagctgttaatcatcaaagcaatggccgatgtgggtagcacaaattattcggaaccaactttgggcccgtttagttcctcaaaaatttttcccaaaaacatcacatcgaatctttagacacatgcatgaaacattaaatatagataaaaagaaacactaattgcacagttatggaggaaatcgcgagacgaatcttttaagcctaattagtccgtgattagccataagtgctacagtaacccacatgtgctaatgacggcttaattagtctcaaaagattcgtctcgcggtttccaggcgagttctgaaattagttttttcattcgtgtccgaaaaccccttccaacatccggttaaacgttcgatgtgacacccaaaaatttcctttttcccaactaaacacacccaaaatgttagggacaagagaacagtaaccaaacgtactgtcactgtttggttttactaatcagtgactttgtagtccgacatgacatccaacaaaccccgcctgacattgccgccgatcgagaggatctgggggattcgctctagtaggcactatcgcacagtgaccgcgtctctgtcttctagaacccaatgcgacgacctgataagatcgcattatcacatccatagttttagtatctgtcacaatacacgttttgtcactgaagaaaaccgaacaaatacgtgactatcacgggagaagcgccatgtagttttagtgtctggcgccggaggtagcatcggtcacaattcacacgtcgaactgtgatcatgcggagggctttggggtctgcagcttgggttggaattcccctcaagaggagaacagagaacgacagcatttcgtcgctccccccacgacatcatggcagaaacacgcccgtgaccaccaaataatgtccacccaattggcctctaatccatcagaaaagcagagcgaaaaaatagaacattgctagctagtggcaccaccaccaccactgcaccagtactgctacatcgggatagattgctacgagacgagacactattgtccaacgaactcaagttgattgcacggctgcgcgcggcgtcgggacagagctccagccgtgcgcgcgcgcccaccactgatcgatcgcttcccacgcccagctgacacgggagctagggaccgtggtgcacgcgcggcgacgtcgcggctggcaggtcggacactcagaccacgcgggcgccctccatgggcgacggcgtccacgcgtcggaggtgcagccggcgtcgccgccctccttggggggcctcgctggcacgggccggaacggcgcgccgctgcctcctgccgcggtggtggcctgcatgaggtcgagcgtcacgtgccccgactgattctcgtgctgccctccggcgccgggcggtggcggccgcgcctgcaggtgcgcgtgccagccaccggccgtttcggagcccgggctgcggcccgttggacggccagctggtggcggctgtcggtcggagaagaattgccacgagaggagggccgcgcggttctcggcgatgagctcgtcgagcgccgcgcttgagcgggcggagatgtcgggcgtcggcatcagccatgggccggtggctctagccgatgacagaagagagagagcaccagccgacgacgtcggcaggccgtacggcgggaaaccgtgtcccagcaccggcatacctgcaacaacaacgtcgacacgttattatgcatatcattgtgcctacagaaatgtggccatctgttatagtcatatcaagaaagcataatgcacaccatcagtcctaataacgaagtggttactcaaccgcaatcatttttgcatgcttgccctgatcatttgcaaccaaatttacaaagtttaaaaccaaccaaccatgcatgttcaccgggtacaactaattgatactatactatatatctttacacaaactgatcgctacctgatcttccacaacatcatgtctatgtgttgatcaaataacaggtttcaagtggtcaataatgctgatgggctttgggtcactagcatagtaaaaacgtgcactcgaccttgatgtcaagtttaggtccatggtaatacgtactaatgttattgttaaccaagataggcccattatgctgttgttgattatgttgacacgaaagtttgtggtggttacgattgttaatgtctttattgtttgaggcaactaacttaaatcttgcattccataatatttctctgtaagacagccagaaggacctactccaaatcaaagtccacataaatactggagtacataagttatcacagaatataaggcatgttcatctacaggatctatgtcagtgcagcaggagtaccatgtactgtattttctactgcaggagtaatagtttctcagaacaagagaaaggtagtggtagactaaaaggagtactccctccttcctataaaaataaatctatgaatctggacagatgtatatcaaaattcgtagtattagaataagtcatatctgacactatattgtttttttatgggacaaaaggagtatacatatatacaaggtttctgaactgcagagccgtgcttacctttgaaggtcagtagtacaactatactcatgaaagcatatcaatatcaatcaatacacgcttgaatatcctagaatgccgctatgaaattcgaccgccgtatgtccaagtctttcggccagtcccgctatagcactataccttcgtacagtaactattcgtaattaactgtacagttgtacgcgtatgtatgtacatgcgtactggagtagtagtactagtacgtagtagtatagatttccgtaagcatacaggctcttgataaggagtggaagatggatggatgaaaccactgtttgccgtgttgcgtgcgcagcgaccacccggcgcgcgggttcctgttgatgccatggtgatcatatgcacggtcggcctggccagtggccacgcagccactgccactccaagcaagcaggctggctgggccggccaggcaggcagcgcagtgcacataaagtcgtgcattaaaatctgtgctctcagcgtctcacacatcccgatgagctttttggtgcgcacctgcagctctccccttgtttcccggcatcaaaccaaccagtactcctactactgggagtggtacgctcctgtttgtgcagctaacctgcctctccattggtctccctaactattactgggagtagtacgtacgtactacacgtactagtagtatgatgattaatggaactgttacggccgggacgggaggagtttgttttgtgtataccgtgtgggtgcgcagagcccctggccatggcctcgctggcgttgctcctccgccgcctctcgttgtgcccggccagccgccgccggcagctcttcttggcgtcgtcaaactccgcgagcacgtggaacctgcgcgtacaagtgaaagaccgctatgagcacgcgtgtagcagagctagacatgtgacgtagatcgtggtgattgacgcaccggctgcattgctggcagaagcgctgctcggtgccgtgcacgacgaccctcggggccttggcgtgcacctcgcacaccttgtgccgccggtggtactccttgactccctggagcgtaatgtcgcacccctccacctggcaacggggcaccaccggcaccgccgtcgccgccttctccttcctcttcccctgatccgcggaaccaccaccgcctccgcctccgccgccgccgctcccctgcgccacctggccggcgccgtcgccaccccagaagcacggccgcttcccgagcttgaggcaggtcagcccgccttgctgttgcatctggacgtcgggcctgcatggcgccggcgggaggaacggcggctgcgggctaggcggcgaggtgacgacgggagcccagtgcatcccaacgacaccacgtggtgtcgccccgcttccgccgcagccgtttccttccatggtggcagccgcacacggacggacctatgtgtaaacgtaccgcagctaagctagctagcgtcgttacacagcagcagccacctggtcgcgcgggcttggcttcgctccggccgacggcggcggatcgaaaactagcgccgattgggaaaaaggctgcggcggcggttgtaagtacagcgagtaggtttgccgcactggcgttccatataaagcgaagcagccaggcagcgagggtttgtgaagcgaagcgcacccccggggaggagcagcctactggcgaggaagcacgcgccgtactgacatgtgggatctcccgtcaggattggggtgtgtggtggggtcacgagcgtggctcgtgacatgtggggccaccgccacatggagctgtgtcattgacaggttcaatcgaaggcgggccccccctcgcccgctgccgctgcctctgccgctgctgctgcgccgtgacatgactgccacggcattaaacgccgcgcgctgtgtgacaatacgctcatccgcgcaccgcgcgtcaaccaaccaaccaatagcgcgcgcctcccccgacactgacacgccgggccaacacctctggtgccaccggacgagccccacctgtcggcgagccgtgccccgcgtccgtacggatcacgggagccacttgcgcaaagatcccacccatatccggaaccggacggcacgatagattctcccagccaacgcaccagttgacaaccgcgcagcagcccacctgtcgacgggcccattctatccatggccccacatgtcatagaggcatccacagagctacgcggtggagtacatgggacatggggtacgtacctggtgggcagtgaaaaaaaaaagcctgcgaggcaggtcgtgggtgtgtacatgcatgcagcgcgacgggcgggggtggggcccagtacggcggtggtccagttgtcagtgtcagctacagggcggcccagtgcctattggctggggaatggggggtatgtctgtgctttgggggaaataacatccccgtgctgggcgttggggaggatacggtgcagcacgtacgggtacgcctattttggccgcttcctgcgccattccctgcgacggtgctgctgcctttggctgcctcacctcacgtccttggttactcgcgcccgcgcactgtactactgccgctgacaccagtgttctgtttcctttcttcattttacagtactgtactatacgttttactacccctagatgttctctttacttttacgcatgtgcagcaatgcaggctgcaagaactccgttgcaagttgggtggattcgttgcaagttgcaagcggctgctagctgcctccggtgcctgctgttagggtggcagatgtatgtgtgcccagacgatgatcggaacagctgtgctgtgcactgcatgcgtatgcatcgctttttcagatggcagatcagccttcgtgacgtgtagtaacacgttgtgcagttactagtgggagtaggacaagaggcgtggtgtagaagtgtccaacaggatgagatcgtagcgtataataaagtggatacctcctcccatgcaagcatatcgtacgatcgtagcgccctcctaaagacgctttacaccatctaatgcaaatcctctcacttttgcttggtttcctagcgtctaaatataggcttgtccgtattattgtcattttgaccgtatcaaattttgataagacaataaactaaacgcaacgcaagaatcttcaggaagattgcatggacccctcaaactctaatcacaaatataaaagaggaagcatgagcctagtaaagcaagggcagtaaaattgaaagacactacatagaaaagagttcgatggcttggaagacactatatagaaaagtcttttatgggcatggttccctttcccatgcgggcatgcccactacattgtttcattttaagcttttattcaccatctctattataatatataagacaaatattcttcctttccttaaaaaaaaactaaacatgatatcaccaacttcatcctaccaaaatttggtagttttggaattccctctcacaaaaaaactatcaaaaaattagaaaggtatcaaactaacgcacatcctacgctaccacaatttaataataccaaaacttgagaaatgttggtattgctaaaattcgataatgttgattttaacagcaaagtgaaccagagccctctgcatattctacctgtctgccgtgatgggccaatgctgcaacagcgactaagcgcggtttgccgtctgcggagtgctcaaagcgaacggcccagctcgcgttctagcctaacgttttcggtgtggattgaattaggcccatgtagaatacacttgggccgtcacacgaaacggaatggaaagggcccaaaaagcacatggaccttatcgctggtcctcccgtccccgttaacaccaccggccgcctcgtcctctcgccatggccgcaccatccgcgagctcccgtgcctccgcgatctagcgcggcgcggtggctctcgcacccccggcgtcgacggagcgcggaggaaggcgggcctccgtacagaggcagtcgaggggcacgggatttaggggagaggggttggggggatggggaggaagcctgatccgtcgaagccacactacggtggcggcgcctcgccgagggcagcgaggaggacgcagccgtcgccggttttcctgggaacggcgctgttcgtcctagggtttgtgtccctcttcacgggacacatcgttacggacgccgactggtcccggatccggagccggtggcgatccaagcaggtaattttctgacaacctagaaggtctgtactgtataatttgacgggatttatcggcaccacttagaattcacgtgatattcgagtgcaataggagtaaatggacgtagtttgtctgttttctggggtgggcacgcctataccacagcatcgttggaaactaactgaaagctactgaacggaaaaaagtttaatttttgggatatatatatagttgttgcatacggtttacctggaaatagtatgcaagttgtgggtagtcagaggttttacgagtcactacgtgagcacctgcctgataagtccttaaattattgtttactgttgtcctgtcattatcagcatgttatttgtctcagttcttggtcaatgcttccttacaacgttggcaatgtgcaggttagaaataacgagcccataaatatttggaaatcgaggtattccaacttgtactatggatgcagcaggaggagcgtaaatttcagatgttagtttgcttattaaatcatcctcccttttggacaattataactagatgagtggaagaatatttaacacagtgattccatatgttcatctttcagctgctgtgccggagaacagttctactggttacttgctgattggtactagcgggggactaaatcagcagcgcataggggtacaactgtatttcaactttttattgcgttgctttgtattatccattgtattaccattacgatcttcagtttccagataacagatgctgttgttgtcgcccgaatattgaatgccacacttgttgtacctgagttagatcaccactcattctggaaggatgataggtaagttgagaccttaaaattatacttcctccatttcatattataagactttctagcattgcccacattcacatatatgtcaatgaatctagacatatatgtgtttagattcattgacatctatatgaatgtgggcaatgctagaaagtcttgtaatatgaaacagagggagtaggacaacttctgaagttcatcaacccccttgcacgatggacttaccctgatatggtacgtgctatatgcagcgacttctctgacatttttgacgtggactggttcatctcttacctatcaaaggatgtaactattgtcaaaagaatcccttatgaggtgatgatgtcaatggataaactcccatggaccatgcgtgcgcctaggaaatccatgcctgatttttacattgatgaagttttgcctatccttatgcgaaggcgagtaagtaatacattgcttcatattgatcaatttatcatctgcttgtgattgtttcctcgacacattttaatcatattgtgcatcttggaagaacatttgaattttttttttacttgaacattggaagaatcaattgtttgtgaggtatggatagtttggtagcttcatatgtcaattatgaagttacctcctgattttctgttttcaacactccctccatcccaatataagtacaacctagtgcagatgtgaaatatcctaggactatgatgtctagattcgtagtcctaggatatgtcacatctatactaggttgcacttttattgggacagagggagtatgagtttaggagatgcaataattggaaacatctatatgaaatcattagacacgtatgtggaatgctcgtgatatgtaaaagcaaagaggtttgcctatgcacttaacagtttaattttgcaggctttgcagctaacaaagtttgattatcggctcactaacgagcttgatgaagaattgcagaagttacgctgccgagtaaatttccatgcattaagatttacaaattccatacaaactctaggtgagaaattggtgcgcaagctgaggagcatgagctcacgatacgttgccgttcacttgaggtatgcttttacttgtttcttttgatttagtttctttgaaaatggtactactgagtttttttcccctgaaagtactcatatggagtgttttgaataacctctttacttttgcttgactcctcaggtttgagcctgacatgcttgcattttctggttgttactatggtggtggtgataaagaacggagggagttaggtgaaattaggaaaagatgggatacactacctgtaagactctgaaacttggtgagcttaggatctggatatatttttgtcggtattgcacttcctttttgtggattatttcttttgcactgataaggatgtgttgggtcagatttcccttaaaaactattgagtgataatggctgctgttagttctgagtgtccatgtattcttttgatcaattagtaccgatggatcaatatttgaatgatgaaatgatttagactgattcctagcaggagttgagcgctgaggatgagcgcagtaggggcaaatgtccactgactcctcaagaaattggtttgatgctccgagctcttggttttagcaatgacacgtacctgtatgttgcttctggagaaatatatgggggagaagaaactctccagcctctgagggatctctttccaaactactacaccaaagaaatgcttgctgggaatgatttgaaaccgttccttccgttctcttcaagattggctgcaattgatttcatcgtatgtgacgggagtgatgtttttgttacaaacaataatggaaacatggccaaggttttagctggacgaaggtatgcatctatcttctaatggatttgctaaatgttctaaatgtaaagtatagttgaatgtaaacagataagccttcaggtatgatgcaatccacctgattatactatttttctccctagtgctacgtgtgaccctttttcatgtatttttcgtatgtgtctatcgttggtggttttgtttcatctaatggtcattcatctctgtctacttgtaggcgatacatgggccacaagagaaccattcgcccaaatgctaaaaaactcaacttactatttaagagacggaaacagatgggatgggatatattttcacagaaggtaaagaaagtgcagaggggactaatgggagaaccggatgatatcagaccaggaagagatgatttcaatgaatttccatcatcttgcatctgccaaagaataccagtcaatagatcagtcacagcgcgagctgaaaacttgtgagctctagtgtagtgaggcagacaacttgagaacggagaatgctgggtgattgagcacgtcccttgctgcactggggaaaatacatgtttgttaagcaaagaaaacagggatgtaaacccaatcagacagaagcagacgtggtggataaatactcttaccggctttaactcatggcactctggtagtctggtggttcagacccagcagaactggttagtgtgcagcgatgacagacaaactgctgatttgcagcttcagtttggttccactaattgttaaaactgtggtaaagaatctgccacgataattgtagtcattagctcgatatgctatccctgtaaattgtacggtatacacgatcaattatttggatgtgtgcttcaatcgtcccatcttctgtctggtagaacctcacagcaacgaacttatttgctgaagggaaatgccattgtaccagaaacttggaaattgaaaattgcggtgattacgtgtaatttatttccttttaacgagccagtctggttcttttgaagcaatatgaatgtaacgtctttgttgcatggctgtgcagtactaatcaatgactcagcaaatctaatcaaatcgtcatcaaacataaatttcatgggattgctattcaccagtcaattgatttttattttcttaaatatcagccactggggtagatgacaacaagtgcattccttgttggctgggtatacaacacagatgggggaaatttcgactcacagatgtaagtatgcaacatcgatacacaacataacaaatgctgatgaaatcatgagatgcaccgtgatagcatcaccagctaacaacaccacccatggatcatcgggatcatctactgcgtgacaatgagaaacatcactgacgaaacccttgcaacgatttctttttagtaaacattaaccgaagctctgcttcggacctcggttgcagttcagatcagagaaactcataagcaatggacttctcttccttgagctcggtcgccgaggtttccatcttggagcgtgcaaagtcgtcaatctcaagacctggagtgcgaacaaagcgaacattcttaggctgatctcatcctgcaatgtatctgaatcacaaggattccatgagctcaccctgcacgacagaccactcccccttctcgcaggtcaccggaaacgagaagaagacgccctcggggacgccatagctgccgtcagagtaaacgcccatggacacccacgtaccctgatgaggagaggacgagcaaatgctggaattattagatgtgatcgatcggaattcggaggaaggtatgcaggggaggggatatggacctttggggttccaaggatccagtctctcatgtggtcgcatgccgcgctggcggcggacagcgagctcgactgcttccgcgccttgatcaccgccgcgcctcgctgctgcacgtcggtgacgaactcctccctcagcctgtcgacacatggtggtggagccactatcagaactcgttaccacacatgcatttttacttgacgagttccgtaccatatctcgtcggcgatgagctccctgacgggcctctcgccgcggtcggtcgagacggtggcgtggctggcgtcggggaactgcgtggaggagtggttgccccatatgatggcgttcttgacgtcgccgacgtgcacgttcagcttctcggcgacctggccgagggcgcggttgtggtcgagcctggtgaggcaggtgatgttcttggccgggattgccggggcgaactccttcaggacgagcgcgttggtgttcgcgggattggccacgaccaagacctgcaaactccggcaagatcatgctggtttgactttataatagaaatcctaataggtacttcatacgtttcatacgtttcataatgtaagtcattctaacattttccacatttatattgatattaataaatttaaacatcattttctacattcatattgatgtatatatctagattcattaacatcaatatgaatgtgaaaaatgctagaatgacttatattgtgaaatggatggagtactagttaggaacccaacataaatatcaaaagttttaactggcatccgttaggcagcaccgataataatagtcatcagtaccgattacacaattgaaacctatatcaacatataggtgcctgtttttaagtgagggccatcaacaattacttcgtcgtgataaccagtggacccacaccaagatgctagttgggtgaaataaccggcacctataatttgcgtgaagtatagtttatttgttttttaccgttcattggccggtacttgtaccgggcggtaccaaattcctagtcgttggatctggcccgatccaacggctggtagagtttgataccaattctgtccctggtacagtaccgacctaagaactaaggtggaagggcaaaaatataattatgtgcaatagatggatgtgagtcgggcagatagggtgatatggttcccaccaacaccactgccgccaagagtgtgtcaacctcgtccacgctgcgccgtgaagaactccgcttcgtccgcccctcaccgccgggaaggactcctcctcctcgccccctcggcgccgggaaagaatcctccttctccgcccgtcggcgccgggaaggactccttctcggcccctcggcgcagggaagaaatcctccttctccgcccaccagcgctgggaacgacgactttaactctgccgccctgattgagcgcatccctgctcattttctctcccgatcctacccatccgggattgaacggtcggatgagttttggtaccgaccaattccagtaccgggcagtacaacttggtggacggtaaacatgtaaacatgctgatagtttataggtgtcgttttctattaccaaccggcattatgtatgaatatgggtgctaatcgtctcaaacagtacctcgtgggtgcacacttgaacggcaaaatcactataaatattggttctagcccgtttcttttttactgttccgtagtagcagtagtgttttagcatagaaattgtgtacttgcgtatacgtgatgcgtcgtcattcaccttgcagtttggggcggcgtgctgatggagcgcagaggcctgggatttgtagattgtcacgttcttgctaatcaaatctttcctctccatcccgtctctcctcggccatccaccgatgacgatggcgacgttgacgcccttgaacgcctcagcctcgtcactcgtcgccaccactcctacacaattgaagcatcatgttttatactcgggcgaccagcgcaacgagggaaacttgaaggtacaaggtcacgcacctctgagcagcggcagcgcagcgtcgatcagttccatcctgacgccgttcagagcattggccgcgaccggcagatccagcaggtggagcaccaccggctggtcggctcctagcatgaggcccctcgcgatcatcgcgacaatggcataccctatttgccctgcaaaaaacagcacaaaatgtcgtcagtgaatttgttttctcgacttctggtcgtatttttggtttagctgcttaagtgtttgattagcttccgagttctgtattacctgcggcgccggtgacaagaaccttgacaggcttcttcggctcatctctcagtaaccacgggcaccattttgccagacgctggaagagggaattggatgacatcatggttttttctctgtgaaatttgtatgtggatgacaaattttaggagcctagctttgatatgggttcagctgaagcaactcatacaaatagcaccaagtaggccatacaccatgataccttactggcttaccttgatgaacttgatgctaaaggctcagattccatgctgatttctgcaagaaatggagcttcctggtgcaaac

SEQ ID NO: 18233 - DNA, 1061 bp, Oryza sativa
aatcacaatgacaataaagagtaggtgacagacgggctgtagatcagggacacagtgacatcgtttggtggcacttctaaaaattattaaaaataaaactacaagttcaatttttaaaggttcggaacttctgaaaagtaaaaaaaccaatgataatcatgttcgattttaaaatcaaaatgaaataaagaagggaggcagcgggcgagccgtagaggattacaatggcaaagccgctaacggtttggcgggacttttaaaaagtaaaaatgaacttaaaacgataattacgttcgatttttaaattctcaatgacaataaagagataagacagtagacgtgtcgtagaggagtataatagcaacgtttgacgggacatctagaaattataaaaatgaaacccaacgtgacaataaactctaaaaactataaaatccaatttttaaaggttccaataagaatgaatagaaatagtggtagatcgagcaatcaaataaagaagaagctgagacataaggggtagcaactagtgtgacttttaaaaactatattattagaaacacgatgatgataaggtttggtctttcaaattcttaagacaatgagatagatatttaataaattttaagtaaaatcatacttaaaaaaatatatgattttgtttgggtgctagccgcgcaattgtgcgggccacccagctagttatattattaagacagctcgaaaagaaggcaccacgttcgctgtaggggctaaaaattcccacattaatcggagaaaaagaaaacaaagaaaaggagagtctaagtagaagtataatctaaaaatagctgaaattcggaaataaaaataagcaatattgaaagaagtttccatataagaacccaatacgagattaaccaaaatttgaaataaaaataaaatacaatctaaaattagaaaaggaaatgagagtccaagtaggaatacaatttaaaaatagctgaaattccagaattaaaaaaagcaatattggaaagaagatcccttttaagaacccattccgaagattaatcaaaatt

SEQ ID NO: 18234 - DNA, 1222 bp, Oryza sativa
aatgccgcacagctaaactggtgttaatttgggggaagtgccaattttatgccttctagtgctaaagcttgtgaattcagtttttggattatgtgatgtgcattgtaatgccgaattatgtgttagtctttggctaaaacttttgtctatgatcccctgagtagtccggatatctttagatattggatggtatcatgatcaatatacctcgcttgttcaacttttctatgatcctggatgatgccctggatatgaaattgttgttagtccttgtaattttcaggttggatcagtttttcgaggtggagatgaaggtacgagattatgaactcgaccaatatggggttgtcaacaatgccatctatgctagttactgccaacatggtgagttctgttctaccaatgaaacaaactaaaagaacatctcatgtatattaattaggtcagttaatatgattcctatagcatgtttagaatttaattaaaataatatgattaccatggttggttctgacaaaattaaggattcatttattttttaaaaaaattgagcaggtcgtcatgagctacttgaaagtgtaggcataagtgcagatgcagtagcacgcagcggtgagtcgctggccctctctgaactgcacctcaagtactacgcgcctttgagagtaacatccttgtttcccaagttgtgaaaaaaccagaactgaaaaatgttgatgtgatactatgaaactaataacagatcaaactctaaatattgataataggttcatttgggtctaacttctccctttgtttctttgacttgtcagagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgcccca

SEQ ID NO: 18235 - DNA, 292 bp, Oryza sativa
cctatatgtttttctctaaaacgagcagaatcatttccttcgtttgctatttttctcttcaaagaaaagctccagctgtgtgttgcctacgtgtacatggacgcgttctcgtcgtcctgcctgccttgcgtgcgtgcgtcagaggccgtcacgttggaccaaccagctctcctggcgagatcggctgatctggaccgtctgggccatcaggcggagctgaaccgacggctaggattcgatgggggtacggcgcacgagggcagcagctaggcaggttccccattccgatgaa

SEQ ID NO: 18236 - DNA, 733 bp, Oryza sativa
ccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccgggctgcaggaat

SEQ ID NO: 18237 - DNA, 18741 bp, Oryza sativa
  unsure (1)..(18741): unsure at all n locations
attttgcaaccctttgtctcttactcttgcgagtatctacaatgttgtcctcctcaggattttcctcaggcgtttgatcattgtgttctatcggtgcaaagtgctcatggggcatgacagtttctttctagaagtgctaggtgtatatttcataggaaattcattctcaaagaatgtagcatctctggactcaaaaattgtaccagcatgcatgtcgggtactccagagtttactatttaaaatctataacccacactgtggatagcataaccaagaaacacacaatcaacagtttttggtccaagtttccgctttttgactataggtacatttaccttggccatacagcaccatgttcgtaggtatgagagatttaatttcttcctttcccattcctcgaatggtgttacttccttatgcttcattggaattttattcaagacatgacatgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattagaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattcttgctaatatggttcacagcattatgattattacacatgtcattcaaagaaaaacggaacaagcctccgctgtcataacctttaccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagtgacccgtttcccatcaacaaggaggaacctctcccgacctgataagaagaaaacagagaaatgtcagcacatacatgaatattagcaccagtatccacccaccaatcaggtgaatgaaaaatagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcctttcttcttaaaattggttgcaaccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatgagcagtcgtgcaggaggcactccccaaaaacctgatcacccgcctacccggtgcagatctcaagcaaaggtgtggtttcggaggcactgcttcttccaatctctcgtgcgcgcaagagatcagaagcggggaagcgagagcaactcaggcgcggagagggagaaactaacaccgggaaagttgcggagggaatcgtgggaacgtgggttagtggctgcaaaaggatagcgacgcgacgcgacgtgatgcacgcccgccgccgccagcctcgcccacgcccacggcccggcccggcccggcgcgcgcgcgcgtgtggcattccgacccccacctcaactggtcaacagggagcctctaataactccctatttaggttgagatatttctcgcttaaatcctgaggtggtattattatcctcaacatttattatggacctttgagatttaatattataaattgggcctagcccaattattctaacactcttcagtctcagtagcagaatgcaagaagggatctggtttgtagcaggtgcattgataccgaaaacaactctcacctgccaatattcttctgctttacacgtgtgccggcatagtgctgccataccactgttctactgtgtaagatctgttctaattttcttctggtgttatactatagtgtcgtcaagtaatgtgccatttgttccagacaaaaagtataagttgggcaatttggttgttttttcatctagccaagagatgttattgacaaggccctagtgggctctttggtgttgtcttgtttgcggtgagcaaggatggcaaataaatccaagcttgtaatagtagagttgtttgactatggcaggtcggcagcatgccaaatcaatgacttactgattcaactattgaccacttagtatttgtttaaatgtagtgcttaaaacaccattgttgactttcagttgtgctgtactatttgtcttgagagatgatgttattgaaggctgttatgtgtcttgcaaccaccaccacctgcaagtgtagatatctgaattctctttttggaataatgcccttgaacattttgtaatgatatgttttaacaattttcttggtgaaatgtaggtgcgccatgacgacattgttgaacatgtttcatcaattctaaaaagcaatggcattgctcattctgggaaaagcattgacactggaaaatttgaatggtttgacatctattggctttatatatatatatatatatatatatatatatatatatatatatatatatatatatatatatatatatatatatatatattcagttcatgtttttgtgcatataatatatgtcttgatttatttgtgttttgaagctaccaacatgatggggggatgccgattggcaagtcagattcacaaagaggtgtgtttcattttggttgatcctattaaaataaactagaaaggaaaatagctgtgaaactttattatgtgtccacccattacaaagtcatttgctgtggtgaatgcacaactttggaacattgcagaaagcttatggcttgcatccagtgcaaaagggggggcaatcagactctgtacaccaacctcggaactatgctttccatttcataagctgtctcatgaccaatttcattgctgattacagtgggctatggggaaactattgaagcggacaagtcatcttctgatacaggcgaagttagtaaaatggtaatgagatacgtaattaaatttatttgttgagtctaattcatgcgatgaatttagtatgaaaacaagattgttcctccaaatttgctcctactgacccaatcaattaacaagatatggaaatatttgataacataatgcataaccatcaactgttgccttgttaacaacagaatgaatactcactacttaaatctgagtgtttttataattttgtttatacgttcagatgctaattttctcatgtaaacagatcctgggaaagcaaccacctaaaggattagccataaaggaagtgagaaatatgttcttcccatactggaaatcggtgttgtctcgtcggttgcagctgaagatagttccatcctgtcaaccaagcaggaaggacttgctaagtgctgaagcgagcaggaaggggaccaagagtattgaccacccgtgtaacacaatcaaatcaatgggagatcgtggtttgatgtcaagtgaatccagaaggatgctttatactgttgcttcaatgtcccggaaggtgtttaagcgcacttgagtacagaaaatctttggtggtatgcttgttgaaacacatactccctccgtttctttttatttgacgctacagtgcaaatcagaatcgtttttttgtttgacgctaccagttcatccgtcctagtcacgtttgttaatttccatcgttgccctccatctcaacatcgccacggcgctgcctcgtcctcatcgcgaccggactcgctcgccactgtctcctcccacgcgccgctgccgttcatgcctcccgtgcgccgccgccgcaccccaatttggcggcaaccggccaccccgagctgtggcctgtggggcaagcaagagtcgggcagcatggcgcacagggagccggacgtcgggcttgctgctgccgccactgttgttcttgccactcggctgaaaccaagcagaacgtactgcatctgcagatgacatcgtcgttattgccgttcggctggagatcaaccagaaccagggcttctcctctccttctgcttaaattgtaaattgggcaaaaccaggcaattaggcaatgaaaattggaggaaatgagaaaaaagaaattaaacaagctggaagttggagaaggcgagatcgaggagctcacttacagagagggtgacgagtgaggagccgaggtccggggaggacatgctgcttggagacgagaaaggaggaggactgaatcgagaaggaccgcttgatctcaggctccaacgccgctttcaccgggaaggtcggagaagaaagggcgacgcggcgtccgggaagagcgttgtgcagcgggttcctcctcctgtggtcgcgagcagcggcgtttgggagacgacgagcgaaccggcgtcgaggcagcgcgggggagatggcaagggagccggcgtggagggagacggccgcgccgcgcgcactgtgctcctccctgtcgtccaaaagggatgaagggcaaaatagtaaaatcgctctatccttaattttgtccatgccgtcggaaacgtcatatatatcgaaacggagggagtatattttttctataataagcttctagaatgtcttttggtcatagtgccccctacattctcattgttgctttaatctttgtgcaggtctcagaaaaagcaatgaaactttgagcttacatcagacgtttctatcctgttgggctagaaactgtgtttcatggttatggtccatactttttaatttgaaaaccttgattgcagtgtaatattaagatttaacatatattccttctgtcccaaaaaaacgaatctagtactggatgtgacatatattagtactacgaatctggatatagagatatgtcactatgtcacatccagtactagattcgtttttttatgggacagagggagtacgatggaacgtcatttatttcttgtagtgtgccaggcaaaagctgacccggtaagtgatcaacgggctaaatattgtgctgcctctaaagtagaatatcgtggtatggaaaacatgtctagtggttgatttgttctccgaacatgcgtttatatttctcagagaaaacaacttctatatttcagtacatcaattttttttgctgaatttttattctaatcattagggcctgtttagtagagctctaactcctaatttaacttcaggtgttagatctggagtagagttgtggagctgtctatctagtatctgctagaccattcccatatttgtatttggtatgactggtgagtttgctagttgctaccatgttgatgctggcacattaccgtggattctgaatccccgtgtggccgtgtgtacagaaagacacccaagtttagctaacccaagtttggtactagtgattaatatggtgtgcatagatacctgccacatcacagtgtaaagaagggttatcatgttgatatgtgcaacatggactagcatatatacaaatgtaaagtaggtcaatctagcagattaatctgaacattttatcaaaggaaaactaccggcagagggtaaattcaacagattttttgatctgcatgtattgactaggctgtttgagttgattggaagagtatgtgaagcagtggtgcgttttgacgaaatggtacaggcgcagcagcaggcacattcggaaagattgatttcttcaccttttgcttcttgctttgtttcagaggaacatcttcactttcttttttctgtttgcgtgcttctggagatatgcaggctactaattaaacaaccaaacagggtttatcatcttattgttttatacattaaagatttttctctctataaacttttgagaactttttccgagatgtcatattctatcaataaagaactaggacttgtggaagcagaattaagggtaccttcaaatgtccatgaaatgctgaatgtttaattgcttcttgtgagggaaatgtttccttccatcaatgagaaatgggcccatttgtttcagctcgcaaacaactctggaccctagtcttcgtaggccggaacgggagttagcccatagcagagcattgtggcccaatcatgattatttgcatttggaaaaagtacaccgaaggtccctcaacttgtaatcttacaaaaccgttcattttaggtccctcggtggtttttaccccggttttgtccgacgtggcggctgagtcaacgtaggacccacgtgggccccacatgtcaaacagtccatgtcagccacttcttaccctccctctcaactcacttcctctctcctctcctctccacgtcgatggccggcggagagcagccagggtgcggcaggatggtgcgacggtcacggtcgccggtgcaacagaggagcacgccgcggtcgagcgccgcaatggcctcccttgtctctgacgtgccttcatcactgctatggcctcccttgtcttcactgcatagagcgaggagcacgcgggcaaagtgatgcgcgaggcggtcactaacctcgccccgagggccagcggcagagagcacggcatccacgacgcggcgtgccccatcgaagtctccctggtcgacgaggttagcgcacgcgagctctgcggaggctggccggctggtggggaggaggcctgcgaggcgaggtggaaccgtcggcgaaatcctcgaagctatcgcagcccaccaccgccacaccctcgcccccgcacgcgacaggatgcttgtccgcatggcctgccgggtcccgaccagcgcgaggatgtcgtgcagttgctcccctgctggacgctgcccgctgcagatctggcgcctgcgcctcggcggcggcggcgtgagggaagccctcctgctccggcggcgtgggagggcaagcacaggaggacgaggcggaggtggatggcgccgacagggagaggaaggatgccgccgttgtcatccatagccgcacgtggagagacgatggaggctggcagcgtgggagggcaagcgcgggttgacgaggcggaggcagatggcgccaacagagagagagaggtcgccgccgtcgtcatccatgcccgcaagtggagagacgatggaggccagcggcgtgggagggcaagcgcgggtggacgaggcggaggcggatggcgccgacggggagagggaagtcgccgtcgtcgtcatccatggtcgtcatccatggtggcacgtggaaaggcgacggaggccggcggcatgggagggcgggcgcgggaggacgaggtggacgtggatggcgctgacggggagcgcgaggacgtcaccgcagatctggcgcctgcgccgtcggcggtggcggtggtggcggcgtggggggagaccctcctgcttccacatcgtcgcggccgccgccgttcgccggcctcccgacatcttcctctcctgcctggcaccctcgccccgccggctggcttgctcggactgagaagaaaaagtgagagaaaggaggaagggagagaagaggggaaagacaaagtgatgacgtggacaatctgacatgtggggcctacgtgggtctcatgctgactcaactgccacatcggacaaaaccggggtcaaaaccaccgagggacttaaaatgaacggttttgtaagatgagggatgtcatatatctagttttgtggttgggggacgattttgtaactcgattacaagttgagggaccttcggtgtactttttcctttgcattttactctcttctgtttcggatcacacaaaaagttgtcccgcactcggcaccaattcattttatgttgtttcaaaaaaaaaatcattttatgtatgtccagtaaaaaatggtttccacgatctgtataattgccacttttgaagctccagaaacagttgctgagttacctagtcatgattttgttctaaagtgtgttaactttacactttgcaatccatgcactttggtgatatgaccttcagttaagcattggtcggcactttctgctaatctgaaaagctaatgccagcacgcggctatgcattgtccaggatatacataacatattcagaaacacacacacacagagtagatcagcaaggaaggcattgtggtatttgtaattgatattctgatagagtgattcagttctgttgcaaataataatatttgcctatataataagcttcaaaaacaacatagacgaataatgtctaccacttactaatactactaccactaagctttcaaataaatcaaacaattcataaatgaaatataagagtatctctgtttctactctctggctgctctgtttctgaaatgtctagataggccgcttctcagtctccgcacaagttaaaattttacattactgcagacttccaactagcaacaacatatgtgcctgcctgacatagacaaaaaaaaaagattaattggatccatgccactgcaactttgcaaaatttttaaaaaatgctactactatttgtcatattggctatgtgccactggaaatttctaaaattgaaaccataccactgaaaatttctaaaattgaaaccatgccactcccatccctttttccgtctcctctctcacgccgtctccgttcccgtcctcatcccccttccgcgaggaggcggaggccgccctgcactcttgtccatcagtgccggtgataacgatggcgacgacggcgatgcaacggagcgccacccagtagcccgagtagtagcggcgagctcggagaagaagatggtgggcagaggagggagaggagggagcgggtcgacggcgccgagtgaggctaacgtaccttacccgcgactaccaccggagggctcgggagccaccgccaccgtcctcaacgccagctgcagtgagaggtctatggagctgtcgctaccgccgtcctcgacaccatccacacgggagggctcgggagtcatccacattggagggctcgggagccgccgccgccgtactcgacgccatctacgacgggagggctcgagagccgccgtcgccgcctctgtcctcgatccatgatgggaggtctcaggagctaccgccaccgccatcctggacgccatctgcggcggcaggtctctggagctgtcaccgtcgccatcctcgatgccatccgtgcggtagggctcgggagccgccgccgctgtcctcgatccgcgacgggaggtctccggagctgccgcctctgccgtcctcgatgccatccacggcaggagtgctcgggagccgccgccactgtcctctttgcagtcgcgccggatggaggaaaagatggggagatgaaactgacatatgggatgggaacggagacggcgtgagagaggagacggaaaaagggaggggagtggcatagttccaattttagaaatttccagtggcatatagccaatatgacgaataatattggcatttttttaatttcacaaagttgcagtggcatggatccaattaaaaaaaaagtctttctactacacttacaagtggtagtagtgggcaattttaacatgatagataacacattgatttcacaatctctcttgatgaacacgttggcagcattttcataatacaaatttatgtttttgaaaaacaaaaacaaaaaaaaaagataaaaagcacaaacgggcgtgttttcaatgagaatcaatgtttgaataaaaccgaaaccgtatttgattaggctagataagcgaaaaaaagaaataaaaggcaaccgaaccgatcccctttggagcggcaaacaaaccctagctgagtcgagtcgttcgaatcgaggagggatcgatggagggcggaagcggcggcgattcccagcagttcgggaagatggttgtcgaatccaaatccaggaggaagagacggcggggagggacgactatccttgcaggcacaatggacacggaaggaatgatggatcaagaagaagagaaggaggacgacgaacaacctgctgatgttcttgaggataggaagcatcgagatggatccatctacaggggtaccgattactggagtatctattatcgtatcgccgataccaacgaaagtaagagacctcctccattcccaccgaatccaatctcctttcttagttctattatcattcgaatccccttgattcctccctatgtttttttgtatgtatataagtatattgattgattgtgtgtatttggctggctcagctcactgagccgatatactaatttggatgctgtaacaccctaaaaattcgaccgacaaaatcaaaactctaaaaatacggatcttcaaaaaaaaaaactttttaaataaattgcatcatgccaattttattggattttgatttcggaattcatcgatcacaaataggggaaaattaattagaaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacataaaaataaaatatgagtaatattaatctagggtgaattcattagttgagataatacacatattgagtaaacttcatttatgcaagatttagaaattatagaatcaaattcatataggaaataaactaaaattggaaaaataggaaaaagacactattcattagcctctaggtgttcgacgaggctccctagccccttcccctcccctgccatgcgcgcctcgcgccccgagccgtcgccgtcgccgcctgccgccgtgccgccgtcgcctgccgcgccgcgcgccgctcggccgtcgccgtcgccatcgccgcgccgcgtagccgtcgcgtcgccgctgttgccgtcgcgtcatctcgagccccgcgccgccgatgccgcgctgacgccgcctcgcgccgggcaccactgccgcgcccgcgcccgcacctcgcgccgcgtgccgccggtgcccgcccgtcgcgtcgcccgtcgcgtcgcccgtcccgtcgccgctcgtccgtcgccgtcgcgccttgcgccccgcgccgctgccgtctgccgcaccacgcgccgcgcgccgtcgcccgtcgcgtcgcccgtcccgtcgccgctcgtccgtcgccgttgcgtcgctcgtccgtcgccgtcgtcgctcgtccgcgcgccgcacgccgccgcccgtcgcgtcccgccccgagccccgtgccgcgcgcccccaccccgagccccgcgccgccgtcgcgtcttcccctccccttatctctttctcttcccctatataagccccgctattcccctcttctcctccgtctccaccccctatctctacccactcctccacgccaccgcgccgccgtctccacgccaccgcgccgccgtctccacgccaccacgccatcgcttaaagccgccgcgccgccgccacgaagccgccgcgccgcgccttgcgccaacaccgccaccgtcgctgtcgccgccgttgccgtcgccgtcgtcggtaagccgccgcccaacctttcccccccccctcgcgtccatcgtcgccgccgcccgggagagcaagagccgagagagagagatagagccgggagagggagaggaaaagagtgccgagagggagaggaagaaaagaaaaagagaggaagagaaaaaaaaagaaaggaaagaaaagaaaaggaaaagagagaaaaagagaaaaagaaaagaaagagaaaagagaaaaaggaaaaatttaagagatttagaatatttaacatattagaaattaattataggattaatgagaatatcgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaagcaattaacgatagaaaattcggattttattactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcgcagatagtaaaattaataaaaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacgtcctacttgtgattataccatgccttgattattgttcacctttaaatctttgtagccatagatacgtacgagtccctagtcaactatgacacttgcttagaaatgctattttagattcatgcatactcatatttatcaaacgctatatgcttgggtaattacctttgggaaggtaattgagatgcggcatgtggagacatgagcgccacattgccatgatattgatgacatgatttgtgaaaggaaaataaagttaaacaactgttttcgactggggcggctggaggacttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgagaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagtcgtgctcgcggttattgagcaccgggacatgtattacacttggctagactctaaattcttaacttgtgtgggaggggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgattacggttggtactcatccttgcaaatataaaatttatcagaagcgggagatgaagcctcggaggatccctatgcctactatcaggagggagatgaagacgatggcgtccagtaggtcttagtacggtcgttgcctgtggcaatggcatgccgctgcctgaattctgctgccttatctatttctgcttttggatgtattccggacctctcggtccgatgatttaagactatgcctgcgggcctatgatgtaataattcgtattagatactcgtgtatgtgcacttgatattccagctatgaatttgtgtgtaccaaactacttgatccagggaaatggtactgtttacacgattgattcctgttataaaaacgggggtccacagatgccctattatattgcacaaaatttccccttcttcctcttgccccctctggctatggcgcactcccgctacgctgctccagattaggagccagcctagggcgtcatagacagccggagcggaagagaattggcaaaattatctaaaccgttatattagcctgatgtacatcatcccggtgcttcttcttcttcttcttcttcttcttcttcttcttcttcttcttcttcttctttaaatccatgcgtagacaaccaaatttacagaaactcaataatggctagtgctatccatcacccaatctacttactgcttctacaaatttaactcgctgattataataataatttttatatagttattcagtgttcttacatgtcgctgtctgattgttgtatcagctccattgaagccgatgatgctgtctgatccgaccacggattgccggcccaactggtctggttgcatcgtccactcaggttcttccatgttgcagatcttctcactcaagctggtctccatcactgcccctgctattggtgatgaccccattcaggtgtatggcttcatggctgttcgagatcatatggattgcttgcgcaactatgtcttcaaccgcgggcgcgacaaaccttttgtcgtcagcctctccgatccctttatactcctgtctggccctaagagaggcattgggatggaaactcctgcactgcttgagtacgatataaggatcaagagaggagatggagaagatgatgatctccagctcatagatagagctgccactatcagtgagaccgagctacccctgccatatgcccaagcttacacccgatggattgccggcgactacggtgccatgaacattagcttagcacttctccacaacgccatagaggccacgatgcacatccaaataaccgaagtgcgtggcagcggtggcttcgacatgtctatggcttgtcgtgtcggtcaaatacccaatgaaatcaagctctttgaaagtgttgccattgccaagctgtgtcagctaaacaagaggtttgtgcttgccattgtcaagcgcggcatcttggtgttagacttgaaggttaagcggagtggcgccttagaggaggaggagccagtccgtatgctccgtggcttgaagggaaaagcacatggccaagtcatcctacctatgatatttgattgcgccaccattttggttagtgtgcattggtcaaatctgccggcccccatgttagactagccacaaggttcttttttttactttgttagcttctttatatatatagcttatgcaaattcttttttatttacttgtgtatgtttgctagtcatctatctgtaacttgcaagttagtatgcaaatgatttggtttaaaaatgccttatccaggagtgtattactgaatctggtaattttgatcagtaaccttaaaaaaaagaagtgattaagtgttggaatgttagtaatatgaatggttgtttcaggtacctattcatgccggtgtcagcaaataacaatatactaaaacactgtgcaaaattgaatggtggtgcgggaaaaaaaaatactacctccatttttttaatagatgatgctgttgacgttttgtcacacgtttaaacattcatcttattcaaaaaatttacgtaattataatttattttgttgtgaattgttttatcactcaaagtactttaaacatgatttatatcttatacatttacataaaattttcacattagtgaaatctttcttctgcaggtgttacagactgctgttcgccacagattagcaaaagtccaggggtatctaaaagcaaaggaacgcagcagtagaggaaatttgatggggaagcgtgttgatttctcagctcgtactgtcatcacaccggattcaaatattataatgaattggtagtgccatggagtattgctttgaaccttacatacccagaaactgttactccatataacttccaaggtaaaatgctttactgttattgaagcatgatcactgttttttaatgatcacttatcccccccccccccccccccctgggaagacaggtgcaaagtacattatctggggagacgctcaaaggcttgatctttgttatgtgaagaaaagaactgatcagtatctggaactgggttacaatgtgagtaccaactttgtttcagaatctgatttttactgatggtcacatgacaataatgtcttctatattagtctcctcatatggtgttttattttgtcaggtggaaaggcaccttgatgatggtgattttgttcttttcaatcggcaacccagtcttcacaaaatgtatatcatggggcatcgcattaaaatcatgccctattcaaccttccacttaaacttgtccgccacttcgccgtacaatgcagattttgatggggatgaaatgaatatgcatgttcctcagtcatttgatggggatgaaatgaatatgcatgaataagtatttatccatgtcctgtcaaaaacagttagttttccacgatatatataattgtccaatgtttggaagttccagaaacagtttacacgatctgtatgattagttgaaaaagcgtgttaactttacacttttacaatccatgcacttcggtgatatgaccttcagttaagcattggtcggcactttctgctaatctgaaaagctcatgcaagcacgcggctatgcattgtccaggatatacatgacatattcagcaacaagctatgattatcacttgtttcccatcatcgacatggatctacaaacacacacacagtactacaataggagtactacagtagatcagtaaggaaggcattgtggtatttgtaattgatattctgatagagcgattcagttgtgttgcaaataataatatttgcctatacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18238 - DNA, 530 bp, Oryza sativa
cataaataattaagatttatatcaatttattggtacagaattatggaccaactcgcttgtgctagagagataatattcatggatgtaaggctattatggccccatttggcacagctctagctctcaactccaacttacctggagccggagttgtgccaaacgtccaaatccactttttttgagtggagttggcagagctactcctagaaaatgaactacgggggtggggctggatttttgatgctccccagctccactccaccccaaaagacccactaccctctaatttttttagagtatttacacgaaaatgctactcaactacccctacaatcctcctttcctcccgttctctctcctcccctcccaatcccgagcgggcgccggcgacggcgggcggcggtggcagcagcagcgtcggcggcggtggcggcgggacgacgacaggcggcgacaggcggcgcggcgtgacgatgacgagcgggtggaggccagcggcggcgggctgcggcagcgtcggcggtgggggc

SEQ ID NO: 18239 - DNA, 869 bp, Oryza sativa
  unsure (1)..(869): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctggatccgacattagaggaagttaagaagctatgtaatacttgccgtaaatttgctagaacagagagagtcctttttcattacaatggtcatggtgtaccaaagcctacagctaatggggagatttgggtatttaacaaggtgaatgttgcaaagacactgcataagctgctgcattgtttatccatgtgtgtttttgacgaagtgccctttttttactttttgtgcagagttacacacaatatattccgcttcccattactgatcttgattcatggctgaaaacaccttctatatatgtttttgactgctcagcagctggaatgattgtgaaagcttttctggaggtatggtatagttccttctaatttttatacgtacgccagatacttgaagttgaaagtgataatgatgatttcctatctgtttctattgttagactgtttaatatattcactatgactactcatgttcactttagcgcctagactggagttctagctcgtctgcatcttcatcgaaggactgcattctccttgc

SEQ ID NO: 18240 - DNA, 10286 bp, Oryza sativa
tatctgcatcaataatggtctatattcatgtatataaactattcaggttttgtaaccgatcgttactccgtgattccatggaacacaatcttattgaccaaattcctggaaggcaaaatgaccgcaaaactcttctaggggagttgaactggattttcactgctatcacagacactattgcatggaatgttcttcctcatggtactgatagtcattttaatcacaattaatgccagtgatcaattgctttctcattcattttcttttaatctgttatgattcaactttcactacgcagatctattccaaagacttttcaggcaggatcttttggttgctagtctctttcgcaacttcttacttgctgagagaatcatgcggtccgcaaattgttccccaatttcataccctttgttaccaccaactcatcagcaccatatgtggtaattgatggcactagccattctttttatagtttagctacctcttctccattttctttaatttcctaaatttcaattttagggatgcatgggacatggctgcagagatctgcctttctaagcttcctcaattaattgctgatcctaatgcagagtttcaggtgctattaaccgtctttgctttttttgaatgatctaatactttggacatcaacattttgttggcattgttatgttgtttgagaattatcacttcagtaccatcactttgttcatttccttactcaaaccagccgagtccatttttcacggagcaattgacagcatttgaagtttggcttgatcatggctctgaagacaagaaacccccagaacagctacctattgttcttcaggcaagacatttttttccatccagctattcaagatgctagtgttttttttttttgttatttgagtggtaagttggtaactgactctccaaatgatggcaaaataaacttgggtggacatctatgaggcttttttgtgacgcaattcttggttctatttatatcattgcataatcatacaggccatcttgcaaaatgcccttgttacttatttgtgaactttgttaaatacatggttgcccatctcttatctgctttcagtatttatgctggaaatttgctacatgggttccctttaattatcaattgttttactttgctctaatacacttatgttatgtgtaggttttgcttagtcagtcacacagatttagagcacttgttctgcttggaagatttcttgacatgggaccttgggcagttgatttggtatggagttgaccgttctgcgtgcccttttttgggggtagaactgtagaagtgttgttgtatattatcttacccgtatttcaaattctggaactttttttaggctttgtccgttggcatcttcccttatgtacttaaactgcttcaaacaagtgcaatggagttgcgccaaattcttgtgttcatatggacaaaaattctctctcttgataaggtggtgttctatgttgaaaacttgaaatctctgacagttcattttatttctcaagattcaggtatttacttagttgctctgtttttcaaatgacagtcatgccaggttgacttggtgaaagatggagggcatgcatactttatcaggtttcttgacagtttggatgcttacccagagcagcgtgcaatggctgctttcgttttagccgttattgtggatgggcatagggttggtcaagaggcttgtgctaatgcagggcttatatatgtctgcctgagacatctgcaacctgaaaatccgaatgatgctcagacagagcctttgctcttgcaatggctttgtttatgccttggcaaactttgggaagatttccctgaggctcagttacttggtctgcaatcaaacgcaccggaaattgttatatgcttattgtcagagcctcaacctgaagtatggctgctgtcattttgtgttaattcttccttatacctgcttcacaacatacgtgttaaatatttgatcttaccaggtcagagcttctgctgtttttgcacttggaaatcttgtggatattggatctccatcactgaatggagctgacgacgattctgatgatgatgaaaaggtgagagctgaaataaatgttgtccgaagccttctgcagatctcttcagatggtagccctcttgttagatctgaggttgccgtaggtacgtgaatttgcctaatacattggacttacactcatttagtaatgtgtcaagcctatagattcctcttgattttgtggcgataattttgagttgatctgatgtgttgcagcgcttacccgctttgcaatggggcacaataaacatatcaaatctgttgccgccgagtactggaaacctcaaaccaattcactgctcaagtcattaccatcgttggctaatattaattcgagcaatgtttacagtcccagcagcttaatacaaggtagcagtggccttgcctcacatattggtcccgttttaagggttggcagtgataacagtgccactgctcgtgatggaagaatctctacgagcagcccgattgcaacaaatagcatcatgcatggttctccacagtcagatgattcttcccaacactctgattcaggcatattactgagagagaatgcaagtaatggtggtctcaactactcaagatcgaggcctattgataatgggatctattcccaatttatagcaactatgtgcaatgttgctaaagatccttacccaagaattgcaagtattgggaaaagggcattgtccctcataggtgttgagcaagtaagcatgagaaacagtagacttagcaatggaggtgcacacccaggagagacatctgtgcccccttcatcaaactttggaatggcacgctcctcttcctggtttgatatgaactctggtaggttaataatttctatccttgccaagtgcttggaggatgcctgcctttttgcatgcactacattattgtgtggggtgtaaatgattattgaattcagctctttcaatattttgtaggaaatttctcgatggcctttaggactcctcctgttagtccccctcagcatgactacctcacaggattgcgccgagtgtgctcgatggagttcagaccacatgttttgaactcacctgatggcttagctgatcctcttttaagctccagtgcagcccccagcaacatggggctcgatatacttccccaatcattaatttacagatggagttgtggtcacttttctaggccacttctaactggttctgatgataacgaggaagcaaatgctagaagagaagagcgagaacgaattgcaatggattgcattgctaaatgccaacgatcttgtatgtggcctagcaacactattttacattatatttttgctattggagttctatttatttatctgattaatgatatgcttccccttcttctgtgtgttggtggcattagcagcttgcaagatgaccagccaaattgctagctgggatacgaggtttgagttgggtacaaaagcatcattgttgttgccattttctcctattgttgttgctgcggatgaaaatgagcaaatacggtaaacagattatactggaatctcttgttaaaatcgattttttttttgtgcttcagatacactagtgcagttgcgctaaagtttggtctcatttcagagtatggaactatgatgatgcgctgccagtgaatacttttgaaaaccacaagttatctgacagaggcctatctaaacttttgctgatcaatgagcttgatgatagcttgttgttagttggctcaagtatatctcttatctttatgttttttctgttctcatttgttttgtaccattttgatatgtattttttttttcatattgtaggtgatggaaatgtccgcatatggagaaactatactcaaaagggaggacaaaaacttgtaactgctttctcatcagttcaaggctatcgaagtgctggtcgcagtattgtatttgattggcagcaacagtcgggttatctggtgaaactctaaagccttttcccgatgttttgcaaattgcaatgtctcattaatcaaggctattgtaatatggaacttactccttttgttgtaaaacagtatgcatctggtgacatgtcctctatccttgtatgggatcttgacaaggaacaacttgtcaacaccatccagtcaactgctgatagcgggatttcagctcttgtgagttctttgttactgtgtgcatatgtgctatttgagtgtgaaaaatttaaaataatgattttagcttcttttttcagtctgcatctcaggttcgatgtggccaattcgctgctggttttcttgatgcatctgtcaggatatttgacgtgcgtacacctgataggtaagtagatgtttgatgagatatcaaccacatgttccattgcagagatttcgcttcatgtgcatcctccgcccacaacacacatatgcatgcttatttgcgcgcacacatttatgctacttcctaagttcaatttttcccattgctgtaggctagtatatacagcaagaccacatgccccaagatcagaaaaggttgttggtataggatttcagcctgggtttgatccctacaaggtaaatcctccctctttgtgcacatcttctgtatttcttgtagttttaattgttagagcagccaattttttagaactttatgggattatttgagctttacagagctccctttttgttatttatgcaattacagattgtaagtgcatctcaagctggagacattcagttccttgatgttagaagggcatctgaaccctacctcactattgaagcacataggggttcattaatggcattagctgttcatcggcatgccccagttattgcaagcggctcagccaagcagatgatcaaagtgtttagtcttgaaggagaacagttgacaataattcgctaccagccatcttttatgggtcaacgaataggcagcgtaaactgcctttctttccaccgatacaaatcactccttgccgctggtgctggtgataatgctcttgtttctatctacgcggaggacaattaccaagtacaatgaggtttacagcttgttccatgatgcaatgatgatgcattcagttggcctcatgtatggccaagcgttgatccacaccaatggtacagctacaagatacaagatgttatggagagcctggtcagtgacatggtggtggtggtatagaagtgccacagcttctggtgcattgcttcttgggcatatctacatctctgatctgacctgcagtttgtaagatacaaaacagggttcattagcctcccttgcagaaggtcgcgaaagtggcatcttgccctggtcccatcattacacttggaggcttcccaaataactaggttaaccaaactgtaaatagtcatcctatttggattgttgttctccttagccagcttcctttcccaaatgtaaaaaggtttggaggtgcttccatatgataaatcaggttagtggggactgcctgggcaagtggttgtttatatgggcccagggagaatgcatgcgcatgtctctcatagatgttgttcaatagatagatgcatttgtccagctaacacaatattacatggcttgatgaatcaatgccttcttttaagtctttcattgtaagcactggacagtcatccagtgcatcaaggtagggcgtcattgtccttttgtatatatgaattgtacttgtacagttgcccactttgatgcaatgcgtccaaagatgttttgaggtcgcccttgggtttatttggcgccacacaacagttgaagaatcaggtatgtctacatgggaagatgttgaggtagaatgatgaggattggaaggccggaagcactttgggtctgtaaatagtttaatggaagtagtgatgtgaagctgtgagtgttttatctttgtggctttgtctgggtcgccagacaaaccagtgacctttggatgtgctggatctattattggaggaccgggaaaatgctggtggaagtcttacatttgctgaaattgtcttggggagaaactcaaatgaaggcattttggcagttggtatagaaatgattctattgggcgttttcataccgtggagaaacactggggaagtctgatactgaaactgtcttggatgagaaactcaaatgaaggcatatggcggtggcaaatacacaaatgtacctgggttccatagcttggaagaaccctggggaaaatattctgatgcttggagagttggaagtgagcaagaaccctggggaaaatattctactgaggtgtaacctgtactctctccgtttcacaatataagtcattttagtatttcttacatttatattgatgttaatgaatctaaacatatattcattaacatcaatatgaatatgaaaaatgctagaatgacttacattgtgaaacggatcacaatataagtcattttagtatttctcatatttatattgatgttaatgaatctaaacatatattcattaacatcaatatgaatgtgaaaaatgttagaatgacttacattgtgaaacggaggaagtaactgattagcgtcgggagcatagcacattggtcgagtgagtgagtaataagggtgtctgtgtgtttgagatgtgtaataaaggatcgatcttgttgacgctcgacttgaggagcgaatgcaaatcatcagatcatactggtgtactatttatgttgaggatgttttcctggccacaatttataccaccaccatgttttgcacccaaaaaaaaaatcaattgctaggagcgcttagaagcagaaagctactgttttttgtttcttttcctttttttaataaaaaaaataagtagtcgttctgaggcacttacaagtgggcccatcgctgggcctcgaagaatcgaccatccacacgcacgcacttatacaatttggtttccaccttttcttggcatcgcaccacgcacacaaccaaaacccttctcttctctctcgactctcgacgacgctgcggcggcggtggcggcgaggtgggaatggacatgccgcccacgccccttccgccggagaccgccaacacctcgcccgctcccaacggcgccaccgccggaatcagtatgtttctctctctcccccctccctctcaacactcttctttggtctcaacaagaaccaagggaggactgttcattccaacgagctaaccgcaggttttggttcctctccactttttaaatggaaattgctttactggagagcattcatcatcatacatgatgcattgatgcgcttgggatgtaactactactacatttgttgccgaaacaatacttgcattattatgtcatcttgatagagagctggttgctgggacgaaatctcaaaaattgctcttcccggcatcgtggtaatgctattttctgagttgtggtatgcttgatttggcccaggggttgagaactgctacgtcttcaagagccggctgcaagagtatgcgcagaaagccggcctccagactccagagtatcataccttcaaggagggaccttcccatgagcctgtcttcaagtccacagtggtgattaataacaccagctatgactccctgcccggattcttcaacagaaaggctgcagaacagtctgctgctgaagttgccctcatggaaattgtcaagtccataccagccaacgcaaacatcccagctgttgtaagtcactgtctgctctacttgtgtttttgtttaactcaacatgatggaatacctggggcctgggaggacctgctggtgtagtacaagattagtaaaagtgttgggatagtctacttatttctatacagtgcctgcttttgaattcgcgcgaatccgaagaatgagatagccactcacctgataactccagaacgaatcagggctttcatgtttggatagagttaggtcctagagagcaagaagagagggtatttgcatagaagagattgtgaaagctttgctgtcagtcaccacggtcttattattatctgccgtcatgatctgtctgtatcttttcaggctcataattctactcaggtattatatgaatataacaggaaattggttgttaaagagcttctgaactcactcttccccggtttgtgaaccatgaacaatgcaaacatcaaagtacacatattaagttttgtgatcatttccgagtccaagacctagataattttgatgctcttttggtcgagtccctaggaattaacgcctgactaaattagcatagtgctataatctcttacctggattctatgttcttgacacaccttaatatgttttccagcaagagactggcctgtgcaacacaggaagtcagcaactgaacctgagggaaatgcaccgagaagctgaccaccaccaccgccttctggcaacccttgcacgccactgccgtcttgctgccgctgccaccttcttctcctccaccctccgcactgctcgtgccctcaactccctcctcgctgctatctgctcttccccagcgttcctccgctttgcccctaaagtcctcttgctcgctgccccatcagtctcccctgatgcgaccaccttccacatcctcatctccacactctgccaggcccaccgccccgctgctgccgccgacctcctttgctgcatgccctcgcttcttcttgaccctgacctggccagttgtcgtgctgtcctctcctccctgtgccagtacgcttccgctcaggatgcagtagcattcttggacaagatgtgccattggggcatttccccaagcagatctgactaccacgccgtcttcgatgcgcttctgcaggagggaaaggtagcggaggcatatgaggtcatgaagaataagatgggctctaacagggtggcacctgcacttgcatacttcaaattgacaatgcaagctttcagcgagtgcttggagttcgattctgtggaggaggtgtttgatgaaatgctcctgagagggctggtaccagacgtggatgtgtatagtgtgtacatcagcgcgctatgtaggaaaggtgaccttgccggagcgcggcagatgatgacctgcatggagcacgccgggtgcccaccggatgtaaggacatttggtgtggtagtcgccgggtgcatgtctgccggggacatgggcacagtgagggagttggtgcaggaggcaataaggcgtggcctgcagtgggatccaccagcattgtcggagctgataggcttgctgcaggcaggtgatggtgccacacagtcacaggagttactgttggagccactatttgtgcacgatgcaccagtgttggggcagctgattggagcattgtgcaagcaagggctattgggacctgctgctgtagtagatgattattagaaagcattgtaattgtctttttgtttcaaactttcaatacagttgttggttttgaattctcagaaatctgaagaacggcataagaattataaaaacagagacagaaaaggcaaaccatggactataactccaggaatactcagagctttcggctttgtagatcactagattgtcggctaaagttaggacccagtgagcaagaagggagggtatttgtatagatcggccaggtaggagattgcagaaagtctttattgttgtcttctgtcatgatttatttgtattttctcaagcttacaactctactaggttattcccatgaatacaataggaaattagtcgtttaatagctactgaactcgtactgccaggatttagataatttggatgttctttagttcttaggaatcaggctgactaaacttagcatagtgttataatctctttcctggatcactgtgcatttttttacacatattaatatgttttcagcaagagactgggctgtgcaagaatcttcttcaggagtatgcacagaagatgaattatgccattccatcttatatttgcaccaaatcagcctcaggcttagctcctttcatatgcactgtagagattggtggaatacaatatattggtgctgcagccagaacaaagaaagatgcagagataaaagctgctcgaactgctctctggcaattcaaggtattgttctgttcttctctaagggtcttatttttattttttatattatccaggctattcactgttaaaattaacattgctatgttcttgtttgtgtgttattatggtgaacattgggtcatgcatgggca

SEQ ID NO: 18241 - DNA, 14283 bp, Oryza sativa
attcctgcagcccatcttggggcactctgttccttcaaccttgtgaggaagctaaaagagtagaagctgagccacctagagatattgaaatggtacaacctgataaggagaaccaacacagtgacgctgcattggtgcaacctgatgatgaagctagagtagaacaggagccatccagagatatttcagtggtgccacctaatgaggaagctataagtgttaagcaggaaccatccatcgatgctgcaattctgcaacctaaagaggaagcttcaagtgtaaagcaggagccattcatcgatactgcaatgctgcaagcttgtaaggaagctggaagtgtagaacttgggccagccagagatactgtaatttctcaacttaatgagcaagataggggtgtaaagcaggagccagctggtgacactgcagtgccacaacctgacgtggacgctagggtcgtaaaggaggagtcaccaagaacggaacctaatggggaagctacgaacatgaaggagacaccaaagaactctgcagtgtgtaattctccagagacaaaggaatttggagatattacagcaatgggttcagatcctcccgcaactaatatgagcgaagaataagctgtggttgttgaatcaaaatgcaatagctttagtgtgttcacctgcagagggcgaagaataagctgcggttgttgaatcaaaatgcaatagccttagtgtgttcacctgcagaggtgtgaaacatgaatggctggcttttccagtttaaaaagaggcagctggaataggaagatgtatgtgggctgagaatagttagttcatatttgtcattgttagctaggcatgtgtatgcctgatgatatgaatgaaatgtattacctgctgctttagtgagcactactttgaaaagaaggggaaaaaatgaattcgaggtttctgatccctgtttcctctcgaactggtaatctgattgttggatggttcttatttggaaatcaacattttcttgttaaggatgctaagaatacattaacttcctgtctggatatactagcattgcccaccaaatacccaaactacagtatatccaacatgtttccaggatttacttgctttcttccaaacattgttacaagaaagaagtattcacgttcagtctatgcttcctccaacatctaacatggacacatggaagtattcacattttttttagcaattccgttcagcaatcagtagttactgttagccaatctaaaatatatatagaacattcctactacatctcaatcctgctgtacccttgcaacttctgaacgtgattctgaaccatcctcctcctggtctcctctgcagactgccactctccatcgtcagcatacacgtttgacagcgaaatataagcgccatcgctgctcggcgccattctcaggatctgctctgccgcaagcacgccaagttgcttgttcccatgtatccggcaaccgatcaccagcgacctccaaactgcaggccatggttggaacggcattgcatcgatcacacccttcgcctcgtcgagtagcccctttcttgccaggagatcaaccaggcaggcgtagttggctcttgctggatgcatgccatacgcagacagcatggtgctgaacacaagcttcccctgctcgactagccccaaatggctgcaggctgacagaatggcaacgaatgtggctggtgttggactcaatttagcctttgtcatctcttcgtagaggttgagagcttcgtggatcaaaccatggttggcataagctgtcagcatggtgttgtacaggatggcatcgtcggttcctgatgaaacaacggtgaaagcgctctctgcagaggtaatctcaccacatttcgcgtaggcatcaacaacagcgctagctacgcagaagtgcttggaatgacctgtcttgagaacaagcgaatggatgcatctgcagtgcctgatcaatgcagcatttgcacaggcatttaggacggttgccaggatgaactcatcaggcttgttggtggagtcacctctaaacaagttgaaaaggaaaatgacctcatcgttcaggccatgcttcaggaatgctgagataacgactccccatgacaccagctccatcttgccagcgtcctcgatgatttttagtgaaatctgaactgacccaaacgctgctacatttgccttgatcagtgaagtggacacgaactgacaggaggcaaaaccttgtttcagaatagttgcgtggatttgctcatgatcccttgcaccttgagcttcctggaaggcagacagaacagctgagtaggtgaactcatcaggtctttctccaaagcaaaccaaactgcggaagagcttcattgtttcttcagagtgactgaagagaccataacctgcaatcatctcgttccatgtcacaatgtttgtggatgtgagactacagaagaagccatatgcacggttgagcaatccacatctggatagcatgttgattactgcatttgctacaagaacattgtcagtatagccatgacggtaggcaagggcaacgatctgaaggcccaatgattcattctctttagcaccactcagcctcaacaagacagagaaagtaacctcattaggtttacatccgattcgtgacatgtcaatcaagcagccaaaaactgccttgtcgtcttcatcatgcgcaaaacctgaaatcatggtattccaagacacggtgtctttttgtctaatcttgcgaaagacagaagcagcagtttccttctgtctggctctgaaatacatatcaacaagggaattcatgaccgaggtattggactcgagcatgctgtggatgacaagacagtgaagctgtcgcccaagatcccactgcgcactgattgaacaagccttaacagcagaaatataggtgtaccggtcaggtgcaagcccagaatgatgcatcaggagcaccgtacgaatggcatgatgcccaaaaccattcaaaacatatccttcgagcatggcattccagcacgtcaaatctttgttcctgatatgtgcgaatgcacgctgtgcagcagcaatgcggccatgctttgcgtacatgagcagcagagagctccccacaaaaggattgctatccaggccagctctgacggcaacaccgtggagcgaaagggcgatgaggagcttattggaggaatgggccaccatggagtggcaggcagtgagcatggttgcgagcgagaactcgttggggcagaagccgctcctgatcatggaaacgaagaaacgaaagcccaggtggggcgcgccattgcccgttgaggcagagaccatggctgtccaggagacgaggttcctttgcggcatttcgtcgaacaccttgagtgctgagtcgagaaggccccgcctagcgtagtagatgaggaggtgattcatgttgaaggtgtgagcgagcgtgcccagcttaagggagtgcgcgtggaggtgtgaagaggaggaggaggaggaggccatggaggcgatggcgaagggatccctggagatggaggtggaggaggtgcagtaatgcagcaggtggagaggagaatgcgattggaggaggtggcggcggtgagtccaaggaaacatgccgccgtcgctgctcgatctcatgagtccaaggaagttgtttgtgtgatctctctctctcagttgttccttgagagaaatttcgtttcttttaattttctgtgtggggtaactgtaatactaacgcaactgcacgggaacggaattgcagggagcaagatgggcctatttacctttgttgaatgagtccgtgagattatgggaccatcaactgttgtccgtccctctcccagcacctccagctccagtcacttcactgattcaagtaccaccctactccagttaatgcctgtagactatacatcttaaattaaatataatgttttttttttggcatatcccatctggctggagaagaaaaggaaggccttgtctgtattttcctcatgaatcacacatgcagcaacagggtccagaatggcaggcagctcaacgcctttcttcctaatataggacttgtccacttcacttggaacttggaagaagatgtctctgttgccttcctaattactgcaacatataagcagcgccacccaagtctgacctgaactgacttgaccgtctcaagtcaacccacgatgacaccggactgcaaaaactctacaagctccaaaattttgggagagccattgctttgcttgcttgtacaagaacccctcttttcaactgaaaaacaaattatattcagttgtggatccaataagagtggatcaaacagaaagttgcaagttgcagccttgtctcctttctggtaagacttagctctccaaactctctcctccccttcttccttgctgcttttcgacaaaatcccctcttttcttttcccatgtccagattcttgtgtccattgtagatttttcctgaaatttcatctgttttctttttctcctgaaatgcaggtggacgagaagggggctttgcgaattgcaattttgcaatgcttcttgcttgtgattgtgacgacgatgcacaaaccgcagagaatggcaacgccccgatgctcagcaactaccgcgcccagcctgcgccaccgctcgccgagcccctcctcctcgacaagccacagcgcgcgcactggctcaggcagctcaaaccgtggcgccgcaatgccgccgacgaccacctctccgccggaatcgccatcaactggagctctgtgcgttcggcgaccaaggactggatcaccaaccccatgaacatcgccatgctcctctggcttctctgcgtcgccgtctccggcgccatgctcgtcctgctcctcctcggcctgctcgacggggcgttccccacgccggcggcgaggaaccactggatcgagatcaataaccaggttctcaacgcgctcttcacgctcatgagcctctaccagcaccccgtcctctgccaccacctcttcctgctctgccgctggcgccccgccgacgccgccgacctccgcgccgcctacttcaaggacggcgccggcccgcgccacggcgagcgcgcccacatggccgtcgtggtcgcgctgctccacctcaccgtcgcctgccagtacgtgctctgcggcctgtactgggggtacaccaagaagacgcggccggagctcgtggagaatgggttcttcgtgctcggcgtcgtcgcgccggtcgtcgccgtcgtgtacaccgtgtgcagcccgctcggaaaagacaactacggcgagctcgcgtgccccaacgccttcgactcggtgagccaacacaaatgcacgggacacgccgtggtcgagccggagtgggccggcggcatgttcgactgcggcggcgacgcgacggcgtggtggctctccctgtcgtgcaccttctgcgccttcgggtggaacatggagcggctcggattcggcagcatgttcgtgcacaccgccacgttcgtgcttctgtgcttcgcgccgctgtgggtgatgggcgtgtcggcgctccacatccacgacgtggtcatcggcgacatggtcggcggcgccggggccctgctctgcgtgtgcggcctgctctacggcggctactggaggatccagatgagagaacgcttcgggcttccggcgagcacggcgtgctgcggctcgccgtcggtgacggactacgcccggtggctcttctgctggccgtgtgcgctggcgcaggaggtgcgcacggagagcctctaccacatcgattgcgagacgttctacaagaagcttcctgttgtcgatgacgttgaagacgagaagaggctaccgttgctggcgtcacaccatgtccaattccatgaaccaccggacacgatgatcatggcagcatcagagggatcaaatgatcatgtggtgattgttcatgaggagatggttccaccggctgtacaggttgtggtggagcaagtcgtcgttgaaggtgataaatctgaagaagaatgcagtgcagttcatgatgagaagatcatgggttcgcctcttccggaatcggtggtgattgtggatgatgatgagataccggccagtttgtcggatggaagctggacggtggagaaggtgaagagactgataaatgttgtcactttggtttctttgctcattcttctctacaccaggggattcattcgttagtgaggcacagaaaatgcatacaaaaggctacagattcaatagctacttagctagatgactgaattctctcatctttctccatttctttttgttggttgtgatcgagaggaagttcattctttggagtttgggtgtacataggcatactgctggcataaagatgccacaggattttgaagggattgtatatttgtaatccgttcccagctgcaattgcaccttggaaatagtgaatctctaatgcaattatatctcattatttcagtttgcccagtgtggcttgtgtttcaggaaactcacttggggtggttctacaaagatattgtagtttcagttagaacttagaatccttctaaaaccttcagtatagcttctgaagtttcagaaggaactgaattgtacaattgttagcaatcgtagtttggaaatcttagaaggtttgtttcagttttgtccattgttgcgtaagttattatgtgtgataacatgatcaactatcatatgatgaaccaattgttcctctaatgttgtagagcgccaactgtgaatagggaaacgtcgttattggccatctgtaaactgaaagtatttataattgcagcatgcttgagactgtacacctgcctgactatatggacttgaaataacttgaaagagacctgtctaaaaaaataacttgaaagagacttttggctgctttgcagccataacctgaaaaagaagctcagtatcaaaaataaatcaagccaattttaagaagtaaaagtttttttagactggtcaaaggggggagagattccccacctgaatttcattaatcttagggagtagcggtacagaactagagcagtggaagtaaaagtttatgaaatccagctttggcctataacttagcggatcaaaatagggatgaaaatgttgaacagagcacgccgacaggtgatctgttcagctgttctgttttgttgtgctgaacttatttaaggcaacaaaagatgacttattcccgatcaaggttgtgcttcagttatagggccaacaaaacaagcaatagaaagtcatggcaagccaacattgattcctgaacatgagtgagcgtgtatagaagacaatggacgcccatacatattcttggaagtcttctggagtaatactagtcattttagaagatacagtatgtactatgggtgtgttcgcccaaccatgcctcccgacacgaaaaacaaaacacacgattatagtgagattaattaagtattagccaaaaaaaacttaaaaatagattaatatgattttttaagtaattttcatataaaaaactttttgtaaaatatgcaccgtttagcagtttgaaaaacgtgtgcgtagaaaacgcgggaagtgggttgggaaagatgggataagaccacagcctatatgttctagtagtctgtactatgtagtcgttttgttacatagagctactactaccaactccaccccaaaataagtgcagccttgaatattcgtgtccaacgtttgatattcgttttattttaaaaatttataattttcttttttaaaaaatagtcacacataaaataatgttcatatcttatcatatgataataacaaaaatactaatcacaattttttaagacgagcagttaaatattgaatataaatagtgtaaaaccgtgctttattttaggacggggagtaatatacagtcacgcttaactgttttgaccgatccagctcggtcaatccaatccggctggtaattaaacaacacgagcgcagtaattgaactagcagcaaactgtggctgacgctgacctgctcgctctgccaaatttgacaatgttgcctttctttcgtcaactatttgcattgcatgcatatatatttgttgatcagttccatggttttgatttcgagcttgctcctgctacgtactcgatctgctgcagctagctactactaccagattttctgcaactccttcactccacaagaaaaaactacaaatcgatcaacatggaaccacaagaacagcatcaagaaccagtgaacgatgggctgcagaagcaggagcagcacaagaagcacaaggagaagaagaaggagaggctcctcgacttcctccgggcagcgccgtccaaggcgccatggttctccttctccggcgccgccttcctcacccgcctcgcctccctccgcaccacaaacaatcctgctgcttcccgccgcttgccggcgttcgtccgctccgtcgactggcgcgccctccgcgccaagtgcctcgcgtgggccaagcacccaatgaacgcggctctgctcatctggctcgccttcgtcgccggcggcgtcgccttcgtcttcctcctcatgaccggcgcgctcaactccgccgtgcccgccgcctcgcgccgccgccgatggaccgaggtggccaaccagatgctcaacgcgctcttcaccatcatgtgcgtctaccagcatcccaagctctgccaccacctcgcgctactcctccgatggcgcgccgccgacgtcgccgagctccgtgccctctactgcaagaacggcgccgccggcctgcgccgcgagcgcctccacgtggccgccgtcgtgctgctgttccacgccacgtgcttcgcgcagtacggctactgcgcgctcttctggttcttcggaagagacaaccgcccggacttggccgtcaacctctgcatggcgctcggcctcggcttccccatcgtcgccgccttgtacatggtgtacggcccgctcggccggaagatcgtgctgatcccggcgtccaccgacgacgaggagaacttgaactcgcaggtcgacgaggcgaacgcgatcgcggtgacggcgcagtgtgacagcaacagaaacagggcggtggtcgcgaagccggagtgggccggcgggctgttcgacgtcggcgacgacccgacggtggcggcgctgtcgctgtcgtgcacgttctgcgtgttcgggtggaacatggagcgcctggggctcggcaacatgtacgtgcacgtcttcacgttcgcgctgctgtgcgcggcgccggtgctggtgttcgcggtggcggcgctcaacgtccacgacgacacgctgcggttcgtcgtgggcgccgcgggcgccttgctgtccgtgctgggcctcacgtacggcgggttctggcgcgcgcagatgcggaggcgcttcgggctgccagcgcaccgctggtccatgtgcggcgggcgggccacggcggcggactacggcaagtggctgtgctgcgcgccgtgcgcgctggcgcaggaggtgaggacggccaacctgtacgacgtggaggaggacgtgctgtacgccaaaggtggcgaggaggaggaggaggaggaggcggcaatggcgcctttggagagagaaggctgcatcgtcgccgttgatgcgccgccgctaccgatgagagtcgaagagaaggactatgtcgtgttagacatgggtcaatgaaatttcgttccaagatcaaaataggcaacatgtaaaaattccgatctgctctttttttttcttcattatttgaagagatattccaatatttgactaaatttgttcattcgttgactgcttggctttggcgctttatttagacccggtttatataccattttagaaattttcaccctgtcatatcaaacgtttgaacaactgcataaatgattaaatataggttaaaaacaactaattgcacaaattgcaactaatttacaggatgaatcttttaaacctaattattacatgatttgacaatggagtgctatagtaagcattcgctaataacagattaattatgcttaataaatcatcgtgcggtttactgacagattttataattagtttttttatcaatgctacgacactctatataataggcgatgaaacaagaaaatttttttttacaccctatatccaaacacccccttatttatgtctggcgatgccatcaggcggctactcctcgccggcgtcgcccctagcaaccgcctcccgccgctcaccgtcaagctcctccacgcccgcctcctccgcctcgacctcctcgctggcctctcctcgctcctcctccgcgccctcacctcctccgcccttcacctccacgcgctccgcgtccactgcctcctccccaacccctcccacctcaccatccccatcgccctcaagtcggcctcccgccttccgcaccctctccgcgcgggcgagcagctccacgcgcgctccctcaagcttccctcccacaccaacccccacgtcctcacctccctcctcagcctatacgcaaaatgcggcctcctacatcgagcccagagggtgttcgacgaaatgccacaccccagcaccgtcccctggaccgctctcatcactgcctacatggatgctggggacctcagggaagccgtccatgtcgcaaggaatgcttttgcgaatggtatgcgaccggacagcttcacggccgtgcgtgtcctgactgcgtgtgctcggattgcggatttggcaactggggagactgtttggagggctgccgagcaggagggcgttgcacagagcgtgttcgtggccactgcggcggtagatttgtatgtcaagtgtggggagatggcaaaggcaagggaggtgtttgacaagatgcggcacaaggatgcagtggcctggggcgccatggttgggggatatgcttccaacggccacccacgagaggctctggaccttttccttgcaatgcaggcagagggaatgaagccagattgctatgcagtagctggggcgctatcagcctgcacaaggttgggtgcattggatctgggacggcaggcaatcaggatggtggactgggatgagtttcttgacaatccagtcctagggactgcattgattgatatgtacgccaagtgtgggagcacggtcgaggcatgggtggtgttccagcaaatgaggaagaaggacattattgtttggaatgccatgatcttggggcttggcatgactggccatgaaaagattgcatttgcccttgttggtcagatggagaagtctggcgtgaaattgaatgacaatactttcattggcttgctctgcagctgtacacacactggcctcattcaagatgggcgacggtatttccataacatgactaagttataccacatcagccctaggattgagcattacggttgtatggtcgatctgctcagtcgcgctgggttgttgcaggaggctcatcaacttgttgatgacatgccaatgccagcaaatgctgttatattgggtgcacttcttggtggctgcaagattcaccgaaacacggagcttgctgaacatgttttgaagcagctcattctactggagccctggaattctgggaactatgtaatgctctccaacatatactctaacagaggcagatgggaggatgcagcgaagcttagattggacatgaaagcaaaaggggtcgagaaggttcctgcatgcagctgggttgagtttgaaggtaaggtccatgaattccgtgtcggagacaagtcgcatcctctttcagatcagatttacaaaaagctcgacgaattaggattggaaatgaaaaccatgggttatgaaccaacaacagaagtggtgatgtttgatgttgaagatgaagagaaggagcacacactagtgcatcatagtgagaaactagcaattgcatttaaccttctcatcactggaccaggggagaccattagggtcaccaagaacctcagagtttgcagtgactgtcacactgcaattaaactcgtatcgaggataactcatcgggagatcattgtccgagataacaatcgatttcattgttttagagatggttcttgctcctgcaatgactattggtagaaccgtagaactagaaagtagacaacaatttgttgagagctgtgattggtggatagaagagtataaagcagatgatgatggaagagtataaaccagatgatattgtgtttggaggcgcttctatgcttcacttcttgtgaaatgcacaacttttaaagcacaaataaaggatggattgcagttgcagttaaatatcccttcaagtgcttcatgatttgtgcaattatttaaacagaaaggaatatatatatatatatatctcttcaagtgattggttcacttccaaccaagacacacacatgtagaataagctatttcttccccgtcagacaatctgcaccagtaattgtctgatccttctgatgcttcttttggatgttgtacttattttcattcattctctttgttctactgctatatatatgttttcgacttctcaacagtggtaattattgtgaaagctttctctggaaatatgttactatctctaaacaagtagcaattaaataaagttgcataggctatatatataagaagctaattaacaaagaaaaaagaatctttgtggctagtctaacatggcccccggcagatttgaccaaatgcacactgaccataacggtagtgcaatcaaatatacctatgttttggatgacctgcccatgtgattttgccttcaagccacggagcatacggactggctcctccgcttctgaggcgtcactccgcttaaccttcaagtctagcaccaagatgaagatgccacgcttgacaatggcaatcacaaacctcctgttaagctggcacggcttggcaatggcaacacactcaattgatcgacaagccgccctccattgatcgaatccctccttcggctttcaatcttgtttctttggtcctggccttttatctgacgatcgagcggggctgtctgaataagttacggttttggcttcaaataacaaccgtagctagctagctagctcaatattgcatatacagcttacttctcaactttgctttgcagcggagaatcggccttgttgatcttgtttctgaacaaagctcacttgcattgaccacatttcacctctacattctcaggttacttcacacggcacagctgactcctggtcctggatatataatctcttttgtacaacacaaaccatacatacattttggcttttggttcctgacacattcattgtcagcaagctactcaacagcaacgttacccaactagacatatatgcacatttgtggccaaatgagagctggagactcaacttcagtacacctggatggcgtcctgtcttgcgttgcgttggtctcttctccaatcccatggtttctcaggattccctgacgcccaaagccctcggtttgcagctcttgcctctctctcccactacataatcagggagtaagtgaacaactctttattacccagaagtaacaacatatgtaagcatgactcgacaaagtttatgtaaaaaaaaaaggtgtcagagcaaaacaagtaacaacacacaatatagttgaatctcttactcttgcaaactctgggcgtttatcataagtcttgaagtgccatgcgtggccattcttcaacatttgctcctgaaggactcaaagagagcacataatttctctcataagaattgaagcagtaaaatcatgatacatgtggaggtactgatgaaataggttatgtttcacctgaatgaacaaattattgcaatagatatcaccaacgtagcgcccaaactggtccagatcatatacataaattttgacgctcttcccaccaattagtttcaccaacgcagtccgtgattccttcccgtagggcatcttaagctccggtgcatcaattcccctttaatatagaaattataaaagatcatgcacttcacccctcccagtagtacatcaaatttttattcgatctagaggtgcaacgtagatacctacctcattcttattctgtatttccttgcgaggacctcgtcatctgaacaagatattatcctgctcatcaaaattcatagtaagccatgttttcctgtgatctccaagcaaagctagcacatatatgtgattaaaccaaatcgaactgatgtaattat

SEQ ID NO: 18242 - DNA, 3840 bp, Oryza sativa
aaaatgcataaatgcatgtgtcaactgtgtggggacaataagagcatctatatacatatcaaggattgtgtgttaactgtaattattagaagaaaatcaatttaatttttaagctctgttattttcctgtgcctactatattaggcatcctgcattgttccatgaaaagacaatattcagaaaattaggaccataactcttgtatggaaaattagaagattcgtcattcagatatgcaatcttgtgctattaactgataaggatcaaaacagatcagtttccatacttgtatccagcttcatcaaggctgcttagaagagcatcagcactctggtaatccctacatttgcgtgcttgagttcttgctatcaccaactcatgcacttccaatggcacatttgcagattccctcggatccgttgtgggaacatatgcagtaaatccatcaccatctccaatgcacttgtcataaacctataatatcagtgatatgtgagagttagcatttgtcaataattctgtaaatcattgttcaatgtgtgatgtcggattcttggtgataaacctatctatctatctatctatctattatatactaaaagtccattaaactttctaaaatcactttcaagctgccatgtggcatcctaaaaacgctctcaagctgccacgtgatgcgaggagagaagatgaggacccacagaaaaaaacaaaatcatctcccacaacctccgcatgtatgcatgcatgtggctgctttccttccatgcttagcggcaggattaccaagtaatcatggtattacattaatgaggtttttctctgttatttggatcggtgtgtaggagcccatgttgggctttagtccgttcagctggctaggcctttgtgccacctatatatgccatgttccttgtattaggagattggcttttagttttcctttgtattgtgccgccgccgccgcctaggtcaggaaggagatggtgattccatctgcctgacgttttgccaccattgttgctgcgttggtttggacgagcatgatcgggaattaatttcctgggcgtgttctgatttctgccgaagtcttcttgctctgattgtgtgtcattcttgctgcacgggtggagtttatctacagatttggttagtttattcattgtaaacctaatcatctatctgtttaaatttgatctaatggagctattcagcttagtttatctggagttatcgatcttatgtgtctgaccctatatactttgctggacgagatctctatcatcttaatactgctgctgctcttgagttattaaaatggagattacagtatatatattatcgctgcagacatacaaagcattttgaaagattgggacaaaaccaggaaccgtagccgtttccttatcacattccctttttgccctgtttttttagttagattcagtagtttaaagatatttaatgctcttttcacaaaatttctaataaactgatggttctagacagttagatctatctaacaaataaaatactaaaatattctccatgcatggctacaataagtacatatgcgccttctttcccctgtttttttttatagttcaaatcaaatttttacatgtccctgaattcatactcacattgatgtctcatatacatattgatctcggaggaagtaaaacacactatgtctactgttataatatttttggctcaattttggaggcaagattttagaaaggacgcatttatcccatagcgagttgtacactcaacatagttctgtttacatcccaattttaagagatcaaaatcatttcgagaacgattgatagaacatgggcctctaatattccaaaagaaatagaaaggacaactggaattcaaacgaaatttgggctaaatttaaacaaattttgttgaatccaaagcccgatataaattgcacaaaacatttgaacttttttgcatgaagttcaataactattcttaagaaaatgaatttcataaagtttagaacccaaaacgaagatttgatatgtattaaaaagagcatatagtttagatgacagtttataggggccaactccattgttgcaacataatactttcatataattcaagatttcatggttgtaagtaattttagtttagaatttttgtgttgcaaggataattagcatttaaaatagtcacaaacaaaatattgacaaaaaaacaggttgagaatagaatcaggaacagtcacgcatatacaaatattatattcacatgtatagagtaatatttcaagcaacattaaattagatgcccgcgcataagcgcgggcttcctttctagttattcagaatagttgtaatagttgatcacaccgtaccggcaaagtgtttagcacaaactgcacgccctctggtagcaaggatggttggtagtttgacgatgctgtggggagtgatgggatcggaaggttgtaaaattcaagaataccctgagaggaaacatagtttctagacgaggtgagtagagtatctatagccaatttaagcaatagaaataacacaaattgcagtgaattgctttgattgataatttcagtttgtaaaaaacgatccttgatcatgaattgttctgtggtcactcgggttgaactattcagtatttcaaaataggaaaaacaaagttacctccaaatcagctctctggatcatattaagggctcttgcaattagctgagcagcatttgctggtgtttttggtggaggtgttgtattcttatacgcctccaacagtttctggtacctattattattccaactaagatatcagatcaaacattcctttgaagtttgttcagtggaagttgtattaatatcatatatactagctgctagttgcaagatttgccaaatacatttgctttgtgacaaactggttcgttactgacagtataacataccattggaacaagaaccatattaaacatacctttacgctacttgaaattctatcctactaaaatatgtaaaagaattcaagaccgaagcttgtacgtcaacatggctgatttcgaatttagcctgagtcttctggagaatgtaccagaaatgtagccaagaacacaatttatcttaatcaatttcaacttccatgtgaatatgtaactatacatttcgtttggtaagattttttttttagtcccaaactccaaccgttgcgtactcttatcctactctctgttttaaccattgccagaaggttttagtttgctaaaggcatgtagcctagtggttgcagtgacctgagtagcaccccaaggtcctgagtttaaatcttcatatgagtgaatttcaaattagattgtttgtggggataacttcccaatttaaatggctgcatatatccggttgaatgtagaggccatgtaaaaaatacccttccctaaaaaaaagagaaggttttagtttatcaacacctgaagtagcctggacaaatagaccatactagtggtgcatcaacttttgcttgtatgtttcaatatttttttttatcaagggcatgacacccccatttccattactagaaatgaacagaatcttgtatgtttcaatgtcgttcttttttatatttttcaccttctcaaataaggatttgtctacatatgaaccaagtatggaacatcctatcctaggatagcaaatcaaaatcatttaaccgcacagtcataaaatcatttagaaaaaagcccaacttaagctagtacaacagtaaccaatcatttatttatttaaaaaattaacctacaaagcaaagcaattttgatatcagtaggtacaccaa

SEQ ID NO: 18243 - DNA, 3234 bp, Oryza sativa
tttacaatacactaaaccccttacaaaaatgactggatgagtcacatataacaagataaatccaataaaaaggaatattgtaagtattggcttcggtaacaagagattggtttcaattgcacggggttcaaagctgagaaaagttacatatgtgatgcaattaacacctactccaaagtccaaacccaaccttttgtcataaaaccaaccaaagaaaccttgtattgtaattggataacctctaattaggatgtaaatgcatgctgaattgctgatagattaatgtcagacctacagtaacctcttctagttagtacagttgcaagctgaatgaaagaggaaagcgggagtaagggcatgtagctaggagcatgtgtagaagttaccatggatgtggattccaagttgaggagatcgtgcgccagggcggcgacgccgacggtggacggcgtgacgccatgggggccgagatgctgctgctggagtggagctgggggggctgcaggttgaccatggtagtgaggaggctggtagtgtggcctggaggttggcttgtagtagggatagtgatcaccgccatcgtcgtctcccttgaagcaccggaggatgttccccatggatgctttcttcttgctctacctctatcgtatcagcactccactcttccccgggagttgcaggcctgcagctatggcctatggctgctgcttgacttgcctacttgagtctgtgacagaggagcttgggaactctactctactcggactcggggaaatttcggagtgaagaaaagcaaagagaaaggaggtgacttgtgggtcccaccagcctgctacaagtgggaaggaaaggaggagactacactagtacactacactctctaggctttgattcagatagcttatccataatatacaacattgaccatctatgatggtttgcctgatggactcaataattaccgtgttggtgttctcatgtagtcaaaaaaaaaaaaaagaaagacaatcaatcatacgcagtaatattgacatatcagaatatactactccagtatctataacagttattggtatttccaaatttcagtaaaaaaaatatccatacaccttcaccattgtccttcagctccggccgatgagcatgagcttcagttgaaatagccactctctgtactagtaggtcggcactgtacttgatgttctcctttcccccgtgattaaaggcgcaagttgtcgatggctccaaatgccatcgtcatttgtgtttgtagcacctacgtcatgtacttgatcaggattacgacttgggggattagtcaggttagagatgtttagtgcattaccgacattttttttttgcgccagcagtccagcacaataatactccatattgtagagagtaccaaacactgccacactagtccattacaaaagaaggatttctttttgagcaattttacagttcttgaggaggtattatgagatactaaattttacactaattttttaagtacctcgtagtacttagataccaagaggtaccaaatttacaatagaaaaagtggtacctcatagtacctactcaaagactataaaattgctctttcttttttgattgttgagataacagtctgaactccaaaatgagatgttcagttcagaaacacttgactctacacgaacatgatatatgtcaatatcatatgcatacttgtacatattcctagcgatagaaatctagactgtgtccagaatcaaagcaagattatgcaatcctaggtacagtaaaatacagaagctcgccaaaaatcctaaaacacaagattacttggagaagaacactaatattgcagcagagcagagaagagaagagcagagggaatgtggtagtatatcagcatgactagccaattaagtcagtaatcggcgtcgttcctggtggcggcctgctgctggacgacgaggatagagaccttggccgcgaagtcggcggaggcaagcatgtcgcccagcactcccagctccgggaactcgctccactccgacagcccgctcgtcagcgccgccgccgacgacccctccgcgccgtcgccgccgccctctctcctaccaaccaccagcaggtcgaacttgtcgctcatggcgcgcaccaccgacgccgtcccctccccgtcctccaccgtcttctccacgtacgccaccctctccgcgcccgcgcagctgtacctctgccagaactcctgcagcgcctcctcgtccctcatctcgtcgcggccccccatccccacccagtcccgcagcttcagccgcaccaccgtcaccgccaccaaaccgcactccgccatccgcgccacgtacgccagcgcctcccggtcgtcggcgccgcccaggaagtagagcgccacccgctgcagcgtgctgttggacgccgtggcgcacgccgaccccgccgccaccccgtggtcgatcaggatgcccaccgagcacggcgcgtactgcatcaccgaccggttgatgccgcggatggcgttgttggcggtgctccgggcgccgtccgaggacttgtggaaggggagcaggatgaggttggccttgcggctgtgcgccaggaggcacacgtcgtgctgcatgctgctgtacggcgacgccaccacgtacgggctcaccgtcaccgcccccagcggcgcctgctgctcgaagtagcggaacgcgttcacgatgcggtccgacggcgtcgggttgccgcagctgctccgggacttcctgtgcggcttcagcacggacgccgcgtgccccaccagctccgtcaggtggagcacgatcagcgacacgggggcgtcgcgcgacgaccccgacgcctcgatcaggtccagcagcggcgccgcgtggtcctcgctgaagaggcaggccatcacccgcagctccgcgttgggccgcgactcctccatggtccgccgcttcgcccgcgcgaacctccccgacgggtcgtacagcagcttgatcagcggcgtcgccaccgccgtgatgaccaccatcgacagcgtcagcgtcgagtagtgctccgccgtcgccttcatcgtgtccccccagttgttgatggcggccacctccacgatgccccggatgttgagcatcagcgccagcacggtggcctcccggaaggcatggagaagaagagccccgccgcgacgcaccccaccatcttgccggccacgcacagcgccacgaacag

SEQ ID NO: 18244 - DNA, 19183 bp, Oryza sativa
cggccgagctcggagttgaggaggtcgagctcggcgagggcgtcggcgacgacggggaaggaggagagggagaggcggacggcgagctcggtgatgagggaggagccgcggaggtcggcggggagggaggggctgagggcgtggaagacggggagggtgacggcgagggggacgagggagccggcgaggccgacggcgagggctcgggcggtggggcggcggaggagggtgaggtcggtcttgacggccatggagaagaggaagaggatgagggcgacgagggagacgctctcgaggatgtaggtgccgcgctcggagaagagggcggtgcggaggtgggggttgcggccgaggacggaggggccgaggaagatgccgacgagcatgtgggtcacgaagcggcactggccgaggcggcggaggacgtggtgggcggcggcggagaggatgaggatgatggagacctgcaccaggaggagcgggagggcgaagcgcagcggctcgtcgcccaggaacatcccctgcgagttcaccaggttgttgtcgtagcacgccgccaccaccggcttcaccgtcgacgcgtttgcacccgccatcgatcaaactaattaatgtccttcaattcaattattgttaatttaattgttggaatgaatgatctagccgccgcagaggaggagcattgcagcgtcagcgtgcatgagggagggaagccatgatcgatatgatggaggaggtgtgtggtgtggaaggtgcagagagaagaggatggctgtttttagttgtgcggatgagagggcaatgcaaatagagagatcgacgttgcatgcaaatatgcgatgcaactgaggaccgccattgttggttggaacttggaagaagaggaaaggacgagctaaccaagcaaaggtggaagtcaacaactgggcccagcagtcaaccatcatcgtgtgcacgccaactaggatggatagatgggccacatgtattccatcgggcaataatcgtcggccgcatgttcattccggcccaactaataagggcccgcatgtacgtgacaattccattcggcccaactatatcagtacgccacaatcccgttacatctctaaaattcagaggctcacctggaatagtatttggtttccagtcagtggtgagttggactgcaattgggcatagaacagcacacggatcacccaaatttgcaatcatcaggtgatcaccttacgcaaaagcatagcaatgggaaaacagggcaattcaagggttcgagagttttgtatttatccctacaaactataactatatatgacatacgcacaaaatttggcaagttcaatgttcaatgtcttgcatgctatgatttcagaatcttagttttaggtagagatggtgtagttctactatatggacaagactcttgccggtgcaaaaatagttgaaagattctgtaatcgtagtactaatacatgtgtaacgacagtgacagcggttgtgccactacaaatgcaaccaattcaagaatgttgcctcagctcctcgtccacatcctcaaatgtcttgacatacatgttctttcaggtggataacaattgcttctcattgttagaagtataatatggtagttagagataagagtcaaatacaaattatagagataagatatatcctagagatagaatcctagagataagatagagtcctagagatagaatcctagagataaatctactcttatttgtattgtactccaagtctctatcccctatgtactcctatatataccccatgagagggtcgatccaatatatcagaaaataccaaaatacaacgtattagattttctacatggtatcagagccgtagacaaacgtcgatcgatcctcggttccagctaggttccatccgcgctgccccagggagatgagatcaatttctccctggggcaccgcaccgcattagctagctagcctctccaatcatttacagattagtttaccgcatatcattagatgcgttttctaataattagttttagatctattagctagccacagaaaaccatatgatcgtcaggagcaatgcggcaggtgttacaggagcagacaacgtcaacaagcatcataccatccggcctcatccatggatcgatctgcatcgcctacttcacaagaagcaagggcctgatgctgttcgtcgccaacatgtgcacacgcctgtgctgcacacctgcatcaagacaccggccgatcatctgcgacgtcttcgcggagtccaagtcaagtcgccgagctctccaggacgatcgtcttcgccgattctacatcatttcatcaacttgccgctgccgactcgtctacatagatggacacctcgcatcctctgacagattaatctgcaagacgcttcatcgacgacatcgaccgtgtcctctacgacggcaacgaccgcgtcaccgacaacggcatcgatcacgtcatgtacgactacaacgactgcatcaacccggcatcactattgtgatgaccgctatacggcgcagaaggaccaaccaaagtggtggcctcatcgccaacgacgtcctctgacatatgcaagacgtccccaatggcatcctctgacatctacaaggtgcaagatgctaacaattacagtttttgtcttcacaccatggcgtaaatatttttttttcgccttcggctatatgcggctacaccgacaaccacagctacttcatgatcggctacatcgacgaacgtctacaacaaaaatcattgacggaaactccagtccaagcgtccgtgtcatcgctatcgtccatgacactcccgctatgactgcgggagggaataaaggagagtcaagggacgacacagaaggggacgcaggcaccaggtggaggaccgtccatcagagatgcagtcgatgatggtgagtcaaagaaagatgaagaaatagaagatttcaaatccagtcgcaatcgttcacttcgctcccgttacgactgagggggaatgttagaagtataatatggtagttagagataagagtcaaatacaaattatagagataagatatatcctagagatagaatcctagagataagatagagtcctagagatagaatcctagagataaatctactcttatttgtattgtactccaagtctttatcccctatgtactcctatatataccccatgagagggtcgatccaatataacagaaaataccaaaatacaacgtattagattttctacactcatcgcttgtatcactgaatgaggtgcagtcttatttgtccatggaatccttatcactgttattggaaggatcttgttcagttttcagtgtcaaggaggaggattgtttcaacagaagggccttgcgaacatggcgaaacaactttccttcaaagattcaagattttgttatagtaaagatatatcaagtgaattgtgcatatcaacaggaaaaagggaaatgtacttgcattggaggtgcaagctatagacattcaggcacagtcaaaataaataaaggttattatagaaatgcaggtacaattcaggttgcagaatttcaacttcagcaaaagcagagatgaatctagcgtatggtgctcaaatcatgttcataattcagcttgtagtaatcaaacaaagccccttaatagcattagcctattcctccatggcaatcttcagtttgtatacataatagtagtacaaaaatgagagacatgttgtcagatgtaattttcatacctttcgcaccaaaactgcaagcattatcaaaatggaaggagcattttgcacttggggtaaattagtagaacgtattgagccatggcaagagaaaccttgtgaaagaaggtcaaccatcaggttccaatttcattagcaacaataattcacagagttcgttaatgggctagcttacatgctagccataatagtctttacagaatccaagattctgtagtagtgatagaatagtgctgagtgcttgccctccaagccatcacggtggtatctgttgctaccagcgaggttgttgcacgggctgcccccgatcaccaggtcaaagccaccaaatcttctgatgaatagttcaattctttcagcagtaagattttgaacatctgcgatttcaatcagcgtgccagtttgggtctggtcccaccaactcctcagcaacgtcatgtttacctctgatatttcgactaagaccactgtcttcatacagattccaagcctgtggagagctacttctgctccaccaataccagaaaacaaggacaagacgttcatgccattagggaatatgtccctcagcacagagaggtggtaggcaactgtatcaacttggaatgaattcccaagagctctatatctcgctgtcctgctaactcccctggtataattcctatgttagaatttcaatggttactctcattgagaagaggatggcactcgagatggggcaattttctggttttcttcattcacaaaacacaaaagccatacctacccgagagaggttggatacatatatatagccatagctggctactagcctattgctgcaccctcctagtctaaaattcgaaatttgaatgggatgctgtcctagagggcatccaaactgaataaagcataaaggaggcataaaggagatgctaactgctgctgtcctactaaccgtagctgtcctagcaactgaaaaatatgctaaagggtagatgctgtcctgaaaaggtgaaactacccaaaagcaaaaagaagaatcacgaccaaggaccacaaagacttatccaacatcctagggtatcccaataggaattccatctcatcaggctctagagtagcaaccttgttctttccaacctagacaaggttccacttcctacattcttccaagacactcttctgaactgctggaggtagtgcatcgccgaatctaccaagagcacatcgtatccgttctgtatgctttgcgcttgccacacaagtttgcaagcagttgaactgccttcttggatcccaaaagggccaccacatcttagtagaaggaaaggcttcagatattgtctttgggggaatgggaagaacaggtgacctgttcttaatcggcaagttatggatgtaacccctcttcctagcagcagcacagaagtatttggaatatacgaactcaggataaatgtcatacaagaatcttgagatggtcgtccatacaccttttggagctagggccacgttttcatagtaaaagaatggtggtccaagagcctggtcaggaaggtttctgtggactgaccttaacccgtcattgggcaagctgaatcccaccattgaatttggaagaggcattggctcttcatggctgccgtcaaatggcacttgattccattgtggtctacttctataccgttctctttttttcttgcttccatctattaattttgttttctttcttcctccaaaggaactaaactctgtatcctgcacaaaaataaacattatgccagtggcattacattaaagaaatgaaaacaatttcaccattcagatgctctataatcacaaggtacccatacttcatagtcagataagtttgtaaaacaaacatttcctgcagtcgctggtgcatagattgactcaaccaacaaatctacagacgcatccagacctgccaaattttaacccagcataggcagtataaggctccttactgtcaaagcagcaacttcaatagaggtataccgcatctaataatagccctcattacttcatcttcaggaaaacccatgctgactaaggacttgattttctcatctttctcggacatctcttgtaaaaagtcctgcaacaaagcacattacaagcagactgaaaacatttgctacatctcactcatgaattgcagtctgaaatagcctcccaacaaagcaactaatgcaggcatcacatatatgcatgtacacccaaatttactgcaacaaaatatacgattatccttctgtgtcaaatttgttgttgcgtcttacaactccatgcaaacagatactaccatactatagaggaacttattttgaggattaaagttagaggaaactcatactaaagatgtaatgaaaaagtagtaaaactatttaaaaaatggtgaaacaataaagcatgttagaccacaaaaaggagggggagtacagcttatcaatcatcaacacatggataaatgcccagcacagattacctaagctctcataggcatcatttcagttccattttttgttgtctattatgttttcagatgtagccagtggttatcattgttctgtctggtggtcttaacttgcaaccattcaattataggcattcagtagactatctttcatcattgcttggtttgaatacgaccttgtagaagtatatgatcatctctttgatggttctgtagtagttctgctatctctctcactataaaggcaccatacaaaaatgccagctaaagaaacatagaagcaagagcaggatcaacaaagatcctttaacaaccctataggaacaggtattgttttatagataacccaaaaaactacagcattgcagtacaggtaagcatgtacacttgtttactaaataaaagtgaagcataacttaagtcacaaaaccttccaatttattggaccaagaccaatagataatttagacaagcactaaaagggaatgtgtgcttggcatgaaacaagtgtaacaaaggttcgatcatgtctgatataaatatataatgaccaaggagggagtcatgtgaatacctcatcaccagaaccatcagagtaagtagccctatcaaaattgtcaacagtatcatcctcgtcccaattaacatcctcctcctcatcttcttcttcaagaatctgggggtcacaggcagaatgagagctgttacccactgaagggtcactgcctatcgcctgcattacagtgttacgtaacatgacttgtacaatagagcattagataataaacaaagtgatgcaaccacgtgagcaaatacctgataagtgagaagtaactcaagaatttgctccgaatctgtgtcccctgaaagaaacggcaacagttgaaacaaaagatgcaaaatgcaacctaagcaaatgaggaaatgtattattgttatcattaccaatctccttgatagctctgaagaccatctctctcgagaaacccattcccaaaaagtaagcaaccaaagctgatggtgctgatccattggccttcccattagcatcctttagacaaacaccatattatgattataattatagtaaggtaatatcatggttaaaacaaatgaccagctcgtgtgtgttcaactagacttatatctccaacttgcagcctgggtctcgtggacggaccaggcgcatccgtgttcgaaaaggctggagcaaacgtggcctcagactcaccatcagtatcccactcgaactcgctatcctcatcgctgtcgctagcctagtcctgtaacataagttaagcacctcaccccaaatatctcgactaccagtggaaataaggcaatttcagaggaaaggaaaaaaatagcgaaagattgaatcgggtttaatgtagcatcttgtgtaaggcatactgccagtgccaccccaatatcacatagcctcatcaaatcacaagggaaaaaatattatgcttctccgcatgcggttcgcaatatatccacgcgatatcatgaatcaaattcacaagcacgacatcagccatcacagtaagagataattttaggatcagaatgcagatcatccttgtgcgattgaataaagggtaaaccagaagcccctccaacccaattccagtcggaaaccctatgcacgaacaaatcgtgcacagatggagcaatacacgaacaacagcagcagcagaagcgcatcgcctgcacgcggcagcgggaaccattgggtgtggccaaactgatgtcatggatggaggaaggagaggagaggagaggagagaagaggagggagggagctcttaccaccattgtagaaggtccgcgaagcgcctcaggcaataacctctcgctgctccaccgcgtgctggcctccctctcctccgccgatggccggcctagatgcggtggcaaggaagcgcgcggcggaagaggaggagaggtcggtgatggtcggacgtcgtcgcctccgctccccttggcttgtcttgtcgacgactaccagagaagacgggccgcacgtatctagcattcccgttacggcccaacaataatatgggcctcaagctagccattaatcccgttgcggcccaggaggaagggaatgaggcgccaacgatctactggttggtattcatgccatagaggaaaaagtacaccgaaggtccctcaacttgtcatcgaattacaaaatcatcctccaaccacaaaactagatataagacatccctcaacttacaaaatcgttcactttatgtccttcggtggttttgatcccagtttcgtccgatgtggcggctgagtcagcgtgggacccacgtgggtctcacatgtcagggtgtacagtcagcacctctcccttcccccttctcccccttcctcttctctctctatttctctctctctctctctctctctctctctttcccctctgcaggatgctcggcgggtggggagctcgtcggggcgaggtgggagaggacatccggcgggccggcgatgcggcggcggcggcggcatcgttgacgatacgggagaagggagagcgtcaccggctcaccgcgcgtgcgacctcggggtcaggccgctagagaggcccgagcggtggcggcgaggacgccaaggcgcgggactccgggtggcggcggcggcatacgacgcgctgccggcgccggtttgggaccaattagaggagcagagaagagtagggccaggccgtcatctcccgacaacggcggcgaggcaaaggaagggcggcgcggcgaggagggagcgtggtgctgcgggaggccatggcgggactcccggagcacggcgacagccgcgtgaggtacagcaacgcgtgacggcgggcaagcgagggcggcgaaggcgagcccgcagcggcggtggctagggaagcagcggagacacggttgaggagtggacagcgacgagcgggagcaggccgacggcggcaagggagttgggcgagcgcggtggcggagaggcagcggcagcagcaggcgagcgcggctgcggatggggagcggcggcgccgacgactccgcgccgctcggtctcattgtcgtcggcggcttcgggtgggggcgccgcgccgccggcttcttgtcgctcgtccgcggcgggggtgccgcgccgccggcttctcgtcgcttgccacggcgctggaacgggggaggacggccggagaggcggctcgttggggacaggctcgcggaagagcaatggccggaaggacaacagcagcggcggcggcgacaacgcgtcggccggccaactccctcctcgccgcctccatccccacttccctcccgctgtcgccatctccgtcttccgctcctccctcgccccggatgggagtttcgtcggagcggcgtcctcctcctccacctcgccaccgccattccctccagctcccccttcgctctacccctgtggtcccgccaccgacgcccctccccgctcgcgtgcgccgacctcgtcgaccagggtgacttcaacggggcacgccacgacgggacaccgtgctcgccgccgccgacctcgtcgagcggggtgacttcgacagggacaagagaggccgtggcgacgcccgaccgcggcgtgctcctctgcaccggcgaccgcgcccgcgcctgccgcaccgtcctgccacaccgccctggctgctcttcgccggccaccgcccatggagagggaaggagagaggaagtgagttgatggggagggtaagaagtggtgacatggatagtctgacatgtgggtcccacgcagactcagccgccacgtcggacaataccggagtcaaacccaccgaaggatctaaattgaagggttttgtaacttgagggatgtcatatatctggttttgtggttgggggacgattttgtaactcgatgacaagttgagggaccttcggtgcactttttcctgccatcgacggaatgaaaactcgaaatcttgtccattataaaagaagaactgactacgggtgaaacttgaattaaggggctgtttgggcagaacgatggagtactttcaataatctaccaacactaattaagaatctgtctatctgtatataattctctcccgatctgtttgcctgaattttcagtgcatgggctcctctttctctgctcccagatcagatgaactgaaattgaaatggagtttaatccattccagataatcatcaatcatatatgtccatttaatttgttgatagcgtactccattaaggaaggaagaatcacaataaataaatcaaacaaaggccaccacatccaacagctaggcaatcattttcagctactacaagagagggaggatagcagcagcagtatcggtccctattccgtcaactcaacaacctgaatgcgacatacgtttacgtcaatcaacttctaaagcgtctccctaatttttgccatttaaagcatgtaatcaaaccctctggattacgttttccggcaacgaaagcgactgttatcaatcaatcaatcaatcctcgcctcgtcgtcttcctccagcgacgtcgaccgccgccgccagctcagcacggcgcccatccgcggcagcctcaccaccgagttcacccgagccaccccctccagagctctccatacattcgtcccctcctccgcctcgccgccgccgccgcccaggacctttcggaagctgcccgtgaacgacacggcctgaggaggtttcgcgtccccgggggtgctctccgacgacgacggtgaaggcttcaagaagaggcacaccacggcgcagtcgtcgaccatcgacgtcgggaacttgcgccgccacgtgcgcaccgcccgctcgacgagctgcttggcggccttggaatggtcagtagccgacgatacgatcttgatcacctccttgttcgacagcacgtcccatatctgcacccacaacaatttgattggttgcattatctgaaaaacaacctctatccgctattctgatttataaattccctgtggatgaaattttgattggttgcattatctttaaaaaaacaatttgattgattgattgaggcaaaagcattcatgattcagttaactttcgcttttctggctgcaaccatatggctttgcactattaattttgtgctcatttcatatctagtactggaactggagtagcagtgaaacaaccaagagaaaagtgttactcttgattatgaaaagatggtgagtaaatgaaactgaatttggctgccatcatcaggcaaaagtctttctgtttgcttaccccgtcagtagcaagtaccaagaagtcatcttttgcagatagcttcctgtagtagacttctggtgtacagattagtccatgactcttcaagcagaaatctccaaatgcccttgccatggcgaggcccggcgcgtcttggtctggtagccacatcctaggcacgtccggctcatcgtccatggcgaaaacccgccccttggaattcaggattctctcagcttcgcctgtcagaagcccccatatgaatgacaagtgaatgtctgaatttagacatctctgtactttgagaaattcagaggcttacttggaagatttggtttcaggtcagtggttagttggactgaaattgggcggtccttgctgtctcgggtgcaaagaaccgcacgtgaatcgcccaaatttgcaatgatcaggtgatcaccctgtgcataagaatagtatttgggaatttaatcagaatgattacgagtttgagagttctgtatttaggcacaagtatagctgtaacatacgcataaaattcggcaagtttctttgttgcatctgatggtttcagaagcttgttttttaggcagaaacggtgtatttctagtgcataggcaagactattggcaatacaaaaaaatgttgcaagtttgcatagttgtagcactagtacctgcctaacgacagtgacagcagttgtgccactacaaatgcagtcaattccagaatgttgcctcagatcctcatcaacatcctcaaatgtcttgacaaatatgttcttccaggtggataacaattgcttctcattgcttgtatcgctcaatgaggtgcaatctgacttttccaaggtttccttatctgtgttgctggatggatcttgttcagtcttcagtgccaaagaggaggatagtttcactggaaggacgtcgcggacatggcgagcaacttcccttccgagagggccatgcccatcaaaaactccacaaaatatctggcccttgtgccccgcaaagtcctaatgaacttgacacaggtagcacatcaagacctagattatcttatatatattaagtaaaatgtgcacatcaaggggaaaagggaaatgtactatcattggaggtgcaagctagagaggatcaggtacggttgaagtaaatattacagaaatgtaggtacatttatcagtttcagcaaaagcagagatgaatctagtgcccggtgctcaaatcatgttctgaattcagcttgtagtatctaatcaaagccccttactagcactacccttttccctccatggctagctttagcttgtgtacatatatcacaaagatgagggaatttgcagagacaagaagctaagcagcactgaacaaacatgcaagagcaagcaatcaggtctagttgaagatttgaagtaaatacaggctattacagaaatgcaggtacagctcaggctacaaaaaaaatcagtttcagcagagcatggatgaatctactagtgtatggtgctcaaagtcaaatcatgtcctgaattgaagttgtagtaggcaaacaaagcccctttctagactagcattaccccattcctccatggctagagactcagcttgtgtagtactagtacatgatactagtatcaaaatgagagaagaatctgtacatacaagcaaaggaggactgggaaaaacatggaagcaatgaggcagcaatgtgatgagcaagcaatccaatgcaagagagatgtggttacctggcaggtagtcatggcgtcctggttggcgcccttccagccttgcttggtgtgcatggagacgccagcgctccaaagctggtcgtggaagaaggcgtcgtgcttccatggaaatccctcctcctcaagctcctccttccccttgctgcagcatatccccattgcttctgctgctgctgatgctcccctaggaaggaaggaaggaaggagggggtagagagagtagaatggagttgaatgcgtaggggtggttgaagtagttttgttgttttatcattgatggtgatgttgggcatcaggcaccccatccatcggccattaatggcgacggatgtgcatcgatgatggccagccggctgtctatcgtcttggtgactcgccgcgtcggccatacaacgaaccacctcactactggagtaacatgcatgcctgtcgtacaggtaaggtaaggttggagcatttcgtccttcatgactgaaaatttcaggacaacatcttactactaccatcttttatgttgatcgactaccagtgtatatgtgtactagtctactatactgcagatgaaactacacagtaaaactgaaaggaaggaaatgacagtgcaaatgcaatgcagtgttgtaaaaggatacgaggttttctctgaagatgaagtgagctgtatctgaattctgatccatcgatggaggcgtggagaagtacgtggagatggagggatccctgtgcacaacggcgatgatggatagtagagtatacaggagtatacagtagttgcggatggacggaagttgctcattattacaactgttggttgggttgggacgttggttgcttgcaattagagtatttatttattttctcagctccagaatcaactgctgaatcgcctacctgcatgcatctgcagttttgcattgcgctgcgcaccatccatcctcctccgcttcagtcttcaatgctttacaccgtgcctacctgttgttgatgttccctcctctcacatatttcagttgtaacatcgacttgtgacttgcatttttatgacaattgccctcacctatttccccggtccttggagacaattgcccaacaccagcaaaagttaaatagtgataagcatttttatgcattggaccatgcatggaaccttactgtgtaaatgactccatctttctgctgggagagatgaactggagtagcaacaaccaacaagaacccgtgcagtccgggcatgcctgacaaaaccgcccgctaccatgtctcagctctcaactagctagcattcagaccttcgcagaaaaccaatatagtgttcagtgcctttattcaggcaaggaagctatgagacctcattccagataacactccacataaaacactaggagatggaacaaccaaattatagtgagaatgcaatgttccattccattaatcaaattgtgcatcaaaaaggcacagcaaggcatatcacatactccgcactacttacaacatgctttaccccaatgatctctctttgattgttgattcctacctgcgctatatacaacacagcaagaatataacctccctcgcctccactggcatacaagcaaaataccagtactagtatgttgttctgacaatactaccgtcagcaattcaatacactattcagccagttatggcacaaaacttttggagctcattctctaggactggagatattgctctagataaattcaacaccacaaaacacgccccagtttccacaacgtttatctttgaaacatttcactgtacaagcaaatcctgcgactgctgcttccatacatcacacggttctaccgcaacctgccaagaccacacctgttattagacactgctttctaataaactgcataccagttaatgaacatggccaaaacgcaagggtgaactattttgcacttcaattcttctacacaagtaaaccgactagcatcttactttgtataaccagaaaagaaatatagtagaatacctggtagggtttattaatccactggaaaagacaaccacgggcttcaacaactttgagcatatgtgatggcaccatggatttgaatgcttcatgaagcttcacttttctcaaaccacagaccataagagcagctatcagtccattaggcgtaacacccgctaaatgcacaatggtcatgttctgcaagccacatatgcttgaaagggatataagcccaatgtcggtgaccgaacaatatgacaagtttatctgcagtgatgaggagatgttattaagacaattggaagcacggtattgcgattatttcttttacagcagaatgggctaatacctgccggaggttgtgagagaattgggaaaggaaaatcattcccatgtcattgatctcaaagcatttcttgatatcaagcttagaaagtagcctgcatcctgtggcaatttccgagagaccagcagatgaaaccatggggcagccacgaatctccaatgtgttcagctttatgcattttgaaagtgatctcagtgaacagtctgttaattttgtgcagtaggacaaattgatagactctaacattgggcatccttgagctatatgagtaaccccttcatcactgatcgccccagacctgaaagagaggctattagttagtcttggctcctatcacggaaggaaaggaaatcaaatatgcaatgtgtagggaataacctgtacaaatcgatatctcggagatctggacaggacttgctaacgtgtctaaggccctcatcagttatcctcaagcatatgccaatttttaggcttgaaagtttgctgcatccagagagagctttcaaaccttcatcatccaaatcagtgtcagtaagatccaattcctccaagtgagtgcagcgccttccaatcagctgtagtcctttgctggaaacaaggctacaggactccattctcagagagatgagggaggggcatgaggttgtgatggcagctaatgaaacatcagtgattttgcgacaacaagtaacatccagcttcagcaaatttttcagtcttggcacgacaaaagaaagatctgtgtctgtcactccagaacatttgctcagacttaactccctcaaagaaacacaggatttcccaatggattttaatccatcatccatgaattggcaaccatccagcttcagtgtctgcaatttatgaatcatttcgaagctgcttgacatagaaggagtaacctgccacaagaaaagtgtagataaactgagctcaagttatgtccaattgttcaggtgataaaactagacagtgggctacttacaggagagcagtatgatagattgagttccaacagattcggcattgccttcacaatggacagaacaccgacatgagtgacattgtaataatttgacatatcaagaacctgaaagagtacagatataatttcagctctcagttaccagaaattgtgatactcttattgttgaaggctaacaatgatttagtccaaattgtttcagttgcaatatccatatagcctgaattgaaatgtaccaaacaatatacgaggtatatacatgttagtatccctacaacattagcattgcaaacctactttacatgagaagctaactgaatatactcagagcagaagacgataaacaaggatattaatcagatttaaatttagctagcacaatgctcacagtgaaaaagataggggttgatgattacctgtagtgatttgctgcattcttgatcaagactagtaagggcatcatcatcaattccattacatcccaccagtagtaacacttgtagactttgtagcttcatgatggctggaaagcatttttttacaatctgcacaacaattttttcttagtctgatgagtgtgatctaaactgcagggcaaataattaacctataaccaaaaaatgatgataaaacaaatcaacgggagaagtagttactactggttctgacaattgaaaaggtgaggcaaatatcattttgggtatagataagagcatctgcagatcaagaatagtccaatttccaaagcgcttctgtcatcataggctaatgttattttgtgggcaatattcatgtcaggtgcagagaaccggcagattcacaaacaagaacaagaaaaaaaaaaccactaaattaagtttcctaaaaaaaaaacctgaccttgaaatcaagaagcgaatggaaggggaaaagggagttcttttttccctttctgtcgtctaggtacaataagaaatacagtaaatgaaatggaacagagagatgaagaggcaaggcacaagtaccatggtgtaggagagatccaggatgttgagcttgttgcacttgagggcgaggaggtctagtccgagatgagtgaccccgatgcaccacttgagcgagagctcgcgcaggtcggggcatccgacggcgatgcatccgagccccatgtcagtgatgcgcttgcatcgcgacagcgagagcctctgcaggcggcgcgccttggccacctccgccgccgcggcatccccgaggtcgaggccattggagaggtcgaggtccgtgagattggggcacgcggcgacgagcgcggcgaggccggcggcgccgaacccccgggagcgggagaggtcgacggcggagacggacggcgcggcggggagcgcggcgagggcggcgtcggggaggcgcgggcagagggagagatcgaggcgggagagggcggggtagcgggcgagcgcggcggggaggaggtcggggcggaaggggcggagtacgcggcggtggcgcgactcggcggcgtggcaggcgcgggagacgagggagaaggacttgagggcgcgggggtcatgggcggcggcacggtcgaggatgaggaagaggagctcgtcggcgaggtcgttgaggtgcgggggcggggagaggtcgaggcggcggcgcttgacgcggtgggtaggcgttggcataggcgaggccatggcgaggttgactgcaacaagaagaagggaagggaaggtagtaataatggtgggcgtttggcgcggcgcatgtggagaaggagaagaagggaggaagaaacgaaacaagggggagatgagatgacgagagtgccccggcggcgcctcgatctgggtgaggagaggtcaccagctgggttaccgtatttgcccctcgtccaagtacaagcatggctggcaaaggacggtaatatacgtggtcatgtgggggtggaatggtaaatgtggggaagggacggtaatgtacggagagagtacagggtggggtagaagtggaaagcgaaggcgagtggagagagtcaagtggggagggggcgatgcgggggaggagagatagaaaaggatcaaaggacgaacggaacggatcgtacagcttgtgagtgcggactcgtacgaaatcacacaactactccttctacccatggaatcttttcaccctacccaccgacgcatgggccctcctcgtattcagctcttcgcgggtaacggaaaaagcgtgagaaaagatagtagatgttggaagtggaagaggacgcgctgcacttgggggagttgttgactggtcccgtgcaccccggggacggctcggcttgggtgaaggaagggagtcgccattgcactcaatccgtgggttctgcatctactttctgtttgcataacgttttccttctcattttctttttctgcttgcacgcacacgttatatgcaaaaagatttaaaaatataccttttttccctgaatttacattaatatatgacttctaattagcgtgcacaaatataccatgttgtcttcagcatagcggggactattgcttgagaacgcgagggtcagtttaaagacggcatcatataactcagcaaacttgtgagctactacc

SEQ ID NO: 18245 - DNA, 1273 bp, Oryza sativa
atgggatgcaaagtcgatgatgtcctcggactgacccgaacgagtgcatgcagacatggtgcgagctcgtgaccacacggcccagtttacatagaaaatatgccatctcgcggccctataaaattacttcgcttcatgcctgtgcgaattcttgcaattttgtggtgtccacatctgatcttattgaccatggctatagttcgcaaggtttcagcgcgaactagttgagtgttcgcatgtcgttctcgtgacgatgatttgttattgtgaaaattttcagcatttgtatacttcaaaaaatgatataattatataattattatactttcaaaaatttgtatacttccaaaaatgatgatttgatatataattatttttccacattacatacatcatcgaacacatacagatacagtcacagttagatagtggtacataagtagtcacatgtaacatattgcgtacaacggtttttactttttaacctttacaagagcatgatcggtgccatgctcatacattacaacaggaccatatgagaataggttgcatgagcccatagaccgaaacaatctgaccggtatttttgaaccgatttttttccttttaaccaatagtttgatttttctttgttttttttgaggatgggtggttatgcgagtgatgtgagggagagggaacatgtcgtctgcgattttatagtagtagagatgtactcgtgttgttcaaccgcggtatcatgccgttgccaatcatattttgtgtaatatatatgtatgtactccctctgtcaaaaaaggcaacctagtattaggatgtgacacatcctagtacaacaaatctggatatagagaggatgtgatatatcctagtacaacaaatctggacatagagaggacgtgtcacatcttagtagttgtttttttttgacagaggggttatagggatgaaagtatatcaaattatgtttgatttgtttcaaatctaatcaggttgatgatatagtaaaagaattctaaaagccaacatattagtttttcttttgaaataaaagcatattaggtatttgtctctccacttcgatagaaagcatgaatgagacacacaaggaataagctatctgtccatcatgcaggcagccactagcttgagcatatctacaaaagtgataactcgtatcttggtatgtatgctcatacctaaaaccaaccatccattttagctcatgtctctggagtagtgctccatttataggctatttaatcaaattaat

SEQ ID NO: 18246 - DNA, 2336 bp, Oryza sativa
aaaggctatcgaaaagcagtagcaattagcaaaaggtgaaagcatatatctggccagccgttcatgcatgtggagagatggaaaaaaaactgaataataaaaagcaggttaggtcggtcggtctgagtggcacgccgtacctagaaaggacagaattcagttccgttccgttccgtttggtactggaacatgaactagctagatcctctcctcctcagtacatacctgtcctgataagcactcgctccaaaccaccactccagactccactatgtacacccaaaatcttgaaagaaaaggcgcttcaagtacaggagtaggcaccagctgattgcttatctttatctgctcgcatttccagtaaaaattcctccttgtccgttctcttcttgggaaggcttcttctacaccgtactctaacctgcaattgttttgattctacaaaagttaagggcccctttgaatcgtagggtagaaaaaacagagaaataggaaaaatatagaattctgacaggaattgaagtgtaaaacagaggattgcaaaacacaagaaaaacacaggaatggtcgtttgattggagcgcaggaaaaacgcaggaatcgaatgagagagatagactcaaagaaaattttccaagaggttgaagctcttgctaaatttcctccaaaatccacatgcaatgtgccattccataggaattccataggatttggaaagcttccatcctttgaatcaaagggccaaataggaaaatttcctataggatttgaatcctatgaaattcctatatgaatcctttgattcaaagggccctaaggctgtgttagttgcttggggttaggagctaatccctcacacacgtaaaacgagatgactcatttgtgcatgattaattaaatattagtttttttgaaaaaaataaattaatatgattttttaaagtagcttccgtatagatttttttttaaaaaaatacaccgtttaatattttgaaaaacatgcacgagaaaaaacgaggaaggtaagttgagaactttatcaaaatttattaaaagacgtgggccaactataaatataggatatcaatatatttatatgaaaatataactatctgttcgtaatatctagggacacaaggttcctcaccaaaattttgagaaaatgtgcaactaggggtaactccaactgggacatgattattgcagttgctttcatatatactactcctccagttgatgctaccttagtaaatgacgattgattaaatagtggcgtaccacgcgcacacagatcgttagtagtacagtactgttccgtgcaacatgatgcctcccccagtaaactaagggcacccacaatggttatctataggctctctataagagatccatgtcagcatattttcctacttggaagagattaaatgaagagagagaacaaagttatctactaatctggagatagtctatagagaaaaacgaggcaatgtattagagagctattgatacccatgtagacatactattgagatgatttactattaatctagtctattgctgagatgtacatgttttatagatagcaccttactttaccattgcggatgctcttaggctgcgttctggcaatactgctgctgcaatgcgctattatcatgacaaaataacgtcattgttaaccaagcatgaaagctggacttaaataatataattgccggtgcatgtgttcatccggccgtacgaaccaatgtacgtatatatgtatacaaggtaattatgccataattagctgcatgttggcggaatgagtcgccagtttgaagcggcacatatatatactccagaacttaattagttggctgatttatgcaagaagacgtacataaagttagttgaaagagaaagggtaagagtacatggcatatatatgttgctttcttgttgagctagatgctgacatcatgcaagtatattgacttttcatgtgttgatccatatcatcattcatgccgtacgtacgaacgtgctacggcgttgaaccgggatcatctatcggatagataattccaattccaagttaattatagttgacattttctatgagctggagcagtttggagtactagtcaactttggctgccatccgtacattatatttgtaggtggagtagcaaaccggcggcactcgagtaaatttgcatcttaaaacgatacgcattgtatgtaaattaaaatggagtactcatttgctccctccatccacaaaggttattccctgatcggatggcaaatgctttggctgatcagctatttaagcaaaataagctaactaattt

SEQ ID NO: 18247 - DNA, 3634 bp, Oryza sativa
  unsure (1)..(3634): unsure at all n locations
ctgttagagatggtatatttcacatttaagttttttcaaataagttgtttatatttgttttttatacatttaaaacttataaatgaagagataaattaaatgtttgattagaacccaaggagtcatcttagagtaagtttaatagtatagccaactactagctccaaatcatctatagccaatgtaatagctaattcatacaatagttgcttactaaactattaatatctggtcccacctttcatacacacattacatcttagagtccgtgctgtatttggctgcagatctatagcccgctgctcttctctctcttctgttatctctttaaaatatgtttatagctagcttatagcctactattgtacctgctctaaatactcattggttgcatatttacattcactccttgattttgtaatatctaagatgatttaaatttctctttgatcttgatgacaaaagtaataggtataaattttgtggatagaggaagtaattaagaagaggaagtgatcagctggttaattaattggcacatgccaggatgtaaaaagaaagctagtggcttgcagcaaggagttaatagggcctcattttttcaagaataagttcaccggaggtccctcaacttaacagcgagatttctttgaggtcttttaactacgaaaccagaaatgtatatcccaaaactcacacaatccgtgcataaaaggtcccaaagcagtatatatgggtggttttgctgacntggcatcctantcaacaaaataaaatttaaaaaaagtacatgggcccacatgtcagctgcacatatatttcttttctcttttcttctcctctcttctctcttctcacttctcttcttcaggccagcggcgggcgagctcggcggcggcaaggaggctggcacgacgacgtcgcgcgtcaccgatatgcacacggttatggcgtcgaaagctcgtcggctggcgcggccttcccgtggcagaccgggcacgaggcgtgggacgagagccacatgtcgatgcactcctagtggaacacatgcccgcacgccaggagctgcctcacctcctcctcgtcgacgacgctgaggcagaccgcgcactcgaccgacgctgccgtgtccgagacctcgcttccccaaccaattgcttacgtacgactacttctccaaaattccccaatccccaatcccatctcaagctcatctcatctcgtttcgttagctacctaccaaattaataagctactgacagtgtagcggacgaggaatccaaatcaaatccaatcctcaatcgaaggagtccaatggaatgcgagccggaggagctgcagttcctgggcgtggtggggatctacagggaggcggcatccatcctgcgcgcccaccggccgctctttgcccgcatcgccgccaccttcgtcctcccgctctccctcctcttcctcgtccacatcgccatctcccacgccctcccacatcgactccgacgactccgccctcgacttcgccgccccaggcacccccgcccggtgccgtctcgctgctctaccgccgcgctcgcccgccgtcggctccgccggcagcccgccgccgcttcgctgctctgccgcctcgctccgccgtccgctctgcccgccgcccgcatccgcgcgtgcccatcgtctctcctgctctccgcccgccgctggcctgaagaagaggagaatagagaaaagaggagaggagaagaatagagaagaaaaaaaaatatgtgcagctgacatgtgggcccatgtacttttttatatttttttttaactaggatgccacgtcagcgaaaccacccacatatatactgtcttgggaccttttatgtacggtttgtgtgagtttaggggtatacatttctggttttgtggttaagggaccttaaaaaatctcgctcttaagttgagggatgtccggtgaacttatttcttttttgtcagatagtagtatttttcttgatgggctttgggcccaaaactccgttccatatgcacgttgggcttaggcccataaaactcactgtcccataaaaattaaaattctagctaatttaaaactcactgtcccataaaaattaaaattctagctaatttaaaacaaattaggaggatagacaaatgaccacgataatcttatttaatcaaaaccatacatgcatacatttcatataaaaaatagattaattaaaaggaattttgagacaattaacccacattgttgtcgaataacaactgcgtcacgtcgaaggaggtggtaattcagtgaataactggaatggtaaagcaatatattaatcggttaaaaattttggaatctctccattacatggcgtacctagggggctatttatactcctagtatatgctcataccctctagggttcggttattataggggaatttacatggttacccttatgctagagacattaaagtgggtatacaatgtctttgcatttatgggccctgaggtggtcttcccgggctggcccattaggtggcgaagggcctccatgggttttgcgggttttgtgggttttatacacccaagacaaagatcgaaccgagccgcaccaagctaagccgaactagcgggttttgcggttttaagccagtttttattttgagatgcatcggttttcggtttacagatcggtttttgttggcgtgaaccgagctcctgataaaaccgaagacatcgttcacagccgactggagcgagcactagtagtagtgctgcggaataagtccattttacctccctcatctcttgcgcttgcgtgaataacatccctcaaccggaaaaccgggtataatgcctccttctctgaaaaccagagcaaatcacctccctctgtggttttgctggtggtttcgtccgacgtggcgtgttgacccggttgacaagctgactcagtgtggtgggacccacatgtcagtgtgtagctctctctcccccttatctctctccccctcatctcttgcgcgtgggaacgacagtggggagcggcgcaggcggtcggaagcggtggcgatggcggcggggacggcggtcggaagcggtggcggcggcggtggggacgacggtcggaagcagcggcggcggcagcggcggtggcggttgggacgacggtcgggggcggcggcggtggcggtggcgtcggcggtcgggagcggagaagtcggcggcggcggtggtcgggagcggcggttgggacggcagtggcggtggggacggccgaagcagcagacagcgcctacggtggtcatggagtagagacggtagcggcggcggtgtggaagcagcaacagcagcaggccgccccggtgagctccctccacagcgctcagccaccttgcgagctttctcccaacacgcggccaaccgatgagctcctcccccgcgcgcagccggccgacgagctcccctacctgtgcgaggccgaccagcgagctcccttcccagcgcgcgacctcccggcgacatcctctccccatgggcggcggcggtggcgagggaggcatcggccggcgacggtggtggcagatcggaggggtaaacacggcggtggcagtaggccggcgagggctgcaggaa

SEQ ID NO: 18248 - DNA, 5360 bp, Oryza sativa
cgccatcccaactgccgtcgccgccgcctccttctccgctcccgaccaccgtcgccaccgccaccgcctccgccgccgcttccgactgccgtccccaccgccgcttccgaccgccgtccccgccgccaccgtcacggcttccaactgcttgcgctgctccccaccgccattcccacgcgccagagatgagggagagagagaaaggccgagggagagagataagggggagagagagctacacactgacatgtgggtcccaccacgctgagtcagcttgtcaaccgggtcaacacgccacgttggacgaaaccgccagcaaaaccaccgagggaggtgatttgctctggttttcagagaaggaggagtcattatacccggttttccggttgagggatgttattcacgcaagggtaagagatgtgggaggcaaaatggacttattcctagtgctgcactactactaggcaacgctagcccagtcggatgatcgcaggcccaaaggcccattgtgtggagcttgagggatttgatggcccaacagcaacaatacagcatcagcacgtacgtcctcttcctttttttgtttgtagagcgcctggtcggtatcttcggtacaaaccgacactgaacccaagtatagatcggtttttttaacatttttcctgatggatcggttgattgcagaaaccgatctcttacaagaaaaaaaccgatctcctgaaaaataacggtaaaaaccaaactaaggaatccatataaatcgattggctacatatatacacactagatgaagcattattattagttgttcctgcattgctcaatagcaaggaggcgaggccgcggtgatatggccacccacgggtatccacagtatgcacacacgaatccctcctgtacgttccctgctacttgcttcaagccctagcgtgcatggatcgatcgcctgcttgtttagatatttgatttctcgccgactcgcttcgatcgatcgcctactgccacgccttcctgccttgttattttctctcgcgttgatgctagttcagttgttttaatgtgttttgttcgcgttgctgttaattcaatatactataatccatgcatccacgatcgaccgacttgccgcttgcacaactagttagttggttggtgttttattttgtgaattagcgcattatattcgtttttgttcgatcgataatgatctgattgcctggataggttcatttaatgtttcgctcgctctgatttgatttgtttgcattgcgcactgttgatcaaaactgctagttatggaatccgcccggccgtgcacgctagctcttaaatcacagtgtttttgttaattacagtgtagttaattagtaattatagttatatgctcgctgctataggctatagctgacgtctttaattaagtgcattttagtttaatttgggtgctggaaatatatatgtgcatctaatggcatgtagaaatttgatcaatcgcgctgctcctattcattcatgtgttgtatacatacatgcttcaccgatagattggcgatcaatatgttccagtctggctagttgcatatccgatccttacggtgcttgcattcttatgttaaacacattaatttgattatttttttatcatgtttcatgcctatgttagtatgccttagactagggacacagttataattaaattaatactctgtttgatggagcaagttgggaacttcccccgttggcacggaaaatgagatagcccgttagttgattaattaagcatttgttagaaataacttgaaaaatagattaatattattttctaaagtaaattttctaaaaaaaattgtgcaaaaagatatcattttttaaaaaacgagaaaatagaaatgaaaaagtgacttccgaacatactagcatgggtgcataggagttatatacctgagtactctatcttgtatataggccccgtttggtagggctccaaactccaactcctaactctaaactccaacttcagtgagagctagctccggttggagttgaaaactcgttaaaagtgtctggctatactttcagctctagatctgaaaaaaaaaacgaaaccaatcggccccagccgtgccgccggccgccggccgcgcgcgccgcccgttgtcgtcccggccgccgcgccgcccgtcctggtcccgcagcccctggccgccgcagcgccactgtggccccccaccgccgacgctgccgcagcccgccgccgctggcctccacccgctcgtcatcgtcacgccgcgccgcctgtcgccgcctgtcgtcgtcccgccgccaccgccgccgacgctgctgctgccaccgccgcccgccgtcgccggcgcccgctcgggattgggaggggaggagagagaacgggaggaaaggaggattgtaggggtagttgagtagcattttcgtgtaaatactctaaaaaaattagagggtagtgggtcttttggggtggagtggagctgtggagcagcaaaaatccagccccacccccgtagttcattttctaggagtagctctgccaactccactcaaaaaaagtggatttggacgtttggcacaactccggctccaggtaagttggagttgagagctagagctgtgccaaatggggccataaagctttacatccatgaatattatctctctagcacaatcgagttgttccataattctgtaccaataaattgatataaatcttaattatttatgccttcacttactgctggtttaatttgctatgtacaccaatttgctagttagaaaattgtgttctcatcattttgcagcgtacatttagcttctttcgtatttgtaatgttaggtactacttcattcctagtaccaaaatataacaggttttgagattagatataggattaggaaagttggtgaaattaaatgcaacaaggttgttattaattagttgagaaaaggaggtagtagagccaaacggaggaatgctgtgattgatggagaagatatataggtagagaaattgctacattttaagataaatttttaacattttgctttgggacaaagggagtacgtagtggcggaagattgaacaaaaaaattgacaaagttacatatcatgtatacatgcatatcggtgttacacatcatatcatatactgtgtattagaagatatattattaagtatacgatacttcctactagctagctatctcacacacatgtatatatactccctccgtcctgaaataaaccaaaaatgtaacacaacctagtgcaacaaatctgaacaaccctatttttagatttattagctagtttatgtcacatcgttacttaggttggtttatttttaaatggggagattatgctggattatattccctccgtcccaaaataaattaacttaatataggatgtgacatatttggagggagagtataaattttagttgataattgagtactgcattataggcatataaaaagctagaattttgatgcttgcaccgtgtcgtaggatgcatgcaaactacactacttggttaataattccctttgtttatgagtgattataggtctcatttgtggggcttcaccgccaacgagaaagaggcatactcaggagaaaacgatgaacgccagcagatcctacagtaagtacatacgtactaaacctgatatacataagcagttaactatatatatatatattagttaactgcttatgtatatcaggtttagtacatatgtacttactatatacctatataggatacctatatgggactttatggtgcccgggttctaaggtataaaacacacaaattctctcaaatttttaaaaaattttaaattgtgagtatatacctaggtatatgaatttgattcatacaaatacctaacaacaaaacaactcaaactcaactttatttcacaatttattattacatacctaacgaattatatgtttggatgttatacacctagaactaaaattgaacaaaaaaaaattcaaactcagttcaaagttgttagtaaagaagttaatgttcatatctaaacatttaaaaaaatttcatactcattcaaattgtgtatatactcaatttgaatcttggagcccatactccatgtagcaccagttaatttacctatatatatacacacacgtactgacatatataagcactaaactaattggagtattatatagcaagttgaaaatgcatcagtatgctcttttacttaattatttgcaggttgataatagaagagaaacaacctgagatcttggaattgcctggcggagggatacaagtgcatcaggagatagacgctgcggttgcagagctgatagaacaagaagcccttgatgaattagagcaactggtgaaagcccaaccagaagccgctgcagatcagcaaaatccagttgagccacatcaagatgaggatgacaagtgagactacttgcatgcaagcagattcattcatatatttgacattctagctagtcaactaaacgttgcaccagctcacaccacaaaattatatataacctcttggtttctactacatggtgcaggctgagtttggataatttgttggaacaacatcgttgggagggagctctgcggcggctgacgcgcatggtccgtaatggtgaagccatcaatggccctgtacctgacgcgccaccccaagacatttatgttgctcatcccgagatcgttattttgcgagtacctaagaacacccacaatggttatctatagactctctacaagagatctatgtcagcatattttcttacatggaagatattaaatgaagagagagaacaaaactatctactaacttagagataatctatagagaaaaacgaggcaatgtatgagagatatagatacccatgtagatatactattgagatgactattaatctagtctattgctaagatatacatgttttatagataacaccttactttaccattgcgggtgctctaaggctgatgcgttctggcaatactgctgctgcaatgcgctattatcatgacaaaattgagtccatttattcaggagataccggaagtgcctttgtcaacggtggtgttttgaaagaaatccgggattgggttaatgcaaagagagatactccattgtaagtgtcacttggctactagcactcgatcttttcagttgttaataatcttccatatataataattaatataattgcattacgtgtgtgttgtgctgataattgatctgtgttgttgcaggggagaagatgaagctacgacccatatggagaacacctgccatgcgatccatga

SEQ ID NO: 18249 - DNA, 2699 bp, Oryza sativa
atattcacggttatatttgttaacattgtagaatttgaatttgaccttgcttgcatgtttgtgagtgatatttttcatattaatctatctggtcaattttataaaatttttaatggctatttaagtgatatgcaagaaacgagggatgaaaatacactttctcaaatccttctcccttttcttctccatcctagcatgcatattggtatatgttagacataaatacaaggcatatatgtaaagccacatattttttattgggctctaatgcaaactagaaagaaaaaattaatactattgtccttataaattaggaatatagtattaagttttcctttattagtttgcattagagcccaataaaaacaaagtggcggagttcttggtcagatcaagcggtcacctttgctccgccgctatcattttactatcggtagttgttaataaattagtcgatcactcgaaaacacgttattaatccgtttgggctcgctccttataaatctcacagcgcgagtacgtcatctcaaaataataaaaagaaaaaaaagaaaaagaaagaaaacacacacagcgcgactgcgcgaggtccagcagggaagccggccgcgtcggcagagactccagccaacgggcgccgccgcagcctccgccagtcggcagtgggagcaggcagaagctgcagcggggggcctcgagcaggtggcggcctcaagcggaggcgagcaatctcagggaaaccaagctcgccgccgtcgtacccattcttccgtcgcagatttcgctgtgactggttccttgtgattgaatccataggaacggaacccaaatcttggaattgtttttgcagtgcaagtctaatccttgggaggaaaaaaaaaagaaagcgtaataaggttggtttcttctccatcactcccatcacctacccacctgataactcctctcctcctgccgccgctgctgccacactccaccactatcgtcgtcttcttatcacccctacctcacctgcagtcctgcaccaagcaagcaatctccaaagtgcaagctttctcttcttccggcgtctggatctcgctcaggtatgcgtccacatttgctttcttcttcctccattcccattcccccctactctcagatgcgtggataccccttcctctgatctacaggtttctcctctgcctgccactccccatggctctggattcaggtcgctcttcagcattcactaccgtattcacttcttgaaggccaatttctggttcctcaccaaaggttggttactctttctttctttcttgtcatccactccaagttgactgcctctgtaaatattctatctttccaactgttgcaatggtagcccatatttactagtattttttcccttggtaagatctagtggccaatttaacttacatcttcaaacgcctgtaatcatctatgtcaattaattatgtcaacctgtagctgttcgattctgaaaataagtgggaacggtagttgaaggtcagacctgcttcattgataattgatactgtccaaatggcgatgtgttgtcttgaactcatggtcattatctggtagggccatgcagcctcttatgaccactagtgttgcaggctcaacgagttgtagtgttcttgaccattctgttaaacattcatgccgtgtctttgtggcaacactaagaacatttgatcggctagcaagcttatatgtacgtaactctttttgattatttctttctactttactgtcatggcatgtgttatatgctgttgcagaaatgcactccttttatgtttgagggaatggtgatttgcatttgtgagtgacatgttcttatcttccccatctaggtacttgatgatccgaagatgtcatcaaactccactctgacagattctcttcatgagagaacaattgtttttggcctgaaactttgggttgtaattgggatatctgttggagcatccctacttggtgttcttctcatacttattgtatgcctcaccttacaaacttggatcaaacggtcacgtaggacattcaaggaaattccaattacccaaataccttctgcatccaaagatatcaaggaagtgagggcagtggacgaatttttgcccaatgatttcgttgtacatgatgggcttctactcgccattcagaatgaacctgttgaaccagtggataaagatgtgaatcagtttgctcaagaggacaagacgatacaaggagaagaaaacagtcctgttcctcttcattacgtggacaactatgatgtaattcaatctgtttccacatgtgaacagtcttcctcgcatgctcccgtcgactctgttctgttgccaggcttacctgagttctcttaccttggctggggtcattggttcactctcagggatctggaacttgcaaccaactgtttttcaaaggataatgtaattggtgagggtggatatggtgttgtctaccgtggcagattatcaaatggcaccccagtggctgtcaaaaaaatccttaacaatctgtgagtatttttcgttttttcttataacaattctttggtgatgcagtggcagtgcattggttagtttgttgtccttccttttacttaagctatgaccacttgccttgggcagaggacaagctgagagagaattcagagtggaagttgaagcaattggtca

SEQ ID NO: 18250 - DNA, 1688 bp, Oryza sativa
attcctgcagcccttgattgatgatgagtttaacgccaaaatatctgactttggtttggccaagatgctaggtgctggtaaaagtcatattgctactcgagttatgggtacttttgggtaagtttttcatgcctttgtataataaattgaggcatgttctctttgtattacgttcaaatcttggccactgtaatttcagaaaaattctgttggtgctaatcactaatggtactcaacattgtgttattattttgcagctatgtcgcgcctgagtatgctaacagtggacttttgaatgaaaagagtgatgtctacagttttggggtggttctgctggaagctattacaggtagagatcccattgactatgatcgccctacagatgaggtaatacttgttgattttttttctgtattgttcagtaccaagttattacataaaagcatgcaactacaatcacttgttaagcaatcaagaagctatgaacttatgatttgacaagtactgtaacacactactgatcttttgtaggtaaacctagttgactggcttaaaatgatggttgcccacagacgatctgaagaagttgttgatccaaacctggagagaagaccatcgacaaaggagctcaaacgtgcccttttgacagctctgaggtgcatcgatttgaatgctgagaagagaccaaggatggaccaggtggtccggatgttggactctaatgaacccattcctcaagaggtttgattcgtttcaaaaataaatgtgcatacatatatatcatatagctgtgtgcatatcagatgcaaaggctgtagctctaaactcttcctttacctaaagagtacgattagtgatttacctggaaatcatgcatattcgtgctatattgtgttataagtacatccaatgttcatctcacagtaaaattagtgacagatggacaacatgagcaatcctatttgattgtatcctatatacctgtcttatcagcattatcggacataaagagcattgcataacatggtattaatgtctaccataaggaaatcatggctttattctgtcattgcctcatgaattaaacacatgtcaattgatttgcaggaaagaagacaacgacagaaccacatctctaataattcagagaccgagccattaagaggcaagagcagcagcggcaagagtgatgcccctgaaaatgagatgaggccacctcggtataagaatcgatcatttccccccaagtgaaaagtgaaaagcatactagagtggaagttatggagttacctgcgatgctctcaatacataatgaattggtcaattgttttgtttctcttttattatttctcttgacttgatcaatttttttgttccctgggaggctgggggagcggccattgcagttacacatatttgtatttcttgaaacatgtacagtgctggtgtgtgatacatgtacagtagtttgtgtgtgatagatagttgaaggatgcacatgagagcataaaagctattatttagaagctagtggctggtatggttgctggtgtgagaaagtgcatgaagaaaccaatgaaataactttttcatattttctgtatactctaagagtataaagaggcaaatgaaagaaaaattgactttcagtttgtgttgtgtgcgacaaatgaacgaactgaatctct

SEQ ID NO: 18251 - DNA, 1654 bp, Oryza sativa
gtagttttgtccttagcagctcttttccaggagataattaacccattaataatctttcaggtgaatatctttctctctctccgaggtaaggacttttcttgatacatgcatgcaacaaacttcaatctgtattgttgttatacttatacatgcaattgggcgttgaagtgaatgctgttctcttcttaatgaatcaaatgtgaaaaatgatacatgtaattaattgagtaatgctgatctccaaatgattaatcagctgctaacaataacataagagattaagaggtgattaatttgatgtgttggtcgaggcactagcagagcggcaggtcgggtggaggcgcctccagcgactgcagctcgccgacgccgtcgtcgacgaggaaggccatggcgaggccccaggtgatgtgcacgtcgagatggcagtgcatcagccacacccccgggttgtccgccacgaaccgtatcaccgcccacccgttcaccggcacgcccaccgtgttcctcatcggcgggtcctccacgttgaacttgcccgtgtcggcgccggcgtcgaagttgcccaacccctcggcgaggatgtagaagtcgtagccgtggaggtggatggggtggttctcgccggcgaagatgttggtgccctggagcaccacctgcacggcggagccgtacttgagcttgtacaccttggtgcccgccaccggctgccacagcgcgcggctcacgttctgcgccgtgtagtcgaactgcaccggcgggttggccgggaagtcggcggtgaacacgccgccgggcgcgccgtggtggtgcgcctggaggatggaggtggaggaggggagcacgaaggagacgttgttgatgctcgccgcgaaccgcgtcccgttgggcccgccgcactgctgcgccgtggcgttggtgcagttgaagaggccgacgccgacggtgaagaagaggctctcgtccacgcgcgacgggagctccgccttgcggaggccgcgcaggttcgtcgtgaaggcggtggcggcggtggtgtcgttgtacgccgggagggtaggcatggcgatggcggcgctggaggcgttgttggcggcgccgtagtcgagatggcggtggtggtggtgttgtcgaaggggacgccctgggcgctggcgtaggcgcgggcggcgaggtagtagcggccgggaggttggtcgaaggtgacgaggacgtggtggtctggccgggggcgaggaggaggagggaggtggtgtacggtttggtgtaggaggcgtcggcggcgacgacggtcatgttgtgaccggcgagggagacgaagagctccgtgttgagcgcggcgttgatgaagcggaggaggttggtctcgccggaggtgacggggaagacggccgtgtcgtgggaggagcagctgtagaggtcgccgggctgggcgttgacggtgagggcgtcggagatgttgggagcagcgccggtgcgcgtggcggcgcgcaccacgtcgacggggttcatgtcccaccactcccctgtaaccaattttacacgtttcagggctcaactcctcagatttgataaaaaattttaaatttcaaacattaattttttttaaaaaaatgcttagattttcttaaaaaaatatacgtggatttgcattgaa

SEQ ID NO: 18252 - DNA, 3526 bp, Oryza sativa
gatataaactggtatggctaattgtgttatataacaaaaacttttttcttttaatatattgacgggcaattattttacacgtttgcgaaaaaaataccgtatttttaaccggagagaatatgattttactgattttaatttattgagaatcaaacatgtaatgagcctgctggtatagtgacattccttctgttaattgtaccaaactgccagagtaaacatggatttgcaacatggaaatccatggccttaattagcagtacagtagcaccaaaccattttgcttatcagacttgtagtgtatcaactattaaccattcaaccttcaactaatctttgtctttttcttgtgctcaagtgacccctgtaactaccaacatgttcttttgcttaaaaatacgaattcctcttattcaaccactaaaaatacaaaagggaatagctaaccctatacattgagccatgtcggctacaagctcacaacgacattctgaataaatggctgaattgtgcaatttttgattatgtggtttccccgaaagttctacttttgaggactgaggacgaaccttttcaaacaatgggacatatgctcctaagaacattttcttcacttttgacatgttcagactagtgtatgcatctctctacaaattgataacttttaatgcaaccttcttttgttaacaaataaaaagtatgtattgcaaccttgcattgcacattcattgagaatattttcttaattattagggagcaaaactttgagacaaacctcaaatgtactttgtaggagaaagatgatatcttagttcttaaggttcaggtacatgtaggagtataaaaatgtttgtaaaagtagctggctagctctgaggaatattgagcattgagcatgctttcagcatcaattttgcataggcagcatgtgcatgtttaagttttgcgccagaattcagattgatgagtaaagaaggatctgagaaacatgcacaatgatgaagtttttgatacataaacatgattggttagctagctttttcttgagatagatcatgtatggctctttggaaagctatgatacactgatgcttacttgtttggtaaccctgccctgactcatgcatgtgttttgactttgagctaagcagcttgtagtaagctggtaccaaccaacctaagggctagaaagctgttttttttttttctgatgaaaggaagatgtggttgataacaatgataaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaatagccgttaacatgcgtgaaaagcagctaaattatgacagcttgaccccacactatagcaatggtaccgaccgaccaatcgtggctctgagatcaatttaattccaataaattaatgtgctataactatcattagctcgcggcatgctattcctgatcatgaaaaaaaaatatagaggaagcataaaaatgcatcttctttttctttggctttataaatcttttgcatttcggccaggacataccttttgacctgtaagtgattggctgcgtgaaatttcagtgatgatggttgcacaattttttgtaggtttggtaatgtgtgtacactatccagctaggcaatagtggtgaaaaaaaaatgctctctccatttcataatactttgcaattttgagttggcatttttgtgtgtgaacatttatactttaaagataaaatcataggtattaacaaataaaccatattacttaagtactacattgcaaatgtataaacatatagatcgatatcatccataataaattcatgatcaaaatgtgttagaataaaccggtaggatttcagtgaggttaagaacatagaagcatgtgtgtgcgtgtagcggcgtgtatgcatctgctatgcgattgcaaaaagaaaaataccagaagtcaaattaactaaacaaattggcggccaaaatagtgagacagataataattaaaaagcatgtagcagaagaaacgtacgtaccgagcaggatgggggcgagctctctggtgggctggacgtcgaaggggtagctggtgccatcgcgggggcggatgaggagggcgccatagacggtggcgcggagccaggaggagtgggcgtgccaccagagggtgccctcctgcgccgccaccgtgaagcgataccggtagctctgcccgggcctcaccgggcactgcgtcacgtactccggcccgtccgaccaccccgtcctcatctgccgcaccccgtgccagtgcagcgtcatgttgtacctcccacggtttatcaggttgatgatcagcgagtccccttcgtttatctccagcgtcggccccgggaactgaccgttcaccgtcattatgttgtggctcttgcacagcctcttcactgttgtctccctgatctgcagcacagatgatgaaatggcaaccaaattaagctagctgctgcagatatatatgatgagattcagacgagctaagtaactgcatataaatgatcatgtatatatgtactgaccacaaactcatggtattgctccttggcagcagccagggagcagagcagtgccaggcttaagagccagcatgaacaccctctgcttggcatgctgcttgatagtctgaaactaactatatactgcaactcgatcggtcgatcaatcaagatgcttattgtcagcaaccaaacatatctggatagctatatgcaagcttacaagacctgagactgaattgattgcgtgcagcaatgcagcttatatctgttgcaatacagctcgccctttatataggagcagcctggccgatcgaccacatccatgagatcagagtatatatatgaaaagaaaggggctacaggtagtagactccggccggttgcatgctttcttgttggaaagaataggtaggtctttagcacttgattctctcgttaatctacatatatacatgccatcattaatttcacacttgcatttgcattcttcatttcaagctgcctcctcaatcaatccatggtccatgcgcattggctaattaattgttcaatgtacttgccaatgaattcatagttaatgtaactccttccattttaattcattctgcaagattagta

SEQ ID NO: 18253 - DNA, 7644 bp, Oryza sativa
ttagtcaatgtggtatcatgctaaccccatgcaagttcttgattttatcttctgtcctacaagtactaaagaatcagtgaaccaacacgcatcaacttcacctagtactatctataatgatcttaagattttttttcatcctatcaaacccttccttcactttcagcaagagaaaaaacaaatgtaaactaagtatttaacacgtccatttcttaagttcagttcttaaaaacggtgcttaaagctatagtctttcgatcagtatttttatgacatgcataaatatcacagagatgcatgttgcatcttgcatgtgcatgaccggccatttctataattatatggtgagccctctatatcaagaaattctgacctcaaattatactgagcttttctcccgtttcagggaatcatgaggaatgaattaacgtatcatttccagtggagccaccagtcccacaagtctccactggccaaaaaagtaactttagtttttgcctcattttgtttagaacaaaagacaacatttttttcaagtccaagaaacaaaatgttgttaacaggatgagacttttccaagtctctatggcccccatgtcaacaaaggttaagtgcttgattaacaacttctttttgacaatagaatcaatccatgaatcactcccttcctttccatcattgtctagcatatgcataactaaaactgtgattactactcgtagttagcagttacactgcgtggtctttgctctggtaggagttgttgggcttgtgctctagacatttgcattttttttagataatggattaaacatggtgtttactgctgtttgatcgcaccattccatttgctagagtccaaggaacctagctaagatgtgatgtacactaacaaaggtaacttggttatggaggtagagatcaaaagtttttagaattgtgaatttttgtttgaaggactacatgtacctatatattaatttccctgttaaagaagttctcgtgatgcagatactcttgtgagtaataagtaaataatgtatatttcaggcaaatgaattttctcttcaacataaaaagggaaaaggagctactattagttgaaattcggatctacataatgggccaaatccttgccccatcaaatgattcatttccacaactctgattggcaaaagtattggaagaagcatgcaggtgctaagctgctaactaccacatattcaattgcaaggactgttagtaggcaaacgtccaacccctttagctttatgtggtttcttctgttcaaggtaatctaaagtcaaaatgttaacactaggaacaatcttcaaaatgaaggaacatgctattggcatgagcaggatcaggatggtttccttggttggcaaaatattttaggctgaggctgatatatagcttgataccaatttggaggcatttaacaaccctggtgctccactacttgtcctttcaaaattgaaaagatgcttcacatgttggtgcatatgcactgaatgccccacaatgttctctaaattgcactctgctgtacgttacttgactgaccaggtgtattatgaatctgaacaattggctgcgctcaacatatgagagaaatctcagacaaaaaagattaatgattatgaatggttgattgaatggcacgaaggcagtggtggggagccaaaggagtgtgcagttatgcaaccaacaagcatgagtactgaccgtcactaatattctaaaccttattaaacttttagatgattatattttcataaaaagggtgcaacaaacgtttttgaaggaagatgttacagcaaaagaagcattaaaaaacattcagataacagattgtcatctttgttgcaaaaagttaggtacaatgataattaatttcagatgtcaagttttcatgacatacatcaaccaaacttgaattggaatgctaggattggttcatggagatgtatatggtagtaaatgtcatcattgtcctttaacaaatagctagacatcatggcccttaagctggaagttaacaggaatcattttcctaaaacttccatagaagtgatgcagtaccattgacactacaaaataactgcattgtcactacaaagctcttcacagttgtcattcccaagaaattactttgcatttccaaatgaatccttgtagataagttacttgagtagcgaagagtaagatggagctatgaagaataaatgctagaatagttgtagcattagtagtaggtggtgggtgttaaggagggttatggtgagaacgacggtaactaacaaggagaatatgtagagtctgtcaacatccaacattctttcttcgaaaaaattcctgtctaatgtaaaagtgatcgactccaagtcagtacaacagctatggaacaggtaaccaactgaaccgaagggtattcaggtgaggttgttttatgtaaacatatcttttctcttgagcaaacacgattccagtattgacatatgcagctacctaacacaggtgttaagctagaatgtcaaattgtttggtactagtgattaatatggtgtgcatatacccacctgccacatcacaatgtaaaagaagggataccatgttgatatgttcaagatgtagtagcatacaactgtaaagtactaggtcagtagcagattagtctctacatttttcgcggcctgtacattttatcaaaggaaacaacagagagaaaaatgcaacagattgattgatctgcatgactatatgtattgactaagttgtttaattgaactgacgaaatgtgcgtttggagtttggactaaatggtacaggctcagagttttttggcctgccgtgaataagggcagcaggcacatttcagaaagcttgattgctgtacctttagcttcttgctttgttcagaggaacatcttcactttctttttctgtttgcgtgcttctggagatattcaggctactaattaaacaaccaaacagagcatagtattttatccttttgtaggctttttatctcctttataaacagtttccccagctgtcatattctatcaataaagaacatggacttctggaagcaaaattaagggtactttcaaatttccatactgaattgctgaatgtttgcttcttatgagggagacgttgaatgctgatcgaacaatgcgttgtgtgtatctgtgatacttgttctggaaaattaattttaggagaagtgttctgaattgctgaatgttattcgcgtttcacaaagttaaattctcgtcatcagaaaaggaatactttcaggtttcaatttcccggttgagttttcagcggtggaggaagaattgataaaggtgcttataaaaattctaaccatgaattttctacatgaacgcggcgactgctctagctgtattcctttatgtaacaccgtgactgactaaaccttgtttgacatttacttctaatataatagtgaacggcagagtctgcatgttctctcgaaaaactttcacacaagagtgattttacgtgcttaaaaatgtattggaaggtattacattttctaatgtaaaatttgatacttctcagaacctccagtacagaatttgcactaaaaatattattacttatttgtatctctcaaggactgtaaaatttctcttcacatatgcggaagattctaaccataaactttatacgaaaataaaaatatatattagaaacttccaacaattgttaaaagttctaccagaatatacaactttctaccaaaaaaaattctaaattggataatttatagtgacacttttatcagggaaaaacaaactcgaagtctcgaacatgtactttgtacaagaatgaaaagaaatcttaaaatggttaaattttgttttaaatacgactaatatgttttttttaattcaatacgactaatatgttttgatggtcctagaaggctagaacaagctaaacagtcagtagaattcaataataataataaaaaaaacaattgagccaaataagtcatttggcccaagcggcattgctagcccacgaggcccaggccacgttcgagaaagaaacgcgagaatagatcgacgctgccgccgcctgagcctgctctgcagtacttctccggcagcgccggccgccggcccgggtatcaatctagggtttccgcccgccgcagccacctagctagctagttcaacgtacgatgaccatggaagatggaagctgtcctccagcagtcgcccccagtggcagccaagccgaagattacggatcatggacactgaagcagaagcttgaggatctcatcaactgtgatcctatccatggtatcatgccaaaaaatcctaaatataaagcatatttcgaggaaaagttcgaggtacgtattttcttcgatccatcatccatggatgcaaactaattaattaattaattttgacctcaccagcatatatatatttattttattgtatgcaatcgatcgatggatcaatctatcataaatattattgccattgtaggagaagttaagtacgtacgttcgtgttgtattgccgaaacttcgtccagcaattcagaaggatagcgtgaagcaattctatcaagtctataattgttggtcaggtttcatgggactgggagagtttctttaccctgatatcctcaccaacatggcctcccagaacgctctgcgttgtgccagggtcgcactccagggcacctctcctctcttgcgttgccgccgccgcgctgaccccaacacccgccaccgctacggcttcgcccccctgcacatggccgccgagaacttcagcgtcgacatggtcaagctcctcttccgctgcggcgcgtccgccaacatccgcaccaagggcgacaacgtcattgagggcctcctccctctccatgttgctgtggagaatgccagcatgcacaagtacattgaggatcattgggctcatggggaccatatcatcaacctcatcttcctcctttgtcttcctgagatggtttttcttctttattcaattcctatatatatccctctattatattactgccactgccagagcatttagcccatttcaaatacgtactactgacatgcagaaaatgttcttggacacgactagattaattgccaaacagacggacaacattgtcgacgaggtatggaattacattcagcatgaagagaagcatgtccaggcagcaattttgctgctcgctgctgaaaagcagctccgtggtcgccttaacaagagcagtggcaaagcctctctgaacgggtttgatattgttaaaagccgcattggtgatgctcttagcaccatacatcttgagggcttaaatatggttcaagagggaaagaatggcagggcactaaagagattgaaagacaaaaaggaagcccttcttacagcacttgtactagtgtgcattgttcacaaagctggtgaagctcttgacggatacattcaaactcattcacaggtaattgctgaaatttcctcattgttaccattgctttctgctacccctgtgtgttttgattttccagtttcattctctttaaatttgtgtgatgcttacttcccatgattttgatctaatagtgactcgttttcttcaaatttgtatgatgcttacttccatgattttgatctaatagtgaaacctcgaattaccctcgttttagaaagctgtggtgggctagctggcttagcttcgaagcctcacccattctaattattttatattaggtcattccctaatattcgcttttttttagaaagctgtggtgggtgttgatcgtttttctttttctttttggtgatatgtaaacagttggaggagctcctgctgcattgtatcaactagtcacatccatattataaaaaggagttaaaaagaactggacccatgcggtaaatggcatcttttagcccccatttttatgtaaatccaagaagttgaatagcaggcccagcatagcggtagtatgctgctagtttcaagtctaatgcatgagtcgaaaatatatgaaaacacaggggagtagatgcagtgttcttaaagcgaagcatggtggcccaccacctttcagatgcctatgagttcaacgcataagtcaaggtgacaccttagggcagtagtagtccaaggcacggcatgcgtgcctccatcccattccagcgaggattttggcccaaattttatctctaggtcacgcacctcacagtgctcggtaccccacaatactagtgcgccgtgtcttatcctcacgccccaaaaaatcagccttcatccagactcatccccgcccgccgcttttctcctcctccctcgtcacgcccgacgccgtctctcctcctcctcggctctcccctccttcctccgccggcgtcctctcctcctccctccaccggcgtcctcccctactccctcgaccggcctcctcccctcctccctccaccggattcacgagataaactctcgctggattcgataggtgctcagagagagagagagagagagagagagagagagagagagagattcgaatcccccacggtggtcgccaaagatgaagccgccgccgccgccgcggaggtggttctccctcgccggcgaattgagcctccccaacgatggagcggcaagctcagcaacacgggggctcgtgagcggcggcgctgagcaaggttgtagctagaggccagccgtcgagcttggagcggccccatccgtctccacccaagcccctgccgcctccgcctccgtcgtacgagcaggcggtggggttgtcgaggatcgcgaggagcgaggtggggtcgtcgaggagggcgaggagcaggcgaatcaagcaacgactccaacagcgcagatttccttcgccgcgtgccctcgttgcggcgagaaaacgtgcatcccagataggggccaagcggctgagctagggtgcgggcctcgtcgccacgtcgacctgaatccgagctggagcaacgagatcacgcgccaggtcggtgcactgtgaagggccttacatctaaatctatacaaatgctgccaacttttgtattacacacgtgcttaccaattattgagcccatgtaccattcattcatcctttctaaagaagatttaagaggagggaagagggtcctctttgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaacgcgataacatgctagaggcatcatgtagaacaggaacaagaacatagcgcacacagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcaccagctccggatccagctcctgtcggcggcggcgcaccagctcctgtcggcggcggcgcaccacctccgccggtagcggcggcagcaactccagacatggcgatg

SEQ ID NO: 18254 - DNA, 1954 bp, Oryza sativa
actatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccattcaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttttgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatctagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatcttagttgatcccttgctattcttcggtttttccttaatagcatactgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttaatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaagaaatcctcgctttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcat

SEQ ID NO: 18255 - DNA, 307 bp, Oryza sativa
caattctttgccaaatccacttcgattccattgccgaacctggttcatagtttaccaaatttggtcgtaacaattacacaatcaaatattcaacaagtttacatctctaaattgttgaatgaaacaatcattgaatcatcgaatcaaacaatcaaacatcactggaatcattgaatcaaacaatcaaacgctcaccgtcgttgtggggagcctgtcgccatcgttgccgctgcctaccccccggcggtggcggagcccttcccgccgcccgtgcctcccctcccaccggatctggcggaggggaggc

SEQ ID NO: 18256 - DNA, 429 bp, Oryza sativa
aaagatatctttattgttctgaagaaaggtgatgagcgcgctttcctatttacaatctaactcggcgcctattacaacagtcttagtgggatcagatggtcttggcatctaggggaatctttttagtcttggcttcgctttctccactttttgacatcttggtagcaggcacttctccttcgctcgccgtggatgtagccagtcagatatcctctcgggcgagcgtaatctcgcgggtctgggccatctcgcaacttttcttgccgcaagtgacggcttgcttgatgtcgctccgtagggatatgactccacggggacctggcatcttcatcatcatgtaagtgtagtgcgggacgggcataaacttggctaacgtcgggcgtccgagtatagcaatgtacgctgtctcgaaatcagcgacttcaaagc

SEQ ID NO: 18257 - DNA, 3364 bp, Oryza sativa
ccaagaacttttttaaagcagtagcaccaagggttggttcttgtctcaacttgttgatcacacgatctctcacccatgaattggtggccatgcaattgttctccaaaccagctgtgctagcacaattatgtgcgtaaggaagcttctttatctgaaatgaaatagcaaaaatgttataaatggcagaaaacacaatgaatagacaaatcagtgaacatcaattatgtaggcctacttacttgccaagttctcccatccggtagtctagaagcatgtatcctccacttgcaccgcttagccttacagtatgccctatacctccttgattcgctatatggcactgcaagttcaacctcttttagtactgcatattgtctaatgcaccttttaaagcaattgccatcttcaaaagttacaccaacggctatcttaggattgtctacatcagttacatgagccactgactcacaaccctcctcatcgtcaacggctaaatcgtcttgatcttcgtcagaaccagggtcatagtctgcgtcaactgcctcatcatctgaaaccaagtcgttgtatttctctttctcatcatctacaccaacatactcaacctcatcactctcaccccaatcatcaaccttttccttaggcttcgtaggtttgctaggtttgctacgtttagatgcaatgacttggctctcttgagtggctaatacaatgtcagtacaagcaacttgtccatctcctgcaacagtactagccggcccatcaatgctgccttgatccatacaaggctcggtcctatttcgtgggtcatcactcacattaacaagcaaagggagcctcctcatctcccagtacatatcaaatgcatcaagcaatgaactatccgaagctatctctgcatacctctcaacatttttgtcccaataggttacagttatctcctgaagataactatgttttacctccccatcaagatcattaataaggtcaatccaacaaattgtatccttgtctattacccacttaatatcacgagagacatgataatccggtctaccgttctcatcaaactcaacgtatggaccaactcgaacatcaactctgcaagctgcgctagcgtccatcctacgcgacaaaaacgcagcaataaaatcaccaaatttcaatcactttaaattgcaacaaaaactctacaactcgcaacacatatcactgcaaacaattccactcataatgcgaggcaaaaaggaatcaagcttacccttgaggaacccaagacatgtccaatgccttcaatggaacctcactgctcgtcagccgcagggacgatttcttcccagcacacttcttccttggcgacatcttcctagctgccgctcggccgcctaccaatatgacagctccatcggcctccgccggcgccgccaccggcggccccgccaccaccgccgccggcgtcgttgccgccgccgccgtcgcctacggttaggtttgggaatggggaatcgggctgtggagggaggggggatggaaacagcgccggctaggtctggttcgaccagacccagtcaggcttagaggtagcggcgcgcaggggtagattggtcatttagaaaattttctgaccacttttgcctcggaaattataaaatattgcctccggtgtctcacagccaatttcacaactttcgtagtgtccgtgggcaaagccaagattttgcggtgtcccacagccaattacacgattttggagtgtcctgtagcaaattttgcctaattatttataccaatcggaaccaaagattaaaaaaaagcagctgcacacgcctcctcggcaaccgcgcgcctactcgttcttatcccttcttattctttttcacaaacgccttatcccttcgtcctctcttcctccactcatcctcttcactcctttcccgatcccctctcctcctctcaatcccctccccttacctattggtggcaggaggtggcaggcggcggtcgggcgggtggaggggaggacggtggcaggcggcggcccggaggggttgtcgcggcactgacgagcgggctgatgcagcgctgaagacgacgatgtgaggacttgtttttgtgatgtcgttgtagatgtgtggtgctgctgtgaatgattaattttgtgaagtatgtgaatttgtgatatcaatgatctgtgaatttgtgttgtcattttgatctgtgatgtttatttgatctgtgaatttgtgatgttggtgagttgggctgtgaatttgtgatattggtgagtttggcgtgaaaacaataaattagagggtaacctttaattccgcaaaaaatttgggtttttgggtataccaacaattcacccccctggttggcttagttcttgtgattcgatcctacaaacatttttgttctctctgaattagtctgaacagttttgaactcgtccatttatctgaagcttgaacggttctgaaatctattgctccaaagtgttacctggaactaggcaaatttgaacagattggccagaaagaagctctccactgcagctcaccaccatcttcctcagcatgttgtcactgtaaactgcaacgaggaaggcagaggccaccaagtgctgtagtgagttccactcaactacatacagcaaactccctaaaataaattgctgcaagccatgtgaattattactgcattgcttccttcaatcaatttctagctaccttagctataaaaaaaatattcgcagtgttgtgaacttaccttctgaaagcggtggtccctaagtccggcaggatcgaggagtatgtgcaggactgtaggaacgaatcacaagaactaagccaaccagagggggtgattgattagtatacccaaaaaccgaaaacttttagcgaaaataaaagttaccctcaatttcgatgaaatcggtctaaccgaagtagattagccggtctgaccaaagcgtaaccgccggtctgaccggtgttgacctgccggtctaaccgccgagatcgcctgccgctcgctgtcgctgccaccggtctgaccgccgtgctcccgccggtctgaccgccacaatgctgccggtctgaccgccggtgagttgccggttagaccgccgaaacctggtgaaacacaaatcgaagaattcttaaagtagatgacgactttattgattctctccgtgtttacaaagtgcaccaaatgcactccttacaaaaatttcgactaaactcgaaaccctaactcaaaactcaactcaattgctctctaaagcgataccgggaagcctcacgctcccccttttatacatgaggtaggcagcctaaagccacgaaccaaactcatactaaga

SEQ ID NO: 18258 - DNA, 13123 bp, Oryza sativa
  unsure (1)..(13123): unsure at all n locations
aatcatttttttgttttataggttcaatgttttgttccccttttcgtgagctgaaaatatttcttgagaatacttatgaatgcccatctaatatgaaatttttggacataatgtaggggatagctttagcagcatccagtactagctcatgtgcaaaattgctatggataaatgttatgatgtgatgtttttatcaagctaaagcactacatttctttgcaacgcaagttctattgaagagatcggtttgtacatatgtcagaccaccttctaattgcgctttataaccacttagtttccctaatataatccactgtacgcatgcgccacttttctgtggttgctatttttgctcaagtgtacatgatcatatagatagcactccaaacaaaccgatcaaaacaactcatatttgaactttggtggtatggttcgaatgtaatgttggctatatctaccttctgttgcttttattatgacaaaccttctaatgtcagcaccggcacacgcagcgtagcgcgtggctctttctagtagatagtatagcgaaagtagtaagcacctcctgcttcatatagaggttatattgaatggttggcatgcatataactctgctcactctttggcaactggctagaatacgtgcaaaacttcagccaccggataatggtgcagactcatctgcttgtaatgaattgaatcacctgcagctggcatctggtgaatgatatgacatctggattttggaggcaccgtggcacatgtatggtgattggaggcacacatgcatgataaatcatgatgtgcagactctagagatgaaatcatataagctcgtagaagagaattaattaaggatattaaattccatgactctacatctaagtaactggtgaaagttgggggaaaaacgtacggctgttattactactatttagatcaattagaggaaagcaatcggacgaaagcatcaggtattaagttgaaatcgaatggcttgatgaggcaggttagtgtagtgccatgcatttgaatggacttaattagtgaggccattgatttgagagaagatgatgcgtcctcgctgcatgctgcagccagaggcacctctaacaaagagacgaatggtctcttgcactctcagctcacagtcagctgggcctacctgagaaatgggcctccaaggtgcatcagcagagatcatgctgcttagtatctaatccaacgcttagtagtagctgatatgaattgattcaacggcttcaattagctggtgacgtggaggcatgagatagcagctttgggtcttaactttaatgaaagaagggatacgcgtgtgggggcagcttggacttgaggcttacacgcatgagtgagaaaattgatattgtgtcatcgtcaaaagtgggttttgtccaaatgccactccgcaaaatagattcgataaaataccactatcgacacatggttacacggttacacgctacaatactactccctccttctaaaagtctaagtcctatttatttttcaccaagatcaaggtgcagttaactcattcatcatgtgataaaaccaatgaacatgcaaccaataagtactgaatgacttcttgggttccgataaaaaatttaatatagcacatagtgactgcaaataggacttagacttttgaaaaaaccaaagaatgaaataggatttagacttttagaaggagggagtatctcggaccaaattaccctactctcatcttcttcctccctccatcaccatcagctctcgccggcagccatcatcagctctctccattggcaccaccgccttcaaaacgctaaccctagcttgttgccttcgcgcgagctctcctccatagagaaccccaggccacaggcccctgcggggacccctcccatggctcccctccccgtgcccccaccccggccattgctgccgtcgcctccacctccgcggcggcaggaggtgggggcggcggtgaggctaactacgaggtttccgatgactaccgcgccaagtgggagcgccacgagcgcgctgtgtaggagctgctccagcgctgccgcgccttcaccatggccgtgcgcaccaacgactccgccgtgcgggcgcgcctccaccgcctggaaaaacgggagcggctgggacgacaggttggcacgaaagatggagactgccaacgtcggtgttggcggcgcggatggcgtggagcgcaaccacggggtcatcgggtgggggcggggaggaaggggagcgcaggtggaggccgatgaggcgagcacggcagaggcgagctggcggggcatccgtcctcatgtccttgtcagaggtggaagaaggtagcagcaagaggggcatttttgtccgttcagatattatagcgtgtagtcttcgattgaaagtgacatcctatcttactataaagttataacccacttactcctaaagtttaatatgcaaagatgccatatcatcatctactaacaagttgacaaatcatcatctactaataatcaatacatttaatatcatgcaaacatgctatattatctataatttaaaatttattatattttagagcttttaaaatgaaagcatgttaaatcatcatcccacataattcacataatatttcaatatatatcttcattattttttaaattttaaatatcttatgtacctatgtaagttcatcctcacttggttaatgttatttctctcttatctaattaagccatatcacatcaattgattttagtgcatatgtaagtttacgttgtttagctatcttacacattatttttacttattgttatcatactgaagtcccacagcaacgcacgagattttacctagttttaatgaagcccactcccagtttggcatttgagcaaaacccgttttcgaagatggcagaatatcaattttctccgcatgagcagatccaaggcccgatgaccctggacagccactactgcttacacgtcgaaaatattttatacatgtatttgcctaggttccaaaagatttcaaaatcgatctgctatactgcttacacgtcgaaggaaatttcaatggaaaaattctaaattgtacgtactttgaattttattagaacttttaaaactatatggtccagccattacgtacgtactcttggtaaaaatgtttgcctgtgctgctgattctttccattttccgttggtgagggggcgagggggaagagaggaagttttcttggaatggagattatgggcaacgagtttggttgtaaatgggccgatctttaatggctctcatggtccatatacactgtgacttcggttatatgggggtgtttaggttaggggtgtaaagttttggtgcgtcacatcggatattatttatggtgtcgggcactaataaaaaaattaattacagaatccgttagtaaactgcgagacgaatttattaagcctaattaattcgtcattagcaaatgtttactgtagcaccacatgctaaatcttggagcaattaggtttaaaagattcgtctcgtaaattagtcacaatatgtataattagtttttttagcatatatttaatactttatacgtttgttcaaatgttcgatgtgacatggtgtaatttttttacagggatctaaacaggccctaagacatttttggttttgaataaattcatgcataaatccgtgcatatgttttacatatgtatccaaattaataaggatattagtgatgctagacaaataatggagatgccaaaacgtgtggaacgaaaagagtaacaattagtgcggtggaggagctatggatgtccgacgttatccactaggatttaaatcttgtcatatatggttatatgcatcttttaattgatatatagtcatatagccttgctaaacaaaaaaaatataaactcgttcaccatgctttaaataaacttaatagagccatccacattgaaggtgtcctactgtccttacgacgttcacaatgcacacgatgttttattatagatgaagaaaataatgtttcattcatccactttaaaccaagatgaaatcatatctttctatatagttcgtatccactacgggcatttactcctataagacaagacatgcaaaaacctacattatcaacaaatttaaactattagatcatattagtacaaagataataatcgttggaccaagaagctacttattcatcctattcaattatttatgagttatccattcacctccatttgctccacctcacagtcacatatagcactgttatatattttgtgcataacaccatgtgttccaaatacaactcaaattagcgttcaatatgtgtgttttattttataatgcatgataagatggcttataattattagatatcgttacctgaatctattttcagaaaaaaagttgagtgaagtagagagatacaaattatctaactataacgatacacatattgtatatgaaaatattattcatatattataataatacacaatgacgcttggacaaagaaaacataaattgtattgtaataacataaggcatatataaatctacattatcgtatattttatatatacatagagttacacctaactatttaaaactagagttaagtccgatttacccccctaaactcgtacgaaagtacgctttacccccctaaactatgataccagatataatacccccttgaactattcaatagggacacttaaccccccctcgcgactaatttcggctggttttacccctttcgtctgacgtggaacacccatgtggtaaatgatgtggcagttacataaaaatatctctccccctctctctctccctctccctcgtgaaaaattccccacccaaacccctaaccctagcggcgcaggtggagctgggcggcgcggcggcgtggtgaagggtgacgcaggcgaggcggtgcagcacgagcggcggggtgctgcgcaggcacgacgctcgcatgacggcacgagacacgggcggcggtgtggcacaagcacaacggcgaggcacacgtgcacaagcgcagcggcaagacacacgcagtggcgaggcaagaagaactcctcaaaagtgaagacaaggatatgtttactggttgaaaatgttgactgaagcatatgttcccttgtgctttccaaatagcctcttgatcctcttgattgatttatactaactgcgcacacactttattgcacaaaacatgactatcacaaattgagaaacatgctggttcagatagccttcatgacatatatcggtactgattacatgcagtgattacatgctagcacactacatatacaggaagatcacagcttaacatacaaccccagaattacaaatacacatgctactaatgcatacagaagcacacatcttcccttctccgatatattatttttagcaactagattagtatttccagcatccttttgcttccctcattgcttccatctgttccttgtgcagttgtgcctagcaacattggcctccagctgcacctttgctgctttgcatcagtgacatgcttgagctctgtggcatacctgtgcgccgtcccgtgctcgcgccttgctgccgtgcgagcgttgcgctgctgcgcgtgtgcctcgccgctgcgcttgtgcgcgtgtcggcgtgtgcctcgccgccgcgcgtgtctcgctccgccgtgcgagcgtcgtgcctgcgcagcgccgcaccgctcgcgccgcacagcctcgcttacgtcgtccttcaccacgccccagcgccgccctcttcaccacgccgccgtgccgcccagctccacctgcgccgctagggttaggggtttgggtgaggaatttttcacgggggagagggagagagtagaatttagactatttaaggatatttttatgtaactgccacatcatttgccacatggatgtgccacatcggataaaggaggtaaaaccagctgaaattggtcgcggggggttaagtgtccggattgaatagttgaagggggtattatgtctggtatcatagtttagaggggtaaagcgtactttcgcaagagtttagggggtaaaacggacttaacccttaaaactatgattttgtttaaacataaagctacaaaacccaaggcaaagatgcggggtgccaactggttaagaattaagaaaccgcctagtcgcggcccatggaggaataggatgttaagtctattttaccaagtcatgcatagaaatcacatgaaattaagaactataagaagccaggttcctcatttgctctcccagtcccatttctatttactacgtaacatcaagcaacgcaaaaacagctttcacaacacatttttcccctgaatttcaaagtgaaaaagggatatacaaactctgctgcagtataggctgtaatctgaactcacatgaaaacagaggatatataaaatttatttctcagaaaataaagtagaagtttagtttaagccaaaattagaagtttgattgaaattggaacgatgtgatggaaaagttggaaatttatgtgtaggaaagttttatatgatgaaaaagttagaagtttgaaaaaaaagtttagaactaaactcagccttacaaatactgtttgccacgattaacggtgttgcatttgaaaagtaacgattggttcatattgacaactgagacatcatctgcttgacaggacaaataccagcaaaaatatttgtacatagcattcgaaactaaaatcttgtgccaaggcatcgtcaacagcatcccattctctcccatagtgtgaaatctgaacctgcaaggacaagctatagattttatatactaaggctgagtttagttccaaattttttcttcaaactttaaatttttctatcacatcaaaactttcctacacacacaaacttccaacttttccgtcacatcgttctaatttcaaccaaactttcaattttggcgtgaactaaacacaccctaagcaaattaaggttttgacaaaagaaaaaagaaactttgagatagtttactccatgcagtaacaaacgagagtgttgttgctttgctcatgccaaattggtgctcatgttggagcagaaagtaatgcaaccttgaaaaaaaatattgagatcttttatgctgtaaaaggtcaaaaggttctttttgggtcttttatgctgtgaagtgtaaacccaaataaatcagtttttggtttcttcagcaaagctcaagcctccacatgcaatggtgactggtgaaatggtgaggtgacatgcatcgctaaccatggccctcaacttacactgcacttcaaatggtacccctgcatatacagtaaacaacacagttatatttccatgagaaaaaacatcaggatagcaaacctgtgtcacaatccagatgatgctgcggattgtctgtgacagcacgacctacatttgaccaccctctgcataaaccgctcaaaaacagccctgaagacagcacatgtttagcactagttgacatatatcgagcacagatgtccgaagaaggatatcataatatatgggaactagaagtccactactattacataagagcagagttataaccattaaaagatcgatcatggagacaattatatcaacgacttggacaggcagtctgcacccttagctgcgacacacatcgctcgagcggctgcacgggctctgtccaagctggaagacgacactgtagctcggggatataaactatactttttcctggacttccatttccttgcttgggccggctgagacagagggacaacaaacagacttgcgcagagaaaaggggaaaggctgctggtttggctgggctgagggagagagttgggccagattaagcccaagaatttggaaaggattttaattacttcttcaattaaattaataactgaaatgatctttgaattgttgaaaatacttccaaagctcaaataattccaagaaaaatcttgcaactacgtggacactcaaagtatttttaaaaattaagatcatatcatttaatgactaatttaaaatttaattaattgttgaaatgtttttgttattattaaaattaggagttgagctctgaaaaatccgagaaaattccagagagtataattaatcatgaagaatttaataaaaattaaatccagccatgctttatatttaggaaattttatttcccacatttaaattcacttgtaaattaatgaacatttaatataaattataataataatttttttaaataatttataaatcctgaaacgaaaatcagatgcgacaacacaatggaacaaatacattatagtggcacaactacataatccagatccctcccaatcccagctcgcgtcatatctacaagcccttctcatgcatgcaaatatttctacattataaagttcaatatgttttaacattgattattagacaaataaaacaaaaacaaattgcaagacacataaacaaaatccttttatccaacttagaaatggttctataaatacatatcacttgcattacactactagaaaatgcattttttccaacgtagaggtctgattttcgtaggcggatataacccttgaagccaaatgaccgcctacaaaaatataaatcggggtgaagttcgctgtagattttcgcaggcggactacttaagcgacgcctgcgaaaatcagttttgcaagcgaaccactcaaaccgcgcctgcgaaaatgctacctaccccaaaaatttctaagtcttatcttctcctccacccctccccaccactcatttccctcactcagctctctctctctctccctcaaacacttacccctcctctcccctccccttccctcaacgcgcgtctgggcgccgtctccccctcccctccctccatctaccggcggcggcagcggcgcgggccggcggtgatgacgacggcggctcccctccccctccctcccagatctggccggaggaggaaggggggaggccggcaggggcggcggcgacggcgcacgtggggcggcggcgacgacgacggctcggcggcggctcccctccccctcccttccagatctggctggaggagggaggggggaggccggcaggggcggcggcgacgacgacggcggcgcggggcggcgacgacgacggctcggcggcggtggctctcctccccccttcctcccagatccggccggaggtgggaggggggaggccggcaggggcggcagcggcggctcccctccccccttccttccagatcttgccggaggagggaggggggagggcggcgggggaggcggcggcgacgacgacggcacggggcggcggcgacgacgatgacgcccggcgcggctccggtagggggagggcggcggcggcggcgcccgcgatttttttttttgctttttcattgcattttcgcaggcgggccattgcctcgactgcgaaaatcttcgcagtcgttgggctgcaggcggtcctcccctccgcctgaaaaagtcacttttggccgcctgcaaaaatactttttctagtagtgttagttccttgtcgaaacaagatttcggcaatactaaaagggggtggctatcaagcggaaaagtggatgggtttagagacaaggaattttatacaggttcaggccttcttaatcaagaagtaataccctactcctgtccggggattgatccgtcgagtgtatttttgatcgtatgatctgggaagaaaatcgtacctcaagaggcacccggacccctccttatataggggaaggggtccgtattacaaagtatagcccatatccctaacggaataggtagttacagataaaatacaatcgtaaccaactaggatcccggatatttccttgacatacaagtttggaatttaacccgagtccctttaaagatattctatctatatatggcaccccatacccagtcggatatacataccgtgtaggtatggggtatccataatctccacagtagcccctgagacttttacagtcgacgaaattgtcttctctcgtagtgcaaaatgataatccgagtgcttgaacttcttctgccttgatctcccgagtaccaaaatcaaagactgtgaagagctgaaaataaaaaatcgggtgcatcgactagatgcacctaattaggtgtagccccagactatgtgattagttaaaaactaaacatatagtcaaggtgcaaataacatccaaccgagtggtcttataactaaatcatccaaagtatcatacagctaagcatatgggacgtttagtaaaacattcagccgactgctttaactttattataccaaaaattgagatataaagaggcccgagtaaaaaatactctaaaggtccataaatcaacacatatgacaagaatccgagtaaaaactctcaaaaagatccatcaaatgtggtataaatcatgacaatcgatgagtctaaatagcctaggctatgactcacgccataatcaaaataagcatataacatgccgagagaatgactgttcaaaaaccagtcatctcaacaaaacccgaacagcttttgtagcctaaaaagacttacaaaattagtataacacttttccatcgggcacctttttatttgcatcatagtaattccaaaaaattatctaactgcgtccaaaaggattttagcagcattgggctaccctgttgcgagcaagtattgctgaagcaaaatgcctaagtccctaaggatcacaacttagccacgctgatagaaagaagtgggctgaagtaatgtttcgggcctaggcccattagtactcccgataccctaataataccaaaagccaaacatcgcgtcgtcttccccgccgagactctcgccactttccccattcccagctacagtgcgaaaccacaccggcgaagctagggttcgccgattcactccaatccgtcctccaaaactccacagaaatcttccacacaacctccgcatcaatctcccatccattcccacccacattctggaccaaatcataccatccagttcgcatccatggcggaagagagagaaagctttgaaagccagtgggtgtcctccgatgtaatggaggagaacttgaaggagatggtggcgcacggcgtccttccggcaaaagagatcatcaggtggcgtctagcatatggtgaaatgttcccggcccctgacacacacgaggtggtggtattctcccatttcttttatggcgggttttctcttccgacctcaagtttcttccgaggaattttggatttctatgggatcagcttgcatcacctaaaccccaattccatagtccatattgccaatttcatccatgcttgcgaagcttttatggggattaggccgcatttcgctttattccgccacatcttcttcctcaagccccagccaaacaaaaacaaaccatgcatagttgggggagccggatttcaactgagggggaccttgagccaaaaatacttctccatgccattcaagacctcgaacaaaggttggcgcgcaaactggttctatgtgcaaaaccccgagccagcgcttcccggatactcctgtcttccccagtctatcgcgatacctggaactcactgccaatgggagaagaggccgcccaagcgctcgacttgttggatcgcatgctaaagctgaaagaacaaggtctgcagggggaacaaatcacccggcacttcatcaagacccggctggcatcaatcaaggaaagatccagaacagccttcgagtttgacggcaagcatgaccccaaccgagagaacccagaatctgttgagttcaaaattatgcaggagaggatgtacaaaatcttctcgaatgctatcgtggtcagctattcacatttattgccagttgtgccatacaatgccttcaaccctcctccaccggtatgtattatacaactcagtttctctcaaagcatgcttttatcttccataaagtcgactgagaacctggaataccatgcacaggaattcgctttgatgaagtccgatcctccaatcgctcaacgctgctcacctcgccgacacactggccaagctagtggagggccaaagattcagtcggacgtccaacccaacgcctcaagatcgactaaccaatccgattcttgtaagaggaagctggtttcaagtgacgatgaaggtgatgatgcggaaaagacgggcaacaaaggggtgactggaaaacaaccaaagccaaccaatccgaagaagaaaatatccagtcgtcccataccaaaaatcaggaagtcatctaggtatgtattctctggcaatttcccctattttactatttactcacaattgaaacagagctgatagcgtgtctaaaatttgtagaaaaccatctgacatagatccctctggaaaagatcccactccgactggcacagagactggtccttcggtagaaactggaccgactgccaaaaaccacccgggtaataatcaaccggcaaccggcaatgtagataccagcaacgagcccccgactggaaaccagtcggctgaagctaaagccaatgctgatcaggagccctcgactggaagtcaatcgggtacagaacagaatcgagacatcccagaaatagaagctcaagccaacagccctcccaagacggacactggtgctggccctggaacgagttctcctattagggtgcaaggacctgctcgtccccgaccggaagttatcacaggtaaataagtcctccaaatctgctttgatccgacaacctttatccaattacttcaccattattcatgaatatacaaggaccaatgattggtgatgaagaggaggtcctctggatacgatcggctgaagattctcgcccaccaatattagtcaagtggtgggacgatgaaatgcgtccacaaggaattgtnataaataagtagagggaagacgaggaagtatgtctactgaagaagacactcggccaagctactcgtcttgtaaacgtaagtctacacttacatagccttaatcatcctgtcggtcaccttacttgaacaagg

SEQ ID NO: 18259 - DNA, 582 bp, Oryza sativa
ttcctcccagatccggccgaaggtggaaggggggaggccggcagggccgacagcggcggctcccctccccccttcctcccagatcttgccgaagaaggaaggggggagggcgtcggggaaggcgccggcgactacgacggcacggggcggcggcgacgacgatgacgcccggcgcggctccggtagggggaggccgacggcgacggcgcccgcgatttttttttttgctttttcattgcattttcgcaggcgggccattgcctcgactgcgaaaatcttcgcagtcgttgggctgcaggcggtcctcccctccgcctgaaaaagtcacttttggccgcctgcaaaaatactttttctagtagtgttagttccttgtcgaaacaagatttcggcaatactaaaagggggtggctatcaagcggaaaagtggatgggtttagagacaaggaattttatacaggttcaggccttcttaatcaagaagtaataccctactcctgtccggggattgatccgtcgagtgtatttttgatcgtatgatctgggaagaaaatcgtacctcaagaggcacccggacccctc

SEQ ID NO: 18260 - DNA, 554 bp, Oryza sativa
acggctggcctattatgccgccgctgttgggcgtcaacgacttcaccgccggcctgtctccgtagccgccgattggtgcctccgcctacacgactggcctattatgccgccgctgttgggagtctacgacttcaccgccggcctgcctccgtcgccgccgattggtgcctccgcctacacggctggcctattatgccgccgctgttgggcgtctacgacttcaccgccggcctgcctccgtcgccggcgactggtgtcctcgcctacacggctggcctattatgccgtcgctgttgggcgtctacgacttcaccgccggcctgcctccgtcgccgacgagtggtgcctccgactacacggctggcctattatgccgccgctgttgggcgtctacgacttcaccaccggcctgccttcgtcgccgacgagtggtgcctccgcctacacggctggcctattatgccgccgctgttgggcgtatacgacttcaccgccggcctgactccgtcgccgccgagtggtgcctcccgctacacggctggcctattatgccg

SEQ ID NO: 18261 - DNA, 10732 bp, Oryza sativa
  unsure (1)..(10732): unsure at all n locations
cgctcttgtgcttggcgctcctcctccagtcggcgtcgttcggcttcttgtcgcacgcgttgttcttctgcttttcgggcttgacactgctctttcgtctcattgttggccatgaaaatgccgaaggagaggggtgtgtagttgtcttcaaagccttcgtcgaagtcgtcgtactccacgatctccgctggtcatgagtcgacaccgggggagctgaggtagccgtccagttgttccgttgaaaccgtgccgagaggctggagtatgacgccgacttccctgaagctagactggatcagggccggagccggatctcgcctagacctacggggagaagacgcccttgtggtgaagacggcaaccaaatcattggggagtttcatcaggattggcggataggctccatcgtcttgatcagatcgcgttggagtagattggatctcgtccgagtggttttgggccgactcggatgaaatgatcttggagtagatctcggccgagttccggataccgaacgggatggagacctggccttttccgactggttcgaacccagtcgaggagagaaatcttgcccaagtcgtggtgatgaaatccaggctgccgaatcaaaacgcctgcccggtgggaagacgaaatcgtcgatgccggagacgaaacccatcgcactactcggtgaaaaaactgacgctacccctacctggcgcgccaactgtcgaaacatgatttcggcaatactaaaagggggtggctatcaagctagaaaagcggatgggtttagagaaagaatcatatacaggtttaggccttcttaacaagaagtaataccctactcctgtccggggattgccccgccaagtgtattattgatcgtatgacctgggagaaaaatcgtgccccaatagacacccgtaccctccttatataggggaaggggtccgtattacaaggtacagcccatattcctaacggaataggtagttacagataagatacaattgtatccgactaggatcctgggtattttcttgacatacaagtttagaatttaacctaaattcctttaaagatattctatttatacatggcaccccatacccagtcggatatacatgccgtgtaggtatagggtatccataatctccacaccgttgtgcatctattttcatatcattctctactacagccacgtatcttttcttccctcaaaaaaccatctcttttcttttgatgagttctctgccgtattatttaatttttaagatggggagaaaagttttacgaggtttctttgttttctttaataatggttaacagggtttctttacgtgagacggttacagaggtgaaaagttgcatcttccaaagggcaggtagttaactctataatgccgttttggagcgataatcttcgttcgttcgttcgggtcttccataattaaataggcgacttgatcttctctagctcgtattatgaaacacttacttgtgaaaggaattaaggaaagaatggcttgctctgactgtatggaacatacacatagccggtggctgaagaaattacgaaacactactacaaaacatcaaataggtatcgccactgcagtgccgatagtgctaaaaccggcacctataagccttttccttcctccacgggttaaaatggcaaaaaattggcaccttttagtaattataggtgtcggttttaaataaaaacaggcacctattatattttgtgtcgttttttttaaaaaaaggcacctataatatattataggtgtcggttagttgaaaaccgacacctataaaatattataggtgccgatttttaaaacaaaaccgacacccatataacacgagccgagccggtgggccccaccatgaggaggcgacacgagaggagataaggtttctctctcgctcccttctctagttctctctcgctctcttctctccctcccttgtctcgctctcttctctctccttcccttctctgctcgccggcggaggcggcagcggcgaccgcgccctcccctcccccaaatctagtgggaggagaggcggtggcggcggcaggaggggaggcgtcatcggcgggcggggtggttggttccggcgtcggcggcgggcgagggggggcggatccggccgggagggttgtcggcgatggctcggcggcggcgggaggggcggcagcagatccgacgatggcgtggctcacgggcggtggcgacctcctctccgccagatctggcaggaggggaggcagcggcggcggtggagccctcccctacgccagatccggcggggggtaggcagcggcaacgacagcggcaagctccccacgggcaacggtgagcacccgagtcccccaaccatctcctttgcttgcgatgatgtttgatgtgagatgaatgttgattcaacgatgtttgatatgagatgaatgttgccaaatttttttctgagatgaatgttgcttgattcaattgtttgattcaatgatttatttgtgagatgaatgtttgattcaaatattttgccaatttttttcgcggatgtgggaggagggactgctcagctcgatgcgccggctccatcgagccgacttttttttttcattcatcggacctaaaaggtgccggttctaatgaaccaatacttttttattttcaatcagtgccgcctcccttgtgccggttgggaaaaccggtatagaagggggtttctcaaccggcacagaataccttttctgtagtagtgaaaggtggtttatatgggtcatagaaggtggcttccgctatgtcacgtaagtaaaagagaattttagcatgctcccaaagattgatgtgtagtagatgaggttcacgacttggtcaaggtcttccaacgccgctcggagagagagatgaaggacactagctagacgcggttcccgcggtgtgacgccacgcgcttggaaatgtcaatgagtgattaagctattttgttttcatttctgatacttatgttttgttttatttcagatatttatttatcgttcaagtaacagttattacttcgtagactgagaccaatacaccgtaaaattttatctccgaatatggatttgtatgtgttttagtttccattcgtaatttaaaagtaatccacacttccacagaactatctacatatacaggaagaaattggtcgatagttcaatcaccgagcatttcaacgtgaagctctacgcgtgtaagaatatgtgtttggaaccccaacccttttccatcgtattccgcacgcacgtttaaaatcatattgatccacacgctgtgtatggaatcatctaggctgtgtttggaatcatctcttcccaacatgcacagtacccaaaaaaaatagagcggtctattagcacatgatttattagcacatgatttaagtattagcttttttttaaaaaaaaaatgaatcaggtatagttctgggcctcagggagatgaaaacagaacagatacgcatgcatatatacgtacgtactcattcttttaggaatcctaaacttaaccttatgattcagatttcagaatagacattcaaataatcgaggcactaaccttctctactacaatcatgtatcttttcttttgatgagctctgccgtattatttaatttttaagatggggagaaaagttttaccggtttctttcactactggagaagtgattttcgccgggtcatgcaaaaatgatatagtcctgtttcgaataggaagttaggaaccggccggactaaagatcatttttagtcccggttaaaaagcgcaacagaactttatgatctaaagatcatctttagtccaggtttattttttgccagccataaccgccggacatatttagtcccagttggtaacgatcatctctaaagtcttcttcctccatcaaaccgagccattgctgcaaaggtttggaggagaaagggaggtgctgctaaaattttttgtgaaaatgttttaatgataatatacaaattagagggatctaaaaggttagcaactgcattcgctaatgatgcatgcttagcatattgcatctatagctgtgtttctatacattgttgtctcttaaaaggtttatggaaaatgatgagagagaaaatttgttaagggaaaattaggttacttttaaaattataagcatgtggataaaaatgttataaaagagatgacaaaggaaaaatatagaaaattaagaaaaaaaaagaaaactaagttaatttaataaaatagttacaaaaaattacaatacattaaagatatgtttagaactttaaaaaatatttaaaacatgaataatatgtgggattattgtatgattatttatatataattattgtattattatttaattagtttgactttcgtggattttatttttacgatttttgtgcatttcaggtagatggatcgacaatgaatatacaccgcggaccgatggttcgcagagtttattggctcgtcgttaatctcagccacttctgcccaggtactatattttttttaacacaatattacatagtcaccaatttaactcgcattgcttggaaaactgaactttgaagcatgtcatcaagtctattgctatggataagactacgagaataatggacgcaattgaatatgttacatgttactccctccgtcccaatatgcagtagcaacctaggatgggacggagggagtagttactaatcactgagcaaatgagcctagatgaaacatgtcacaaattaaaagagaatatcgttgtaaccaattgataatttcgaaatatcctgaatatgctgccacccatctgttgtgattgtagcataagctactatagtctgcaaatgaactgataacatattttcatcatctgaacacgatgaagttgaacttgcatatatccattgatagggactgaactttcatatatttgtattttattttcaaatatagtgatataaatggtattttatttttaaatagtgtggtcatcatgtagaaatattattttgtagtttgtaaactatgagaggtaacctcaccaactaaggtgtagaggtaattgtatccaggcaacaatactatagagaagggatttagtgtcggttggaaaaccctcttcggtgccggtttttctaaccggcataagggaggcagcactgatttgcaaatcaaaagggtgccggttccttagaaccgacagcttttaggtttgacgaataaaaaaaaagccggcccgcatcgagctgagcagtccctccttccacatccgcaagaacagaacgaacacatcacacaatcacaaaatttggcaacattcatgcattactgttgatgcgaaaaacacacactggcctggaagatctgcttaactcctgtgcaggtccaaatcttgcttttaggttcataagcgtgctagttgatttgatcctgcaatcaacaagaataaaagacaagaaaaccgatgttaaatccataaacgatagccgatcggctaggagccgatgacatatcatcaatcgtcaagccgatgtcattgtcattagatcggcaatgaagaataaagcaatataaaactaaatctactcgatcggctgcagatatcaacgacaaataatccttttctcggtgtatatttaaactaagtgattgagatagatcgaacatcatgtcaagacaatataaatcacttaagtctaaagatacgctaagataatgattatatgaacatttatagcatagccatcagatagatctagcacgtatcggctaatactccgataccactttataataagatattaaaacaaataaaatatatcaaacagaaagcctaatatactctaatgcaataagatcttaacataaaaatcaagcatataaagtataaaatagctaaatcaggtaagatcgtctgaaactccgacactatcttcgttagaaatcataaaacgagctagatattgcagttatgaatattacttaatagatcgaactcaaccgatacagcattaagcataaaaacaagtacaagatctaagcaagattatgaaaacctctaagagatggtagatatgcgatataatctagattaataacaagatctaactctatcggctactttctaacaacaaaaaccagccgattgcgggttagataacgtaactaacaaagattataaagcatatataataactcgacgaattacataaataagattagagtgtcgtaatgatggaagcactaatcccgagaacgcaagccgccatgacaagtttacctcttcttgaagatcgaaatcgatgcagctcaacctgaaagcaagaactcgtcgaaacaaacgaaagtgaaaaagggtggcgatgcgccaaaagtgttattgaactgttattataaattacatgggtttgggttatatttattcccgagatacatggtaggtccttgctggacatgattcttatctctaacaaactctaagatacaaacgaatcttcacggcagacttttgctgaaacatatctttaaagaaactattcaaaatatcctaattaatagatacaattgcctatctgagagcttatctccatcgtgacaatcctttcgtagcacgttgatcgattccagagacagttttataaccatctcaatgaaatcggctgtatcggctgtcctctgtccgatccatctcagccgatgcagactctagctgatgccttcgcaaccgatgcatactctgttcttcgaatccaattctttgccaaatccacttcgattccattgccgaacctggttcatagtttaccaaatttggtcgctaacaattacacaatcaaatattcaacaagtttacatctctaaattgttgaatgaaacaatcattgaatcatcgaatcaaacaatcaaacatcactggaatcattgaatcaaacaatcaaacgctcaccgtcgttgtggggagcctgtcgccatcgttgccgctgcctaccccccggcggtggcggagccctccccgccgccgctgcctcccctcccaccggatctggcggaggggaggtcgtcgccgccgccgcctcttgctgctgtcgcccctctcgccgccgccgagcggtcgccgactcccctcccgccggaactagaggaggggaggacgtcgccgcctcccctccatccgttgggccgccgcgggatcccctctagccgccaggcctccgcgggctcccctccagctcctgccaccgccacctctcctctcgccgagggagcagtcgccgcctccgtgccagcgcgcggaagaggaaggagatggagagagagagagagagattgaagagagcaagacaagagagaagggagggagagggggagagagtgagagagagaaagaaaagcgagacgatgagagcgagactgcgagacgaccttatctcctccggtcgggtggtggtggtggggcccgccggtcggctcatccgatgccggcttggctcgatttgtataggtgtcggtttttaattaaccgacacctataatatattaaaggtgccggttttttaaaaaaaccgacacaaaatacaataggtgtcggttttatttagaaccgacacctataattatttaaaggtgtcccttttttgcgattttagcccgcgaaggtgggaaaaagcactaccggcacctatagtggtgacacatatttgatgttttgtagtagtacaacccattttgatacctccattcaaacaaaatataggatcattccaacccatcatatccctcaaaccaaacaaaaaaacagggttcgtttcatcccttcaaccaagcaaaaaccagaaccattccattccaaaaaatagggatggatccaacccatcccatcccatccccaaaccaaacatatgctaagtgaattgttcaatcctattttttggtgttagatgttcagtgggatgaagagatggttcctagattttttggtcggtcgtttatgctaatcgaatcatacaaatagcgaggatggtgtagaattgcgacatagtacatctggtatgttcactgttagatctgcttatcatgtacaatgggatcataattttggcaatctaaggagaaggtcgaactgaggcttctctctgtaatgagctagaaattacatatagtcttatagatataatatagttaaaaccatagtatattttcatcacaacagataaatcagtgggcttttccattgcatacaggaatgtggagattatggataccccatacctacacggcatgtatatccgactgggtatggggtgccatatgtagatagaatatctttaaagagactcgggttaaatttcaaacttgtatgtcaaggaaatatccggtatcctagttggttacgattgtattttatctgtaactacctattccgttagggatatgggctgtactttgtaatacggaccccttcccctatataaggaggggtccgggtgcctcttgaggtacgatttttttcccagatcatacgatcaataatacactcggcggatcaatccccggacaggagtagggtattacttcttgattaagaaggcctgaacctgtataaaattccttctctaaacccatccacttttctagcttgatagccacccccttttagtattgccgaaatcttgtttcgacagttggcgcgccaggtaggggtagcgtcaagttcttcgccgactagtgcgatgggtttcgtctccggcatcgacgacttcgtcttcccacccgggcaggcgttctgattcggcagcctcgacttcatcaccaacgacttcggcaagatttctctcctcgactcggattcgaaccagtcggggagaggccaggtctccatcccgttcggtatcccgaactcggctgagatctactccaagatcatctcaaccaagtcggctccaaaccactcggacgagatccaatctactccaacacaacctgatcaagacgatggggcctatcccttaatcctgatgaaactccccgacgacttagccgtcgtcttcaccacacgggcgtccgctccccgtaggcctaggcgggatccagcttcggctccgatccagcctagctccagggaagtcggcgtcatactccaacctctcgggacggtttcgacggaagaattggatggctacctcagctcccccggtgtcgattctcgaccgacggagatcgtagagtacgacgacttcggctaccactacgactaccgcaacctcgacaacttcgacgaaggcaacgaagataactacacgcctctcttcttcggcgttttcatggccgacaacgagacggaagaacagcgtcaagcccgagaagcagaagaacagcgcgtatgacaagaagccgaacgtcgctgacaggaggagaagcgtcaagcacaagagcgagaacggctacagcgtgagcaacaggagcgcgaacgggccgcgaaggaggctgaggatcggcgacagcgcgccttggaggccgggcaacgagcacgagaacttattgggcaacaagacgttgaggggacggcggtttttcgcaccccccagcagaacgcggttgcagcgatcacccttctcgacaccctcctcaaggaagtcgcactcaatcaagccaatcacctcgtcaacatcttaaatcagaccaagaccatgatcgccgcttcggtcccggtgaactccgcaagcgtccgtacgccgactggcagccgagttccccctctccgatctcaagactatcatcaaccaagcctcagcgtcgtcggcgcgggatccagtcgcaggagcaaggatcacaacgagtgatccgtccactcgcctcctgaccgacgcagggagcgtcaagctgaaccgcccctgctccccacatcgcaggcgtcccatcgcagncgacntgcgtcgagtgatttggcaagcgggctcaaagcngactgaaatcaagaagtatgacggcaccactaacccggagtcttggctcaccatctacagcctcgcaattcgcgcagcaggaggagacagcaaagccatggcaaactatctgcctgtggccctagcggattctgcccggtcctggcttcacgggctaccccgtggcacaattagaacttgggcggaacttcgcgaccacttcatcgccaacttccagggtacctttgaatgccctggcacacagtttgatctctacaacgttgttcaaaagtctgaagaatccctttgagattacatctgacgcttttccgagcaacgcaacaagatctccgacatcaccgatgacatcatcatcgccgccttcaccaagggcattcgccacgatgacctagtcggcaagttcgggcgcaagcgtcccaggactatcaagcagatgttcgaaaaagccaacgagtatgccaaagccgaagatgccattaccgcgtccaagcagtcgggcactacttggaagccgaacaaagatacgccgaccacaggggggagtggaagtaccaatcacaaggatcgcaagtgtaagcccgaggaacttgtggcaactactacaccatcctcccgacaacgttcacgcgtcaacacttttgacaagatcatgaactcccaatgtccacatcatccaaattccaatcacgcggccaaagattgcttcgtctacaagcagttcgcagaacaatatgc

SEQ ID NO: 18262 - DNA, 965 bp, Oryza sativa
tccttcatgattttaaaatccagagaatctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaatcggaagagagttccaggtatcttggtacaccggaggaagacaagagtactcgggaagggcaggctcaggattctgaatataaaaccagcttgcatgccaccctttgtttgaggtcttgaagggcatagagaagtacttctggctcagagtccccctcagctgaaatccggcccctccgactacacatggcttactcttgttcggttggggcttgagaaagaagattcggcgaaacagagcgaagtggggcttaattcccaagaaggcttcacaaacatggacgaaattggcgatgtggactatggaatttgggtttaggtgatgcaagctgattccatagaagcttaatatcccgcggaaaaattttgaggtcggaggagcgaagccgccatagaagaaatgggagaagaccacaacctcgtgtgtatcgggggtcggaaaagcctcaccgcacgctggccgccacccgatgatctccttggcagggagaacgccgtgcgccaccattttctttcaggttctcctccgtcacgtcggatggcgcccattggccttcaaagctttccttctcttccgccattgattttacccgaatgcgctgatttgattcgagggatggctaaagagaagtgaggggttgaggcggtggatcacgggaaggattttgatgaacttttcgaaggtggattcgagtggaatggtgaaccctagtttgccggcgcagctctgtactgtagcagggagtggggaaaa

SEQ ID NO: 18263 - DNA, 17612 bp, Oryza sativa
  unsure (1)..(17612): unsure at all n locations
ctcctcgcggctcttttacatggaccgctgaccgggttcggcagtgcgatcgattaggaataaaagttttatgtatactagaagtataagcgcggcgtcatatagagttaatacgaagcatataatataagtatatggtgtacggtacagaaaaatgttgtacaataaattagtagaaatacagaacacattgcagctcgttttgcccgcaaatggaaataacataattttgaatttactcatgttcccgagttccggcggtataactccagtaagtttgttctcatgtaaatatctgaagagaaaaatgacagtaagtgctatagaagagaacttactttcagaaaactgaaaatgcatagtaagatgcacttactttcttctcttcttcttctccttgtaccgtgtaagagcattatctctgctgcctccagcagatgaactttcaggaccaggaggatgccagggtggctcacccataaggatcattgacaataccccacaatcttaaaatctccagcactactttcaccagtcaaaccagagaaggaaagggatatgctggacatagccttcctaccaggaatacaatggctggaatcagcccttgcagctgggtttgacatcccagtatcaacagatgcgacattgttacattctggctggtgcacaggtttgggctgctgaaagtacaagaatttgacaaaacttgaacattcagagtcagatttgctgataagatgaacgaaaccttaaaaaaaatgacagtaagtcatggcctttgaacaaacaatatcatcagaaagggatactccaacaacagaacctggagcccctaaattcaacaattatacaaggctaaaaaaatcattccaatttcaaccaaacttccaattttaacgtgaactaaacacacccttcgtcaacctctgaaaggggacatgaaaacaagcagtcatgtacgaacataaaaatcaccagaagagttgatctgagcttctctgcccaacaagaaaaattcaagaaattggtactgcacgaaataaatgctaacataagttctaaattccaactgacattaatgaatctggagcccagaaaattcagaacacaaaacgtagtacatacatgaaccttgtctagtagtaaagtgtaaagttcagaatgtccatcgatccagttgaacaaaaaaaaatcaaactcataaacggcgctgaggtagtagtatgtgtataaaaaagaaaataaaacctgtggaagagatatcagatatagcacctgtaaacttggtccatgaaataaaaacacaactttcctgcagaaaaattggacatacagacatacagtaagccaacgaaaaaaccaggacaacacgtagaaccaatcggggcagcaaaaattaagagatttgctgccgttcgaagaaggaaaatttagtcgaacaaaattcagaatcaaccaccgctgacgcattgacaggtaaaaaaaaaaagaacagtggattctctgaagaacacaaaagaaagattcctgcagagtataggcggatgtgcttgctccagatatgcaccatatgcaacacaactcccagttgcttgatgccctccttcctgcacataacagcaaacttgccaactgcgttcatcacatgctccgcgcacctatagaggaaaaaccattcagatgaggaagaaagggtcaggacacggaaagtgcaaaaaaatcagatcttgtcaatcaaacaaaacaacagaaaaacaaacactttcctctgctccatccaacggcacattctgggcaagggcgttgacgtccttcagcggcagactccgtcactatgatgttgagggaggcgcactccagtcgaaggctcggtgctgagccagcccctcgttatctcgcaggttggggaggacacttttgggggtcgttcgagtggtcgaggcaggtgaagtcgtcgtccctttcccactgcggtgctgctccagccggtggggatggggatgagctgacccggagagagaagcggcagaaagcaataggtaggaggagtggtggagaggtagagagcgcggcgcacggagagacgggttgggagggagcccgcggagaggttggagggccgatgtgccttgtcgggttgagggggaaagaagggtgctcgccgtcgcatgcacctcccctcccttgccaatctagggggtcgagatccactcaatccagggggaggcggacgacgaaggcagcgacagagggaggacgcaccacggcgacgacggcggccggcggagcggggcgcagtggggacctccgccaggccaaggtccacctcccccgatctgcacggtgtgggaatggcggcaggaggcatcacttgagaggaggagatgcgggagggcgagcgccggcgctgatgggccgacgacggaggcggattcgaggggaggacaatggtggtggtgcttagggaggtggcgaggacggaggaaggcggtcgacgatggcggcgacggagagagggcgcacaccacgtcggggcgagggaggggggaggggaggcggacgacgaaagcggcgacaggagaggccttaccacggcgaggacggcggccgggcggcagccccaggctggcggcggcgcggggcgtagtggggaggaggtgggaatggggaacgatagggtggggatggagggaagcagatcctacgttagagggacgtacttcgcttcatcagcgtcattccgaatcctacggcgacggcgcgatttcctttttcatcgtccttcggcccagtagctgtccagagttcggcccagttgtcagttgcggaggccgaaggggaaaaacagagcagcgaaaatgaattagaaagtgaaacagagcaacgaaggtgagaaagattagtcatatggcccgcccaaccggcctacaattataatagccaaagtgcccaaccaaacatccccttggtcgctccctctcctcctgtctcctcccgacctccgccgatggcgctgctgcccgacgtccggaggcgagcagccatctgcggatgctccaggaggatcttgatcgtgccggtgtgtagttctccgcggcatcggtgacggctgcggccggacggcatgaggcttcagctccagccagatcgacggtgccctcgccgccgagcctccatggagaccaggtacggggtacgcgcccgcctctagtgctaaggtcgggtctgcgcgacgcgctttggctcggactgaatccatcccgcaatcagtttttgtcccacgtcgcttagagcaaggctaatagtatagcccgctgctggctaatagcccatggctaaagacaattactagtacaatagattgtctattagctagctgcatcttataatcaaataattaattataacatgcacatatcaatatatgtgatcaggagtgaattgtatccttgtagctatttgtgttgtgagatgaactttgttcaccaaacaccaagatcatttcacagatcatgccaaccaagttatctgttgtataaaaattacttcatacaaagcactagtgtttcgtgggcaagaagagctcacgaggaaggagtatatttcctagccggatttttgttgaacggtgtggcgtgagagtttttcaccggccgagtctttcgctgatgcatggacgacgattacgcacggacgatggagatggattcgcgcacggtgggggggaaggggatcgtgcgcctcacgggatcgggctgaggatgtgcgggccccacaaaccgcgttgtttagcgctagggtcgactgctcgcgagcgatacggcgtggagagaagcgctagcgcccggcgacaatttagtcgctcgcttcattctctctcatcctttctctctcatccacataggaaaatgatgatgtggcactgttttggagcccgctgagtcagcctattgtacctgctcttattctcagaacgcgcgacctctttagagcacgtataatagtgagctataagcttactataagcttaggtggaggagagaggtagtgaaaaattaaggatgttggctctcatgcaagagctagcttatcacaagctccaacacaaatgcattaaatgtgtaagtgagagatagagagaggagaagaaaattgtagccaaccttatagctaatctattatatatattggctttaaaataggctaatagtaggaagtgggctctattattatccttgctcttataaacgctagttgattatgtggtgtcgcctccccggagacacccacaccgactagatacaacagtaagatccccaccgtggccacggcttggcggataccttctgctgtaaaaattaaaaatggagcagtcataaggtcccctcccattacggggcacggcaggcgcctgccggttaggctgcatccataatacgttaagatgtcaaatacggcatacatatagtcgggtctcccggtggaggcagcgctagacattagcgctttgctttttgaaattttgtatgatcaaattattatttttccgttgattaattatacaatagcagcaatggaggcctgcattagaaccccctctgcgtttgaattccaatttcctttgcgtttgaattatacttaccagcttaacttatctgaagatgttgtccttttttctttttataattttctcggagtgaatcaaccatgatgccataatgcatgctaacgatggagtgtttaaaatcttgtcttgattgcccctgcaggaccttattgttcagcttctatactcattttgtttctgccactttctagagttaaaccctggctagataggtcttctccatgtctttgtattttaaagcattctaaaactatgctctacctttgttagcacattagtgtgtgcatctgggaatttgggtctaggggtgggcaaaataaaccaaaatcaaaaggcaagcatgccagaaccgagttgctactgtggagattatggatatcccatatctacacggcgatggtatttggattgaatacaggataccaaatatagatagaatatcttatttgtgtctcgggtttgtctctcaacttgtacatcaaggaaataccttgagacttagtcggttacgactgtattttatctgtatctgcatattccgttagggatatagattatcttttgtaacacggactccttcccatatataaggggggtccgggtgcctctaggggcatatgttgattttctccaaatcatacaatcaataagacactcggcggattcatccccggacaggagtagggtattacttcttgaataagaaggcctgaacctgtataaatcttttgtctccaaacccatacacttctccagcttgatagccacccccttttattattgccgaaatctagtttcgacactactgacattgactgggtgaaaattaatatcttcaggctggaaattacttagttggttatgaagtgaaaatttgtggcatttgcttgaatctgaggttcttttgtcgagggtgagcttctttgcttctcaaggatctgatgttgcacaggtgacaaggcaaatgttcttgggttatgcaagcggactgctgatgacgtccttgtaaaatcaaaggtgtttttgattattattctgtgatgaacaattgggcattggagattattgattttgttatttggaatttattcacgaagtggttttggagatgattggattcataggtgatcgcagggttcattattttatgtgaccggtcagaccgggttgtgtatgccggtctgaccggcggtgatcgagcggtcggaccggccagcccgcggtctgaccggccgacgctgtgtcggtttcggtttcgggttgtttgtttggatatccgagtttatttcttgattatgacttctagatggatactatacgtatgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggataaggcgacatccgtgatggtcagagatcatgcgggacacttaggctagagttgatgcacatggttgatggagattctatatgtcatacgatggagttattgtgtgcatatgggatgcggagttgaatttggaaggagtccaaatttggtacgattggttatgtaaagtttctttcttgtactagtatgagtttaggactcttagtatgagtttggttcgtggctttaggctgcctacctcatgtataaatagagggggagcgtgaggcttcccggtatcgctttagagagcaattgagttgagtttggagttagggtttcgagtttagtcgaaatttttgtaaggagtgctattggtgcactttgtaagcacagagagaatcaataaagttgtcatctactttaagagttcttcgatttgtgtttcaccgggtttcggcggtctaaccggcaactcaccggcggtcagaccggcggcattgcggcggtcagaccggcgggagcacagcggtcagaccggcggcgacgacagcgagcggcaggcgatctcggcggttagaccggtagatcaacaccggtcagaccagctaatctacttcggtcagaccgatttcatcgaaattaagggtaacttttatttccgctaaaagtttttggtttttgggtataccaatcattcaccccccctctggttggcttagttcttgtgattcgttcctacaagtggtatcagagccttgttttcttctttggatttttatcgatctagagtttttgccatggctactcccgcaaggttttcaactaagcctcatgttttcgatggaacggatttttctcattggtgtagtaggatgcaatcttatattatggctgaagattatgatatttggagaaaagtttctcatccttattgtcgaaacatgataatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacacggcatcgcatgccgagatgtcgagattcacaacaacgtcatggttggtgatgtagcaaaacttgttaagtagcagcaatagagtttgctggttccgaagataataaagatgaagtcgctccaccatgatgacaaagttgtgttgccgtgatgaagtgaaccggtagtgaagacgcgcagttgtgaagataaaagcactagtcggcggcggcataacacgagtcggcggcggaagacgatgatgtccatcagtagtggtagctgtataaaccaaatgtagaggcgagggcactagtcagcagcagacgagacgaccggcgatgaagatggtaaggccaatcaacactggcagaatcatgcagccatggcaaatgtaggcagcttgtgttgaagatactgatgcctattagtagtgacagcgatgtagccagtcgtgaagaagatagcatcagttggcgttataacaggccagccgtgcaggcgatgacaccactcggcggcggatgcggcggccggtcggtgaagacgcagacgcccaacaacggcagcataataggccagccgtgcaggcgggaacaccagtcggcggcggtcgaggtggccggtcggtgacgacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcatatgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggaccccacctaagacatcttctccaaagcttctcttactgaagaggggaaagattgagcaagaatgagtacaaccacagtactcagcaggccacaccggagatgcacaattaatgcaaaggagtacaaggggataataacatagaggttaagttttgcagtagacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgatatagtttccaacccatcctagccatagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaaaccacctaatgttgcctaattaatcagcgaagcatctacctacattcatactagtggaaccatgaatagagtacccactagttggggttttgtttaatctagggtgaacaaggtaataatatcaataacaatagtattaaggtcataacaaaggtaaatgggcatggctaaataaaacagtgatcacgcgggaatttaaataaagcgataatgcaataatttaaatcaaaataattttataaactgggattcaacatgttcaaggatgatgtgacttgccttgctcagagagaacagccttccgaaccttcggcgacaaccgcgaaccacgcttcgggaacctccggaacgacgaaagctacgcgaagcacacaagcaaagctacaagcctataaagaagcaataacaacacataaaaagaaagcacagggttctttaggttataacaaacattaagagacttgaacgggtcgattcggagctcgtatgaccaggatatgatcatccgaagtttaatgctgttatatggagatttgcgaattattataattaggttttgcaactatgaaacatgtgtaagcgctagcctggaaaggacaggaaggctgcgccgttgacatgtggaccccacatgtcaacctaaaggaccgcggtagaccgggtacacagagacggtccacgggtcgacggaggcggaccccgtgtgtcaaccgaggcgagtggccaacaaacggactccactagacaccacacgggatgcacacgtagaaaccacgcggctaccgagcgggcacacaaacacggacaccacacgcacaagcgaacgactaccgacaccggtacacgggtaccggtgtcgacaaccgcacaacgggtacggggcgacaccgaaaggacgagggcggggaagcgagaggacggatccttaccaccacgcgacgaggcgcgggaacgacaacgacgaacgggcgcggcggagacagacgggcacaacggagacgaacggcgaggggacggcttcggcggcgatccttgaacgaaggcgagacgcggccggcacgaggcttgacgacgcggagccgaggacgaagacgaggacgggggctgcagcgacttgcttgactgatgcggacgacggatgagaacggcttgacggagggacgaacgccacgacgagcgaaaccgggaacgacgagaggacgatgacgacgacgaccggaaccggcgaggaggcgacgaggacagccggcagcggctgcacggagacgaggacgacgtgggacacgccgctgcgatgacgatgacggaggcggtgccgcgagacgacgagccgggcgaccgacgggacgtcgacgacgagaacgatcggagacgacgatgatggaccgcggaggggtttggatggaggggaagcgaggccaagagcgaccttgccgctgcgatgccggaggtggtggaggtgcagcgagccgacgagccggggaggaggaaggggcggccgaaaggacaccggcgacgaagaggatggagagaccggcgcggcgacggcgttccggcgaaaaccgaggagcagccggggtggagggcgatgcggcgacgccgagggaggagacggtgacgtcggccgacgctcaggcgaggcggccgggacagctggagatggtggagtggtggcgacaccactagtcgtcggtgaggacgcgtctccggtgatttccccgcgaaacggaggcgaagccgggaaagaggaggcagctgcgaggccgagggagaagacggcgcggccgggcggcgctcgggcgaggagaggaaggcggctggaggtggccggcgcgaaggaaagaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggcgtgggagagagagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccggacttggcgcggccgttcccggcgattgggggcggcattcaaaggggaaattagggggaaatgaagaggagtcaatggggattaatttcccctatttaattttggaattaaccaagcgaatcaagcggatttggaggagggagcgagctagggttcacgggagaggaagaaaggacgcccgggcgggaggaagggaacgacgcccggcctggcgcgtgggacccaccggtcaggcggcggcgtaagcgcgcgcacgcgcgcggcacgtgcggaaggggagcggctcgggggctggggcggcttgggccggcggccggcccaggaagagaggagggagaggcggcctgggccgggcaggccgggaggggaggggaagagagaggcagcccgggagggagagggaagagggaggtgggccgaggggaagggggcccaagaggaggagggagagaaaagagggaggagaggaggactttggactgggcttggcccaaaggaggaagaggagggatttttaggttttctttttattgacctttgataattgtttttgttgtttaataattatttccggtgctctgaaaattcaagtgaaatttgagggctccttttagaccaaggagaatttaacaaaaattctccgggtcacatttgaatttttcttgcacgtattttagtgtttgccaatttctttccgacttttaattaattctattattccttttagaaaatgaattttaatttggaatggatttatcaggacgtgacagcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgtaggcaggccggcggtgaagtcgtagacgcccaacagcggcggcataataggccagccgtgtaggcggaagcaccactcggcggcgacggaggcaggccggcggtgaagtcgtagacgcccaacagcggcggcataataggccagccgtgcaggcggaagcaccagtcggcggcggacgaggcggccggtcggtgaagacgtatacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaagcaccagtcggcggcggacgaggcggccggtcggtgaagacgtatacgcccaacaacggcggcataaaggccagccgtgcaggcggaagcaccagtcggcggcggacgaaggcaggccggtcggtgaagacgtagacgcccaacaatggcggcataaaggcagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcgatccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcggcagcggcgaaggcaagccagtcggtgaagacgtagacgcccaacaacggcggcataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgtaggcggaggcaccactcggcggcgacggaggcaggccggtcgtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagactcccaacagcggcggcataataggccagtcgtgtaggcggaggcaccaatcggcggcgacggaggcaggccggcggtgaagtcgttgacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggataagccggcggagtggactcgcggccgatcgaccggaaagctgagaagcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaagaaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcagagacaaaagatttagacaggttcaggccctctcaatgagaggtaataccctactcctgtttggggatttgaatccgccgggtgtagtatagatctgacgatcaggttgtgtcatgccccctagagggcctcctgcccaccttatataggatggggggcaggattacaagatagaaaccttaaccaatacggtatcggtttcctaaatctattttacaatattatcgaatcaggactttaggccactccataatataaaaggaaacgtaacacccaagtcatgatctgttacatattacataaatataagttatcccctataactagtcggataaccatgccgtgtgggtatggggtacccataatctccacacttatgtgattcctgaagctattaatactactgctgaaaaaactgcttttgaacaaaattgcaaagctcgcaatattcttttgagtggtatttctcgttcggattatgatcgtgttgctcatctttaaactgctcatgagatttggactgctttgagtaattttcatcaaggaacaaataatattaaagaactttgtcgtgatcttttcaaaaaggagtatattaaatttgagatgaaatccggagaagctttggatgactatctttctcgatttaataaaattttgagtgatcttagatctgttgattcttcttatgatgttaattatccacaatctgagatttctcgccactttttgaatggtcttgacatgtctatttgggagatgaaagttacatctattcaggagtctgttaacatgtctactttgactttggattcactttatacaaaattgaaaacacatgagatgaatgttctttctcgaaaagttgattctaagtcgaatgctttggtttcttcttcttcctctttggatgttgatgcttcttcatctaagtcgtcttttcttgctgtttttaatgccacattcgatgatcaactcgaacaaatcgaggaggaggatttggctttggttgctaacagaattgctcgagctatgaataatgccaggaacaggaaaagaggtggtccaaatcgttgctttgaatgtggttcaattcatcatcttcgttggcattgtcctaatcttgggagaggcaaagagaagcaaaagatggtgagaagaccacaacaacaaagcccacacnnancaagtcgaagggttcataccgagggagaaagatggagaatcttagaaaggcttttcaacaagtttgcgccgccttcgagccactaagtgatgtagatggtgaaagtggagatgatgataagggaaagaacatctccgatgtttgctttatggcgcgtggtgaatctgacacagagtatgaagataatgaggtgaatgcttttgaggaagctattaatattttgagtgcaaaaaataagaagtgtgagaagatgtatagaaaacaggaatttatcattgaatctcttaaatctgaaattgatagattaaaatctcttattcctaatgatgatgattgtgaaaattgtgaggttttaatgaatgagatttcaaaaattagagatgttaatgctgcacatgatttaaaaaatagatcttctcttgcttgtagttttgccttgcatacacgcactttggatgagttgtttttaactaaaaagttgttgcaaaaatatcaaattgcttttcatgctagtttgatgtttaacatgatttctgctaaaaagttaaaacaacctcattatgttttggattgctcaacatgtaatttgaataagatgaaactaaaagatgctttaggtcatgttgagtacatggaagatgctgtgaaaaacaatgaagtgctttcttgccctaaatgtcgtaaaagcaaaggtatcatggtagattgtgaaaattgtgctaatttggaaaaagaggtttcttatttgaaaaattctttgctaagattttctgatggtaaaaagaacctcaacatgattttggat

SEQ ID NO: 18264 - DNA, 1066 bp, Oryza sativa
tgaagacgtagacgcccacaatgccgggcataataggccagccgtgcaggcggaaacaccagtcggcagcgcgaagcaagccagtcggtgaagacgtagacgcccaccaacgccggcataaaggccagccgtgcaggcggaagcaccagtcggcggcgaccaagcaacccggtcggtgaagacgtagacgcccaacaacggcggcataaaggccagccgtgcaggcggaaacaccagtcggcggcggcgaaggcaagccggtcggtgaagacgtagacgcccaacaacgacggcataaaggccagccgtgcaggcggaaacaccagtcggcagcggcgaaggcaagccagtcggtgaagacgtagacgcccaacaacggcggtataaaggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgt

SEQ ID NO: 18265 - DNA, 574 bp, Oryza sativa
  unsure (1)..(574): unsure at all n locations
tagccatggtctattacccaccaccagnctatactataagccttgctctaagcgacacgggacaaacactgcttgcgggatggagtcactccgcgccagagcgcgtcgcgcagacccgaccttagcactagaggcggcgcataccccgtacctggtctccatggaagctcgggggcgagggcaccgcccatctgggtggagctgaagccccataccgcccggccgtagacgtcaccgatgccgcggagaactacacacacggccgaccaagatcctcctggagcatccgcagatggctgctcttcttctgacgttgggcaacagctccataggcggacgtcgggaggagacaggaggagagggagcgaccaacgggacgtttggccgtgcactttggctatatataattgtaggccggttgggcgggccatatgactaaactttctcaccctccgtgctctgtctcactttctaatgcctaaaacctggtctggttatcccctaccggcttcgtaactgacaactgtgccgaactgttgacagaaactgtgccggaggacgatgaaaaaagaaa

SEQ ID NO: 18266 - DNA, 805 bp, Oryza sativa
cacctgattttttctattttcagcccttcacagtctttgattttagtactcgggagaccaaggcagaggaagttgaagcactcggattatcattttgaatgacgagagaagactatttcgtcgactgtaaaggtctcaggggctactgtggagattatggataccccatacctacacggcatgtatatccgactgggtatggggtaccatgtatagatagaatatctttaaagggacttgggttaaattccaaacttgtatgtcaaggaaatacccgggatcctagttggatacgattgtatcttatctgtaactacctattccgttaggaatataggctgtaccttgtaatacggaccccttcccctatataaggaggggtccgggtgcctcttggggcacgatttttctcccagatcatacgatcaataatacactcggcggagtaatccccggacaggagcagggtattacttcttgttaagaaggcctgaacctgtataaaattccttatctctcaacacatccacttttctagcttgatagccacccctcttagtattgccgaaatcttgtttcgacaaacggagagacgaattttacgtggaaaacccttgtgggaaaaaaccacgggcgccgaccgcaatgatcactatagaggagttggatatgatacattgggctatcgcaccctccccgtgcggcttacaagagatatgtataaaagaaatctaggagttctagtgggaaaaaactgagtcatattaggaactgatcctaatagtcaagttctattaattaggaa

SEQ ID NO: 18267 - DNA, 1573 bp, Oryza sativa
catcgctcaacagatggtcggcgacggctacatacaggaactcatccgggcgttcggccgccgccgccccgacgagctcatcttccagaggtggttctcgcagctggacgtggactttgtcctggtcctccacaccgacggcatggtgcgagctgacagcttctccgtggaagacctgatggccttgataaagcggtggatccgagctctcctgaccatggtgcaggtcctcaatatcacgctgctcgagctcccactcccggtcgccggaagtacggaacggatggcggcggcggcggaccacgcgcagttcactgggttcgcggaggagagcatcctcaggatgctggccttcgtcgacgccgtcactctttctgctctcaacgtcaacgacgaccaccgccaccggacgccggagctactcccggggatgctgcagctgtacgcctgcgtctccgaggcatgcgatctcctcgtctcagctggcatgggcaaggacgagatcacgaagatgcaggccttggacgccatgaacaatggcatcctgatgcaaagcaggaggaagctgagcgatgctatctgggtcatgatggagaaggtccgggctctcttcttgatggacgcctgctggcaggtctcgcaggaggcagccgcatccgggacccatgagaccacggagctgacgatgaactacatcacgcttctctggcgcaaccataccatgctcgactacttcagcgtgttcgtctccgacgccgacagcttcagctcggtggcgagactcatcgccgagatgatcacctgcctcgagtgcaagctcgaggaaacctccctctccatcccggacctgggtttgcgcttcatattcttgctcaacaattggcaccgtgtcttgcagcgtgttgaatccttgcgagacttgccagcggccgtccggcaagaacgaatccttctcctacatgcctcggacagcaagattaagaggtacatagacgattatcttaatgcctcctggtcgcctctgttacgttgcctgctcatcgacaagctttttgttgctctcgggaggtctcatgaatctaaaattgagacacaactccaaacaacctacgcaacacaaaagttttggaaggttccgaaccctcagcttcggcagagactgcgtagagccatcatgagcaaagttattccagattatagtaaatacatagagcaaatggataggcagaataaaatcaatcgacacctcgtggtcactagtcccgagcagctcgagcagcaaatagaggaattatttgaaggatgatgattattaattcaactaggaaggtaacccccgcattcacgtgggtaagtatgttttttttcacgtgtttgaccatttatcttatttaacgtttttatgcaaacatgtggaaatgtaagtcatgcttaagttataaaccaagtcacaacaaaataaataataatatttatttttaatatgctacgtgagccgtggatctcgcatccgacggcggagatctgtagttagctgcagtacgaactccaagatgtaatgtgtgtatgacag

SEQ ID NO: 18268 - DNA, 4574 bp, Oryza sativa
ataagcacatttggactagatgtcagttctctactctcagtaaatgtgactatgtcacaaacaatatagcagagaccttcaatagttggatcaggcatgagaaatcactgcctgtagttgatttgatggataagattaggcaaatgatcatggagagaatgtctgttaggaaaaggcttgctgtcaagttgactggtactattcttcctagtgtaatgaagtccctgtatgctaggagcagggaccttggatacaagctgtactcagcccacagtcacctaggagaaataggagggactggtagggatttgaagacatggaggcacactgttgacttgaacactcgagaatgcagttgtaggcaatggcaggtaacaggtataccttgcacacatgccatttttctagtcatttcacggagggggctagaattggaacagtttgtggatgactgctactctgttgcaacattcaagaaggcatatgcaggacatgtagttccaatgacagacaagtctcaatgggccaagattaatgtaggattcaagttatatccacctctgttgaagaggtcagcaggcagacctagaagcagaaggattaaaggaatggaagaaggaggttcaggaaaaagaaagtatagatgcaagaggtgtggtcagtttggccatatcaagaagacttgcaatgaaccagttgctgatccatctgcccctccaccagccccaccaaagcccaagagaaaaagagtgaagaaagttgtgctttctgtgcaagatcctgttatacaagtcccaacagctactgtgtatgttgtcaacagcaaaatttcttttttatgccatacatttgctatatttactctacatatttatgttgattttcatttttttgcaggttcacaccttcaagatcacaagcatctggggtgactcaaacaagcccaataacaaggagcagggctagagctcacaatttggatgttgatgctccaagcaacaaggcagctggtgccatctgaagactgaagttcaatgacatgaaatttgcttttgtataaatgtaggatgctatgttcactgatgttagcttttaatggcatggactcctttatgtgctaagtgcactgcttttgttatggagccaatgggcagtactactcatatttgctaggcaaaatgtgcctaaagactttcatgtatggcttttgtatagaccaagcttaatggcagtggcagtaccatgtgtggcactggatgtatggcactagttgatgtggaatggcagtgagtatttctggaatggcttctaaattattgctgtctaaaattttgtttactgtccaacatgcttgtaaatgtttgttgtatggatgtatgccagtttgctgtctgaaattttgccaaactgtcaatttgctgtctgggcaaattttttgccaatgtttcagacagcaaaaatttactgctcagatgccaacatgctgtccaattttttgtctggccaaattttgccaacatgctgtccaaatttttctctggccaaattttgtcaacatgttgtccaaattgctcagatgccatatactactgcaaatgctgtgcactattactcaatgccatatcaaagcaacatcacagagtactgcaaaaattccaattgctcagatgccatatcaaaccaaattcgaatggctgcatttcatctgaaaaccatactacattcattaattccacagggcattcataagttcaacattacattgcttccaaatactaaattgcctattacagtccatattacttgctaatgacaactaccaaaatcaacagtaataataaagcttgcacaactccaaggtacactaaaattcgtcccactccttcaactcccttcatttttgagccaacaatccccatcagtggcacaatggacatttgcccaagggcaactcgccaccaccacggcgccgtaccactgaagatgacgccgagctgtccatcgccgcaccaaccgaagccgactaggccgccgtcgccgccgtcctcaacactgccgcctccgccgccggccccgccaccgccgccgccgtcgctgccgccgccgcctccgccgccgccgtcgcctagggttaggtttgggaatggggaatcgggaatcgggctgtggagggagggaggatggaaacagcgccggctgggtctggttcgaccagacccagtcaggcttagaggtagcggcgcgcaggggtagattggtcatttagaaaattttctgacctcttttgcctcggaaattataaaatattgcctccggtgtctcacagccaatttcacaactttcgtagtgtccgtgggcaaagccaagattttgtggtgtcccacagccaattacacgattttggggtgtcctgtagcaaattttcccaaataattaggactaaatattaatctttagtcccggttggtaacaataaccgggactaaagacagtgggggtctgatgactttttaaatcgggactgaaaaaataacaaaccgggactagagatcaaaaggttcccttcggctttttaagcaggactaaaaataatcttcagtccctgttcctattcgaaccgggactaatgtgatttttgcaatcccagcaaagattacttctctagtagtgtcatgaatgcttaaaaagtaatgtatattaattatactccgagatcaatatatatgttttggtttgttttaaaatggattacctgacatctcaaacaaacaaagaagtgcaaaaagttttagaaagttctaaattttataggtttttcttgccacgattctcaaaatgttacaaacaattccatctattatatactaaaatccattaaactttttacaaacgctctcaagccgcaatggaggatttctataaacactcctaaaccgccatgtggcaatataataaattagaaagattctaaatattctgaaaataatatcaagtgttgattttcccttggtgaacccactaattaaattgattagatctattatgtttagaaatagttgcacgtacgtactccctcccctcccgtatcctctctttcttttgagctaacctcctattttctagctaacaattaatataaaaataatttaattagtatttcttaataattgcataatttaattagtatttcttaataattgcatataaaaaaattaaaagaaatatatggtacatggatgcatattctaacactatacatgccaaaaaccgatgtgcaaatattagagaacaatttaatatgttaggattatcctatcatacaattcttctgttccaaaactaaaaaaataagcatatttaaaatagtggcatgtcaaacatgttaaacttaatcaacattaccacatacatactctaaaaaatcgtagcaccaatgagtatattacacacatgtaacactattataaacaaatccccaattttaacgttcaaattcataaatttgggggaacaatgggttataagattaccgtccgatctacgaatttcaccgattaaaacgaaaaaaagaggggggaattttttagataatggaataaatcctggcctttacttcaaagaagctgcagccacttattacaataatctcataaagagaataagcattcaggcaactacataaagagtgactaaaaaccaacacaaaagacaaaacaattattgaagtctatttgagagggggaatggaagagtatatcttgctcttcgatgtcttgaaagttcccgcaaaaaatggctccaaaacgagtcgaattgagaaggaggaagtgagaggggaaagagagcaagaggtattctcgggctcgagcatgggagaaggggcaaatgtgtggggagtgagaggggagggggtggggcccatgggttaagtgctacccccaccccggagaagcgtgcaagaggcgctagcgccttggggtggtggggggttggcgccagtatggcaggcacagctctattggatgacaacatcagccactctggcgtaaaaaaaaggatcatttctaaaataaatttttttagggatctatttgtaaattaagtttttagaaagaccaaattgtaaaaaaaatccagcatctcagacaccgtacgaaaatccaaatatacttatactttagagagtgagtattgatatttaaatatataacaaatagcttaaaaataatcaatatcgataaagaatatttttcaaaaaaaatgtacgattattaaaggtacaattttcgatagataacgccgttgaatttttgatacatgttcggcaatttatttatattaaaaataaataattattatttattttgttgtgacttggtttataacttgacttacattttcacatgtttgcataaaaacgttaaataaaacaaatggtcaaatgcgtttgcataaaaacgttaaataaaacaaatggtcaaacacgtgtaccttccgtcaaaaaccatgccgttgaatgcataagagcaagtttaatagtatagcctactactaactctaaatcatctatagcc

SEQ ID NO: 18269 - DNA, 702 bp, Oryza sativa
gctgtttgttgccccagaggaggacaacatggagacgatcgtcgcgcatgatgccgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaagagtagtatagattcttcttgtggaacaagaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaacc

SEQ ID NO: 18270 - DNA, 6680 bp, Oryza sativa
atagttggcaccagcctccattaagaaatttaagcactcagttgaaccatcattgcccattgcagaatcaagtgcagcagttgagatacaatctgagttgacatcagcaccagcctatcacataaaaggaatgtttctttaaggcgaataatgtaaaatttaaaggcttccaaactgaagtgtttgaagaatgctttaataaagtaagcaaccccagagcaatggtagaacttgacaaagctaagatgaggtacaatacctgaaccaggagcggtacacattccactgatgaaacatttacagcctgcaagaggggttgtcatatgatacaatccaaacattatgtacgttatgttgcactagtgagagatgtgaagcacattacttgctattaattgattataataactggatggagaaaaatatcaaacagaaagggtaatatacatgaccatatatctatgccaagctttcagtaaaaaagaaggaaacatttcccgtgatattgcaattttcaaaaacaaataagcacaatgttgcatagctgccttattggtcaactcttgactagtagatttttcttatttgagtgattgattccacatgacacttacataggaatggcaacatgatagaaaatcaaccattatggcaagtgcataaaagggcaatgcacccagaagaaatcgtcccatgcatgcaattggctctttgaaaaccatacatacatgaaagcatgcataatagattttcacataaaacaatagtggtgatcccagttaacattaaacattactcttgcgtaagaatggagattataaagctatagactggactatagctttgagaatacatcgttatggatttaaacagaagcaatgaagtatttctgattattgtaacagctgctaccaaggagatcttgaagaataacatgtaactagaaaactagacagctaggaacaaacatttgaaaatttaattgtgctgcaaattaaagagccatgatcacatttcacatcttaacttacattgcaccaaaaaagcaaaacaacgtcaagggatgaaagtaccaaagagtaactacaatggagaatgagaacaacacagctaacaaacaaatgaagaaaaagcaaatgttcaaacttagtttatgtttacagttgaacatgcaacttaaggcagaagtagcatgatcttaagcttacatctgcattatgatccaataaaaccttcatagcaccgacttgtcattccttagtagcaagatgtagtggcgtcccacattcatcagctaccggatcaatatcagccccctttgccagcaacgtttctatcatttcacaatctcctgcatacaagaagcaatgatggtaagttttttttttcctgaatctttttttcttaatttgtatctggctcttggcagacctcagttttccctgcatataggctacaaagatcattctaaaggggttaacgtttcatagaaacaacaacaatccctactcgccaagtcaaagaaattgggtggactgataactgttgaaatcaagcaaagggggacattttggatgtggacatatttttcacacaccattgaataacaaaagaacacttatttgattaaaaaaaacattcagagaatacactgcctgccatagacattgaaatgtttaaggctgagttcggcacttcatgttcccaactcatctctttcattttccgcacacaacggtgtgttttttgcaaaaaaaattctatgcgaaagttgctttaaaaagtcatattgatccatttttcaaaaaaaaaattagctaatacttaattaatcacatgctaatagaccactccgttttgcgtgcaggagggattaattcccatcctgcactaccgaacacagcctaaggaataaggatgttgtgaatgatagctcaacagaatttagctatcagctttgaagataatctacttccacactaacataagggaaagaaatataaattgtcctggaacgaggtcaaataaaccttagttagaacataataccgccgcctaatatattacaaacaaaaggaaaaaaaaactgtgaacctgtggtgcacgcgtgtaaaacagagatgcatatgaatagagaggacctattccagcagcggaatgtagaggggttagcccgtcatcatcagctttgtctggatcagcaccatgatcaagaaggtacttgacaatagcagcattttcaccgatcaccgcaaaaactagaggtgttctacctgtcatgcacacagatcgatgcaaacaaattcaggatcagaaaagaaatgtacatctgaaaacttttcactgggcatcatatttagaaatatgatcagcaagattacaaagcatggaaccacacatacatgaaattcaggaatcacatgaaatggaatgtggaagggcctgagactgtgtttggaaaaaaggactaactatttcactttaaaagttctaacagacccgtaagtatgcagaatcaactgtaggaaattaatttccatccccgtgagatgaaattgaagtattaataacaccaacgaattcttttggggcattttcgcaagtgcgagtaaccaaacaatcacagagaattccctctcaatcggttacatgtttgtatctgatagtgataggaaatatttcattgttgaacatggcatattttaatgaagcatacgatgatgaatgaggataacataacaagacaatgaagagtaaacccatgcttatcattttgtgctttttctctgctaggaatagacacaatcacacaaaatttccagcgtcccgtgaactcatcaatcatatctaaaacctagtacgtatcaagcaaccgatcaacttaattaattacacaagtatatcatcttataagttgcacgacagccaatacactggttaattccccattgtgcaatcaattaactattttcccccaccaaaaaacacaaaacagagcaggtttttagattcacaaatcctaaaatgccagcacaactaactacggatcaacaaaacagaaacataccctcatcatcggcggcgttcacatccacgcgcagcccttcgacgaggtagcggcacacctccagctgctcgttgcccgcggcgagctgcagcgcccagatgccgccgtccgtcctcgccgcctccaccacctcctggaggcggcccctgaccttatccagcgcccgcaccagccctgcgcacattcaaaagcaattccgaagattaacgccacccaaatccccaaaatcgcggaggctgggggtgagtgagtgagagagtgagcgccgcgtactcttgaggtggcggaggtcgccgctggccgccgcctcgaggagctcgtgctgcatcgaagcggccgcggctgtatagagagagagtgagcggatttagttagggtttttggcgtacgggtcaaggcgcggggaggagggggggtgggggcttaccggaggaggacgtcggagcggcgaggcgagatcgccgcgccgccatggcggatgggtcggggaagcgcgagggagtagggttttgcgaatgggggtgagactgagaagaggagggtgagagagagagagaaaggaggcgaggtggggaagagagaggcgaaaaatggttgggcatttgatttttgaaaactgaggcgagagaagacgagagagagggcgtggaggaggcgtacgcggcaagccagcgcgtgggacccgcccaacccctgtaactgcggacacctggaggcggtaggccaaaatgcccaaccgattccatcgtttcgtctaccagtaacctgtgcacgttactgtgcacgtgtagtacacgtcgtaacctgtattaaaattatattatttttaaaatcaaatttatagtagtatataattaaaagctacgacatacatttaaaaaatcaatatactttcacttataagtttgaataacataacataactatttttttttgctatttagtaccaaggaaatcctcccaatcttgcatcataatacttttatatgaattgagaaaatatgaattgcgcttgaggtatctttaatgataatgaaacaagtcacatatatacataactttttaacaaaattatcagtcaagcgtcatgtcctacaagtcaataatattatatattttaaaatggaggaagtaatattcatgcatcaaagtgtgactgcaatcttggatttttcatcagcctccttgaatgagcaatatagctgttagaaaaacttaagagaaataaaatttgctcatgttcagtataaaatttcttagaattttaactgttccctatcaccctatgtgccaagggggcaagaagactaaagggaatgccttggttaggtataaaactgctcggatttttgtttaacactaatttatttgaaaattgtaaacataatccctttctcactccatgccaaattttgcaaagaacaaaatataaagtcctgctaggttgctatagagtacaaccaattcaacattggtaacacttgatgaattacaacagctagacagctagacgattgtaagggtacaaaacaccagatgagaaaaaaaatagtttaacctaagataatatattgttcaaaacatcttcctcatgtattgcctttctccaactgaatcatgtattctgcactttatgaattacagtattgatatccaagatcctagcatggtcaattggatcaccatggaaaagttgtttccatttcagtttcttaacaatgagtttccctttcatttatgcctatgaagacatggtcacagactaactgtgcccaaaaatagttttatcactgccctatgtttttgccttttgctcttgagcagcaacctgatttttttttcaatctcaaacaataaaagccacaaatggataaattttgatttaacaaagttcatataagtaatgaaagctccttatgacagaccatcctagattcaaactgtagctattagagcggcaatcttgtgagttgtgataagaaagtgatctagctagctgcatacaacttccaacctgcagataggactgaataaatatgtaaccctcttttcaatttggcaatttagaaaagtatgaactggcatatgatgaacatcaagagtttctccacaattccagatttgcaacaaagtggacatgcaggaacggaggaatggcaacgtaggtgaaaaaaaaacagtagtttttttttaaataaattcagctgcaaccaatcaatagaatatcagtagcatagtgcctcgtaaaaataaagaattgtaaatatgtaccaatatgttcatgtgcatagcagaaaaatgttgggctacttctttatgcgcaatcaacacaatctgttaaatatatcatatatgtcaactctcaggtgttctggagtaaagaaaaactctcagattgttcaagtattacatagcatggagttgagctgatcagtttcatgctgctaattctaacagccattattgtaagaggaaatacctagctagtacgtatgcagcaggaattctagtgacaagaagtatatagtaaaatatgaatgtcagatcatcaaatagcagagctgagatttagaaattacctcccaacccagatgacaagtactttgaagaggtgagtccaaaataactactatgaaacttgataatgttgtatcatacaatttaagagtaaattggagagatagtagaagtgggaagctaccaaggtattttggacatgtagctcttgtactaattttgcccaaatcttaatatcaccattaaaggaccagaagaaaccatgataattacgtttagaatcaaacaatcaactttggtattgaatctgcctcagctaatggcattcctccttttgttggttctaatggcaaagcagcgggataaagcaatatcaaactgcaaattattagtggtcgaagaaattagaacagacaattaagagtgcatgagtgcatcgaaggaaaaaaagaatatggcattccatatttcaatggtgaatggcagagaaacaaaaacataccagtgggctttagctcgtaatggaataaatcaattaacttgtaatactgtagacaagtggtgttattaacttccttggatttgcaactcatgggaatgcctggacaagaaacatattatcaagatctcaaagaataataattctttcaatgcacatcgtctgttttctttccaaaaaaatgcaaattaattcttgttagcaaaatagagaatgcatctattgaattgcaaagggataaatttctgaccacacgtacatataccttcctaatcaagatttctccgataaaatcctttccaatcattattgatccaataaaagtacaattcccagcgttgctccaataaaaccctttccaaactgccccgcaaaatactttcccaataatgttttaaaacattttccaaacagctcccgacatatatagccttctcgacatcgacgcaagtaaacaatttttgctcattccataataaaacagatttcagtcatttcacaatgattcactatgacgtatcaggataagagcacattcacctacaagaaaacaacgatggcaactataacaacaaaaactactgaaccaccattatg

SEQ ID NO: 18271 - DNA, 1767 bp, Oryza sativa
ggagcagcgtcacaggagcgaggcgtggtcaacgcgcggtcatcacgggagtcacgtgagaagcaccggaaagcaggggtgggcagaaaaagcccgaacagaaaagatcgagaccgagcccgaaaagaccgagaccgagaaattcggtcatcaattcggtcctaggtagtgaaagaccgaattttgtttggtcaattcggttagtctcctcgggtaaccgaatagaccgaaaagaccgaattaccaaaaaatgtctaaatgcaacatacaatccactatgtttaataagattaaactctaattttcacatcctacttcttctagcatgcaacctattaagagtctttactcataagtgcttacgaattttttttgtgatttttgtgttgaaaatttctattgtttctttgcatatatgaaaatattattgaatttcggtcaggaccgagaccgagaccgaaaagaccgaggccgaatttgtcggtcctgacattttttactgaaattcggtcttcacttttcaaagaccgaaaagaccgaaagaccgaagaccgagaccgaaattttcagttagaccgaatgcccacccctagcaggaagagccgtgcaaggatcagcgctcattaggaggacgacagaacggattaggatagaagatggacggtccggattagtagatagatgtggacggatggtagggattgatccaagtgaattggctggtaggattggaggggggcaactcctcctttttatattagtatagatgaattgaataagcgaaacggaatatttataaacgaaaaataatttgtaaataaaacttttaaatatgtattatttgtgatttagaagtaaagtatgaaaaataaattatgataaaaaaccttaaaattaacttcaaatttaaggtttgacatttaaatttcgtcttataagcataaattttggctgcaatgcagaatgagtttgtatcgtcttaacattgcatagtaatggcaggggtggcattctctccatcctaatcatccacacccaagatcaatggctaataatgtagtaggttgttagagcaagtataattggaggctataagtcgactaaatgttgagatgaaggagagaagagaggagaaagaggagaagcgggctataaatttatagccggcttgaacacaagaaccaagaaatttgggccatatattaattgtaaatactattatatatgtgggctaagaaaagattgcaaaaaatattatagccaacaagttagctatattattagcttgctattattgaagtgcttgttagttatccaaaagctcacgcttctttgtttctagcggaaaacctttttaccgctctcattcttgccgccaaaacatgagacggtccacattccttaatattagttggtattactatcgtcaaacatgtcaaaccagccacatattgcaatacttagattgaatgaaagacaccaacaaaaatagagacgacttgcagtgcgattcattctccattagatggcaaggaagttcatctcatcaacaatattctgttccagttgttacatctagcaggtaagcaatataattctttcacacgatcaacagcatttgttccatgtgaagaagttttctatgttctattttctacagagaagaactgcagcatgattcagtatgatgggcagcaagaagattcttctcttcaatctccctgtcctgtttctacatctaacaagtaagcaatacaattgttagtt

SEQ ID NO: 18272 - DNA, 1174 bp, Oryza sativa
ttcctgcagccccgagaaggaggcaatccggtcggctcatcaaacacagatgcaaattcctacaataagttagcaactgcagctggcatagcttgctctactccctgggattcaacaacacacaattcaactgagtgaacaatagcatgacgatgaataagtcccttcagctgattaacatacacaggaggacaagaagtcacatctggtaacaccccttgcaatcgcacagtgcgattatttagctcaaattgcaattgtttcctcttccaatcaatatgcataggactgtgacgttccaaccaatccatccccaaaattacttcataacaaccaagaggaagaatcttaagatttgcacagaaagactccccttgagtccactattgacaatcaagcatttcttccccacattgcaacagacccccatcagcaatacgtaccgtcagtggcttaacagaacgacgacaaccagctaaccgatcagccaattgaacactgataaagttgtgtgtgctactcgagtcaacaagcatgagtacttcatggtgctgaatcaaactctgcaaccgtactgacttgggtgactctgtgcccagaacagcttcacgagaaatagtcaacagagcaccctcctgctcaccaatttcttcaggttcagtttgcaaagattcagcagcaggttcatcagacacaggttcatctacagaaaaaagttgcagcaattcctccacaacatgaagttgaacggtgggtccacaacgatgctcgcgactccaccgctcaccacaagtatggcagagacccttagctcgacgatacgctcgaagagtagcaaacttgtcatcaacagggacagcctttgagtcctcagattttacacaccagctcccccaggttgtcgcacaggttgattgacgaccggaaccacccgagagaaactgcgagaagtcctagaaatttcatgtcgtcgcctatcccgacgaacaacatcaagtacttcctcctgtaaacaagccaactcgacagcagtatccaaatcggcaggccggtgaagcaaaattgtagcgcgaatttccccccgtaacccttctatgaattgggtcacaaaaaaatgggtgttccacgaagggtgatgagcgtgcatcccatgcatcaactcattgaacttctc

SEQ ID NO: 18273 - DNA, 14666 bp, Oryza sativa
cttcgcgagctgctggacttgtgagcgcagttctcccatctcgtcgcgtaactctgccaccgtcttctccaccgttggcttccatcccaccaactcagcaaccatgggcttgatttcttctattgatcccaccgaagtctggattgcaacattatgtttttgaatcgcctccatggctgccatgagatctcccaactgctgctccatctcctggaccttgagttgagcacgacagtggtagcgtggcttctcaagatactccagggccgattgctctgataccaattttgtcacaacctctctcaggaatttgaccgagcacttggggaggaagagagatgaacagagggagagagggaagaagcagaggttgttggggattagtttttctattttcaattcgataactagctcgattacagcatagcctttatatacacaggctgaacactcacgccacccactctgcccactgacgcgtggattgggccgcttactcctactgggcctaagcttaacagggttggtaacatttttataaaaacaaagtacttccattttaactactgtaaactattttccttagtataaactccatttacacgtgctaaacatcagtagatagttgatacagaatttcagagacgggtcttggtatgcctggacaattaagctctttagggataacgtggcagctaacacctagtttgtccgaaagctgcattattcggtacaagatgcgctgccgtggcccgtgaccatttcttctacacatcgcaaccaatcctctatattacacacacacgtcctagcagaatctttaaaccgtgtaaccttttccttcatttctgatcccctttttcatcccccatttgcacataaccaatgtattttggtctacgtattttgcatcctagaaaatactgtataagacgagcatcccaactactcccagaaaccaaaacaaggaatcaaatcaaacaaatctgaacagaacaatacatcattctgaaatacgaatcagtttggtcggtttgggtagcttcatggatcacccaaacaaagcttgaccttgccaactcccaacttccaaagtactccacaaaactgcttctgcttaagtattctagttaacccaagattcgtacaccatgtcattagttgtccttaacttgccctagctgcatcatcttcctcctctcctccgccattgccgcttgcttcactcccccgcaactctcctcctacgccactcaacgcatccgaagcccgcgccattacatagctgcgcgcgagctcgccccgatcttggtgcatctcacagcgcggcggacacgatggagcccgtgacggcggcgtcggcggcggcggcggcgagcgaggagcaggtgacgcggcgcgtggcgagccggatcatccgggcgctgcagcaccagctgcggctgctgcaccgcgcggggcccgagttcttcgtgctgggcgcgacggggaacgtgtacacggtgacgctggcggcggcgccggcgtgcacgtgcccggacccgtccgtgccgtgcaagcacatcctcttcgtcctcctccgcgtgctcggcctctcgctcgacgaggcctgcgtgtggcggcagtcgctccgcccgtgccaggtggcgcggctcgtcgccgcgccgacgtgcgccgaggcggacgtcgtggcggggccccgcgcgcgggagaggttccaccagctgtggtcggcgagggccgccgccaaggccgaggagagccgccgccgccgacgacgcgacgaccaggccgccgcagccggcgcgtcggggaggctcgacggcgcggcctgcccggtgtgcctggaggagatgtcgccgcctggggcggcggcggcggcggcgatgctgctgacgtgcgcgatgtgccggaactcggtgcacggcgagtgcttcgcgcggtggaagcggagccgggggaggcgggcggcgacgtgcgtggtgtgccgggcgcggtggcggcagccgagccgggagcaggagaaggagccgtacatcaacctgtccgcgtacatgaacgacgccggcggcggcgacgtcaacatggtcgccgccgacggcgacgacgggggactgtgcgccgggtagctcagttcggtgacgtcagctgacgtaaacgtgacacggatgtaaattaacgaagttgtacattgtatatagtgctaacaatctcaattcgttgcgtttcatgacatttttttcgttgtttttcgtagaggctgaccttgctacttcagttattcatataatcatattcctgtacataattgatatgttaataaaaggaacatttattttaagtcactttgccttttaatgatttttgtgttcacaagctgacatgaggcactactctgccgtcgaatctgaatctttatttaaattttaaatagctttgtggtagaggagcaatacgtcgaacaccttccagacaacgtgagaaaacgagcaaaaaacagaggaaagacagagcaaggcacaatgctgtgaaattgaacggcgaaacgatagattgacacttggtttgtgctgccaaaactgcatagtttttttttctagttctcattcttcgtgagtattttacagcaacaatttgtatttgcgcgccacgaactaggatttgtttggtttggtgatctgagtgaaattatgtggctctgtttgttttgatctagaattaatcctctacaatctcatagaaagaatttacttcttttggttccaaatggctcaataggaaaaggaattagtggggtgctgaaatcataaaatgtttctttcaattttcttcaacacttccccttagttaagatctaaaagtttctgaaatcataaaatgctggtgttctttacaaaaatgttataattttgtttctaattatcttgtcattcacaaagtgcagttatttaaaaccaaggaaacgaatagacctccaaattttgacattttcatcttccattttggtcctgaactttgctatatatatatatatatatatatatatatatatatgatcggaaaggaataacagctcttctagtacttaacaataagcacatgtgcatacattttgttcatcatttatttattgattacaagattaggagtgctactcctccaatattacatgcatacattacatatgtactccatgttagctgaagagacagggccaatctcaactctctccatgtggtgaaaatcaatataatacaccacaaaacagaggtaaacaagagccccatccaaaaaaaaaagcacctaaacacactactaatcaaagggtgctcatgcatccactaacctatctagctagtgagattacattttaatattgcacccccaaaacatagttgacactccatgcaacgaatcacatggagtgcaaacaaagcaacaagctgaagctacccaactctgcaaaagcttctatctaattaagctagaaaagatgcagcaaaaaaacacacacaccccaaaaatcaagtgtgtaaaacatgctccctttctagcctaaaaattaagaagaaaacattaagcaaagcttaatttatgcttgtagccaagccaaaagctaagtgaaattaaaaaaaccaagaaactctctagttgatgttgacgcgctggctgaactcgtcggtgatgaacggcaagcagctggagctgcgtgcgatgccgccgccgccggcggcgccggcttggcgggcctctcgggggttgatgctggagcgggagcgggggccgagcttggagcgcttgcggaggatctcgcgcatggcctccgcctggaagagcaccgggtgcgtgcgcccgaagccgttgaagcgcttgcacacggcggtgtgggcgcggagcgccgcctcgacgccgccggcgccgccgcgcctcgccgcctcctccgccaccgcctccgcgcacagcccgcacaccagccgccccgcgaaacgggcgcgcacgccgcggatgtactccggcgtgcactcctccgacatgccgcagcactcgcaccgcgcgtcctccacctccgcgatgtcgtcgagctgctgcttctgctcggcggcggcggcgtcgtccaccatggtggtgcccttggcgccgacgtggtggtggagctcgtaggagacgtcggacaccgtgcgctgcagcgcgtcggaggacgtcctccgccgcttctccgcgttgccgtcgacgctgacgacgccctgcatgttgctcgccatcgcgatgaacggcgccgccatcgccatcgccaccgcgcaaacctctctgcttggagccatatgggcttatctcacaatcttcttcttctacctctcttcttcttcttcttcttctaccttggcaatgtagagttgtgtcaagaattgcctagttttgcttagtctttttgctttgtatgataaggagctcgagagcagaatgcatggtggttatttatagaggttttctagggttgatgaacttggcatgcatccaacaatggccatagattatgtcaaaaaaggtgatgtgcaaattgctgcgtgtaacttgtggttgctacgtggtgatgcatctaaagtcattgcaaattgcaacttcaagatttgatagaaaattaatgaagggctattagttcatatcatatatgcatctttttgtcaagtggagatgttactggtaggtttgtaagcttatgcacgtgatgatggtgtgtgagtttgggagaatagacagcataaaattaattaaggtgcaaaatggccaaaaaggtgattgtgaaatgtagccaattgtggttgcggtttagatattgctagtaattttgatccgactttgcattttcaggagtatgttttcttctttgtcggggatctgttttcttttcttttcttctttttgtcatggtttgaattttctgaaactaatttcctaccatgtttgagactcttggcatgactgattaattcaactgattgattttcaacagaagttctgtaattccattaaaaaaacaaaagttatataaacagtggccgatgatgctaattaaaaaacaataatggacaacgaataatttctaaaaataataatctttatgaaaaggtaatcattaattgtaagcatgcatggccagggttcaatctgaagaaaacgcatgaagagaagagtcaagtagttcacgaggagctcgccaagagacatctctggaaggtagctgtccagactccctccgctgctgatcactgttagttgtactacgaccagtactgaactactgattagtggttgctgttctcagtagcttaataatcaagattcagattaacgaaatccagaaggattccgagatcagatatcgatgctagctagctactgtgtcaccctgagagaagagatttagattgtattaggtacctttttgccagatattagcactggccagggattaaccacataccgttcaggttgcatcttgtggctgttatggtttcatcagttctcatgcatctctgatgggaaagtcaatttgcttgtttgcaatttggacactgttaagtgcaaatgtaaaacagtactgtctaagaccaaacaaaatgaggatttagctacttgttgtcattgactgaaccaatataattagtccctgtttcttcagtacagatcccatatatattgcaacttccattggcagcccagaacaaagctctacacatccaacaaattttaatttgtcagaaatattcagagttcaaggggggaaaaagggcaagcgataagtaagtgataagctatcatttgaactctctcatctgcttttcacaaaaaaaaaggcatcaacttatcataccaaatacatgcataggccttgacccttatcagctttttttcagcttcatgtcattttctcttgatcagaaaaaaaaagtagtaataaattgaccaatcttaatcattatagcttatcaacttggatgcgcagtaactgcgtaaagcctggagcttcacatgctgaactcatccagccacccgatcggtcgtatcatatttacagtttcgtcaggtttcgtttcctgtatctgaaactgacgtcgcgtctcggctgtagccacgggaactgtagatattatgagaaatggatgcaggttggtagttcaggtttatgtcattgctgacatattagatatgcagtgtctttgtcagttgttaattactgttccctagcattttgagggcatctgaatgcagacatgaaacatatattgtttgcttaatgtaaatattagtactatagaatgtttgctgttgaattcttacatgaacataatagtttagtttacttacatgtttggttgaaattgggaaactatttgcacgtataggaattcaaaagtgtttgaacttgaaaactctcaaatcatttgtgcaaatcatctgtccaaatgctttaagatgtatcggaaaattttcgattcaaaagcattaaaaaggatatcgaggaaatagtagtaccacaatagcagactgactaccagtgaagaagcaggtaaaaaaaatgttttgcaagctcagacagtcagaatttcacatgaacttccgcgtatattatactgaattcatgaatagatcactatgcagggtttgagtgtctcggccaaagccacacgagtcaagaagaaaatacattcgatagtcgattgtctttctgagcacggatcacatagagtgcactattggcaccaaccatacatttgctatgagctaaacgatcgtaacctcaacctgaaaattctatgtgcagtagcccgtctaaattttcagggataaatccgtataataaacaatgttcatgtccaattggttgttgtatcactgggtttcagtcgtgccagtctgtttagcgccactgtcatttgagccgttcgacccagagctgccatcgccgacttgagattccttctgctcggcattggtggaagcactggtttccatcttgatatccacctgctcaccattgttagacgactctgtattcccatcattctggttctccacaggcttggtctcttctgaagagccatttgcagcttctgcagcagacgcttcttgggagttccctgcctccgtgtttgcagcctggtcattagaaacttctgctgccacattgccttcatcagattttgtttcgtttgaatcagatgcctcattggctgagcccttgtcatcatcaccagatgcagtcccagatgattttgctgcatcttcattctcagatccagtctcaatgtgaacagcctcgctagaagcatcagatgtggtggaagtcgcatcactttgtgagttctcattctgccctgatggtagattacctgtttcatcaggaagagttccactggaatgctcatcatctgttccacccttcgcatcatcggacagagattcagaagcattttgagaatccactgcctcttttttctcagcttcctcttcattagatccgtcacttttcacattggactgatcttcattagtagattcatcaccatgtgcaacttcttcatggggcattctgttcgtctctgcactgctttcctctaggacagtattgctttggggcatatcatctccagttgaatggtcttcacctttactctcagcgtcagatgaattggactcagcgtcactcttctctccttctgagtgattggtcgttccatcctcatcattactattagcttctgtattcccatctgcactactgccatgcccttcaccagcttttgatctgtcagtgtttcttatatcatcatcatgagagtcagtattgtctttctcaaacacagtttctccaatgttctcttcgtctggtttgcttactacatcagggttctccccacccttttccagaatgccatcaccataactacctcccctttctttcctcccctggaacatgcttctatcatcatgggcaagctggttctcagcatcttccaagtactcatttttcttatcataggaatgtttcacctggtacataagccagacaacaacacctagaagtaaggtagcctggagtaatgttttgactcttgatcctctgttcctttggtgccggctattcgaatgatgaagcatgtttacggcagctaaaaaaggcaaaagacaattgtcaggttatgagctgttcaattctattatatcagtataatagacaatatatagtcaattagtaaacccttacatatggtacaaataattagtagttggatagtatagtgtcaaccagaagtgcttccatgctacacctctggaattttgaaagctactttgaggggaattatgtactgatgcaaagatagagaacaggagatgctcgtggataaaacacctatccttgtcaagactaccaattacatgctgcgactacaaccaaaatataactgggactatagctatgtgctcatagtcgctaataaacccaatcaaactgtctcaagagggaccatactgaatacaaataagtaaataaccaactctcagtcttagtactacactgcccacagggctcaccacatctcctagactgttctgacaacacagagctctatatttcaacaaattcatgcatggcacacagcatctggggattgctttctgatatgaacagaagcattacaaacgctgatctaaagtaggaatgaataacatgttagcatttcagagagtggtttccatccatgttgttacaaactagagaaagacttgcatttgatacaaagagttaagtctttcagataatgggaggtaacaatgactagtagaacaggtcaagttctaattgccagggttcaggcgtttcaatcaggaagaagggattggtcacagattagtctccacttaagaatatcatgagactagtacctctataatctgaagtaacaaccattggatctaaaggtctagtgagagcatagaagcaattactatttactagcagtttgtagaaaagaacatgctctttgcctttggcacgaatgagagaacgaaatattcaattttagaagggaaaaaaaaatctctggcatgccttcaaaatgggcgaaagaaagtctaacagcacaaacaaggcctagcaaaactaaaacacaatatcccagatacattgtacacttcgacacagtgaaatgggaaaaaataaaggtagtaacagaaattggttgctaagaccacacttgaggtcagcatgaatattaaatgcacctcacaattcccctttcttgaagcaacaatagagtaagtaaagagcacatatgacatggaaatttcagtgtaagcgacttctaaaccaatacatataataatcagaagccaaaaacaaaggacgtccaacattcggttggtaagttgctagtgtgcaccttcaactgtcaggttattactgcaaccaagtgtaacagggctaagatgaagtgatcttcagtcaactcagggctttccacactaactagtactagtagtatagtaatatgcagagatctgaaaggtgaacaaaaccactctggatatcagatatacaatacccaagaagaggaagctagtttgacggatcgatttcaccaagaaccgacaaatatgtcactatctattttggatcccccgctgcaattgtcgaagtcccgagcagtgagttccatctactgatccagcgatccaccacccccagttccgtgattccactaacccccaaaaaaaaaacacaaatcccgttcgggcacacgcttgaaccgaaacaaatctgatcccgaattctggttcgcagcggacacggcgcctgcgttggtgaactacccaacccaacccaacccaaaaagaaaaaaaaacaaaaaaaaaaaacaaaaccattccgagatgcggcagcacgtaacgacgcacgctcccccgcctagttagagcgccaccggtgctcgccggcggcgtacggcacgcgcattggcaccagctggtagtagaggggtaccactaccagcgaaggcgacaccgagcagccggggggagcgggaggtagggcattggagcgcgggaaaggggggaggaggaggggtttacctgcgggatggggatcgcggcggaaggcggcggagggaagcgggaggcgactgggggtggactggtgtcgtcgtcgtggttggttggaacttggaaggaacgtgggtctaacgttgaaggtggtgggtggcgtggggtttagatctggaaactagtgactagtgttgggtgggggcgcaccgcacctgcgtgctttgcctttgctgctcctcgcctccatatcactcttacaaatactcgctccatttctaagtatttatcttcgtcgacctttttaaatatatttaaccatttattttattaaaaaaaattaattaattattaattattttcctatcatttgattcattgttaaatatacttatatgtatacatataaatttatatatttcacaaaagtttttgaataaggcgaacggtcaaatctgtgctaaaaagttaacggtgttaaatatttaaaaacgatgggagtattacttaaggattaattatcggacccatatatcatagacacatggaggatccacatgttataaactatgaatgtcaaattcttaattatcacatattaaaagtgacaaaaaattaaatgctcttcacttgtgctggtctagctagcaactctttctttctttttcttaaatatctaaaatgatgccgcaagtttttttcatgaaaaactttaagatataactatagtaaaattaaagtttaattacattgtaactacactatagttacactctatagttgcactgtaaattatattgtaactacgatataatttatataaaacgtgccttccattgtggtttggttggctagcaccggatcttacttatggtatgtgaaaattatttgtagcaattttttttacttcatactcaaatctcaagacaatccgatagctacaaatctaaaagttacgggaacagaaaaacttatgaaagttttcaagcattttcatttttcttttgaagtataaattctaatttatacccttctttttaccgcagtttgcatgacaaagagctaaagactatggtatttgggagcttctaacggctatggttttttctaggtcttatgaatctccaaacaatcaggtaatgagaagttgatattgtaaaatctgaaaaaaaaaaaagaagacacagaagctgaaaaacatagcatttttcatcagttgactactcatcaactaatattaagaattttgagctctctaattcaaagaatctattgttgtataatcttaacattttaaaaataaactagaagttagaattaaaaaactaacaactagctactcatcaactacttctcaacatcccgagctctcaaaacaggatgcaaaggtaagtttggatcctggccaaaaaacttttagccggttcttttttttcaaataattaataaatggatcaaagggcgcacttgtcaagtttacccaattattattccaccctaccaaaactttatttttaactataaatctgaatggatacttgtataacctaagtacatatagttagaaataaagtcgtttttccgataatgttttgactttttttttcttgctttcggttttacttgtaacctcttaaactctttttcttaagcgaatggctcaccacaatcttcccttaaccaatactgaattttgctctccatatgtattttttttctttcatcctgctgatctatcctcccccctctcttctctctcttgtactagtagtaccaacgatgaatttattcccactttggcagggtgccagtgtgtgatgtgctggtagtttggacttacaactcgcgtgataattgattgattcccccaaatatggacaggacaagcaggtggatgggggaatgagatgctggatcgggccggtcggttggtttgggctcacaaacacctgcaatggcagtggcgccatggagtcggaatctcgctctcacgtgactagagtgaggaggggtggggaaagtggtccacgcgcgacgtcgggtcgatcggtgccgtcgtcgcccgtccgttgttggcgcgtcgctacccgggaaattattcctccatcggtctttcattaatgctggcaactggcataatgatcatgtttagggacagggtcgtccagattcacttttgcccagcttcaaagaaattaattagccaactagatccttataaaaaataattttacttagagttagtgtattacattgctactacctccgtttcaggttataaaactttctagtattacccacattcatatagatggtaatgaatctaggcacacatatataactaatataaatatttggatttttccggtcgtcacatcgcagtaatcacggattttcgtccatcattaatcgcgctaaactcatccgatccgattcatccgcccgattctgttttggttcggtccatatggaagtacaatacaagcccaaactgatttcagtattctaggtccatctacaagcccatactcacaccaattccaatctaatctatctaatctaatttgtctagaattctaccggttctgatttgtccaggattaagcccacaattctataagcccacacacaccaaattctataagcccatacacaccaattctaatttgtccaggattctatttttagcgccccgagtcagattctatcctggttttcttttagctatttttagcgcactccactaacgtgattgcacagatttttttgcaggctaaaatacatgatacacaaattcaattacatacagacaatagaaataatagatgcgcacaagaaaatatagattgcatagctcttcctcgacgacgcggcacctcaaatacaattacaggcaattgaagatcacaagttttttcgtcgaggacgttaaggcacctccaatcaatgtcgattccaggttatcaataaactcaaccctgaatgcaatttcaatttcattattaattacataaaaggaaatcaacagcaagcaaatcataaaccgtacatagccacatcccaactccgtgtttccgagtttcagaaacaggctttactatttgttgtgcaatgtaaatcaacaagtgacagtgtactactaatttagacttggtttagactggaagtttggaagctaacattccggaaaagtttcagatcagcaaacttaggccagtaacagtctttctgagtactgaccatgctaatggcactaagcagcacagtatatgattcgaattcaatgtcaatggtaccataattctattcaccacatggccgtatcagagtagtggtatactgatttgatttgttcgacttgcatattcagaccaaaccaccaaattgggccaacaaacctcaccggcaatacggatttcacacggtttacacaacaattcataagcactcacacatcaatatcaatatcatgaggtagaattgccattgtgtaaacacaaaccaaacataattgaactccgcgacgaataggcataaaccaatcaatttacaaccagcaattgcgcaacgattagagggggtgtggtaattgaacttaccatatatcttacctattgaccatgtattttcttcctgggctcctggtgtactgccatacccaccatcaccaccattgctgcccaagtaaccactagcaccaggcattccattgctacaaaagcctttaggtttagtaagcctagatttgtgacctgcaagaaaagttttggtgtcagttggaagacgcagaattagacagtgtcaaatactgcatgtgtcctgaaactgatgaaaattacagatctgaatctcatctttgatatgtagttttgaatattttctgaaactttgtgatcacacatgaatgcaacaatatttgatcttgattgaatagtagtcgatgttatactgatatttgaatgtagcctaactatattgtaatatttattgtcagattcatcttctaagctagctgttggtgtgacaccatctggattgacgtccccacccttggatcgtaatgcacgaaaaaggcaaaaagatagggagcggtacgcacagatgactgatgagaagaaggaagaatgaaataaaaaaacgccgtgaagcctataaatgcaaaaaaacttcaagagcccttgcatacgtgaagaaacaggatcaatcaagttcattgcatactacacaatccgaacaaaccaaccatgttgaaataactggtatatcataatgttatgactccacttctactgatgttacacattatatgcttacaaatatttttttactacatttaattttaaataaacttgaaaactatacagatgatttctcccctccactaggcgagtttgaacaacaaatgcaaccggaacttgaaaactgtacagataatttcgcccctccactaggcgagtttgaacaggagatgcaacaaccagaatccactcgtggtactcctcaaccagagggtacaagggcaattgaagaaaaaagatcaaattatagggccgggctgcaggaat

SEQ ID NO: 18274 - DNA, 5133 bp, Oryza sativa
  unsure (1)..(5133): unsure at all n locations
tctaaaattaataaaattgagttatggaatatagtttgttaaaaaacaattaagggaggtcgtaaagatttcgtcagatacaaataattaatcatgctagccaaaaacctttttttgaaaggccgtggcaagagatctaccagatatattaaggagtaaaagagtcaaaacaaaaacaagtattagagttactacatcagagagcagaaacaatgtgagggctaaatgcaagaatacatcaagaacgtttaaaggctagcgtgcgctaatagagtccttagtgattaggttagcaaccatggcatcatctaaagaatactttttggagcactcttttattcctctctagccaaaagttccacttttaagtgatttaggcccatatcatctcctttctctttgtttctagttgtgttgtcactagtttatttaaccatgattgaataaaggcttcggttccatcttggttaaaaagtttcctgtcgcaaaccaaagaccaaaccttctttgtgaaatcacaattcctgaaaaggtggtcggtatcttcgaaagcctttgagcacaaggaacatattcagttacaccgccaatgcgttatgagcgggcagtaagcgctctttgatgcagtgcaagccagccgaagaaatgatgtgtcggctctgcctgtgcgttccattacatagggaagttttcttccactattgattcatagaattgcaaaaaggtaaactctcttcaccgagtatgcttctatgatgtttttaggaaatttgttattaaccactggaggttgataacttacagaagagttattacctaatcaagtattttaaggcaatggacataactctaatggagtcgaagttttggagaagcctattgaggatacttggaccatcattgaagtactttagaacaatgtggtctctggaggaagactaaatttgtattcattcaaatcattttgaagtttgtcatttctttagtatatgcatagcaatgtttgttttgaaattcgttgcatcagattgaattttgttacttatctttgactttagactgagttgaggaatgctagcctgaaacaatcattcattgttagcaacgagtcatctacaagccattccataaatattagatacgcaaatcatcctagtaactaaaaatgttggatatgccaacaatctttttaaccaaaattgttagatacacaaacaatcctgttaactaaaaatgttagatacacaaataattttcataactaaaagtgttagatacacaaagtggtaggcagaaaagcacaacaatgaagctgattatgagaatgggaaagttgtggagataatggtgtcttctttgccgcccgttctcataaacaatcacccacaaaatcaagagaaatttgggcatagttgttttgatgctatgggaaaaatgttctagcattttctgattcttgatcccttatttgtacatacaaaccaaaaatgagctggccatatatattgggcacctagattgtgtgccatgactctcccaatatatgacatgccccatggacaagtcacaccaggcactaatgcaactaaagattcactctggatagcgaaatgaattgctatagtgagcaacatttaattgatatagtcacaatttgagattgttctagatggatgaatagatagtagatttttttattatgtgatgataatcgaggtacaagcagaagagttaactactactcgtataagtcatattggggttatcccatcttcaagttgactttatagaaaaacataacaacagtttcaacaaaaatatgtcatacactagttatggcattttagtctctttactgtggaacactctttttttcggttcacaccatatctccgatgccacaacttttttttatgatcaatttcattgtatttgtcttgtgtttttttaccttgggatgtcctttgatccactagttcaacaaggtttcgtcgccattgtgtgcgcttagaacatcacttctcaatttttgcataattttctcctatatttggcgtacaaatgtgcatgctgcatagtttcgaggttttttgtcatagagctggcagaattaattgttcagccactgacggatttgcagctggtttaccatctttatcttattttatagtaggagccatatattttttttagcattttcaaagtgctcatgccttccatatcagctttgcagctactgaatctaatctcccattgaattgtgttgtatgccgactttgcactggtattccattgttcgtccatcgccatctaatgatgtcatcaacccttctgattggattatgttgttgcttcgtatctgaagaaacatgtcgaagaattccttcatcaggtcgacagtgaggttgtacgtgatatcctgtatccgctgatcgtttgttactgcttcatatatcgatcgactctttcgctttgatcggttgttaaggccaggtgctatagctctttgagtggttgatgactgaccaagttcgatacccagaaaattgctttgcttccctcaccttttccatctcagtttgctggtattacgcattctatactagataaaatttcgttggacattctgtactacataaaattttaattttgatcgttacccattcagtacctgacagaaaaaattcttttaccaaacatatattttctaaatcatacatatataacgtgcaaaattattgttcgcacggggtaacaacttatacttccagatcaacttctaatcatgtcattccatttccaaatgacatttccaaattcttgacaacttatacttccagttcaagttctaatcatgtcattccattaccaaactctttaacactgcaatgtaagttgcttacatgaaattaagggctcacccgaccattacaaatcatgcattcatatgcttatgtacacaacagcaatagttagaggccattgccacatcatatcccagcctactacagcaaaacaagttccattacatagctaagcacatctttattcagtgcaccatcgccgctcgcacgcgtgtcaccaataagcactactgcacccatcggaaacgacttccatggaggataaatgccgccgtgtcacgccaccagccagcgacggcgagcggagcgcgccgacaatttcagccaaaattagcggcagcgatggcggcagcgctggtgcatgtgtcagtcggtgaggagcgagagaatcagtagccgctgtccactccgaaagcgaacgagcagccggctgacccgccggcggcggcggcggcggcatcgacggcaacgtcggggaacatgtcggcgccggtgtagaacccggcgaagtcgacggcgtccgggccgaacgcgccggtgttgtcgccgtcgagcagcagcctcgcgcgcttctcgccgcaccccgcccgcgcggcgtccgcgaacccgttgtcggcggcggcggcggtagcggagccgttgcngtagccgccgccgccgacgaggcggtgcagcttgtcgcggtcgccgacgaccctgaggaggaaggcgagcatctgcttgggcctccgctccgtctcctgcacgcggcgccacatcgcggccaccctgtcgtcgatggtgcgctgctcctgcttcagccggaccacctccgtcgccaccatcgtcatgtcttaatagcaacagcaaccgccgccgtccgccgacgcgtccctgcgcttgccgccgccgccgccgcctcccccgccggcggccgcgctgccgcggcggacgatgttgcgcaggaggtgggtctggccacgcaggaacgacgcgtgggcgaactcccaccgatccggatccaccttgcggaaaccctggtagtagtcgacaaaatccaaacagaatcagaggtagaaagccaaacttacatcgaaatcttttcaaacacaaattttaaaaccacgacttcgacacgtcttatctaattctgtgttcggttctttctatatccatgaggccgatgaacataatcaaggaagaaattaaacgagttactacagtttcttcaagttgttctttttgaaactaagaccgagtttagatacaaagattttcttcaaacttccaacttttccatcacatcaaatttttctatacacacaaacttttaacttttccatcacattatttcaattttaaccaaacttccaattttggtgtgaactaaacacacccttacccttagtttaaggatgtgatagaaaaattaaaagtttgtgtgtaggaaagttcaatgtgatggaaattgaaagagctagacaaaattggatctcttgggtattcccggatgaaatttgtgaacaacctcgaatcacaaacatgaaactatactcactaccgatttcttcaggtgcagagatcgaaatcgtcttccgttggcaaggccagcattaattttccaaattgcgttattttttccccgaagtacagctgagtgacgcaaaaaatgaatatgttccggacgtccatgatttgagcaaaaatcacttaaaaaagtatgcagcacactcaaaagggaaaaaagaacatcagaacatgaatgaattctattctttgctttgttctacagattttagtacaccaagatgtacagctagctgaatttacaacagcgcatatgtacaatttaaggctacaacaataaatgatgggtcccaaactctgttgtcctcacctctcacctcctgtctctccaagtctacaaaatcaacatgccaaccaccacaacaattttttatctcatcttccaaagaatctcccaaaacacacgcacacacgaactcaagaaccatgtagctcagatccatgggccatggccgaagcccctcagaactcactttgagttgggtaccactgagaatccatggcagcatgatgtgaagtgcagagagggggggagtatgatgagacgatgaaatagaactgggagtgacgagactgacataggtgttgagctggcggacgaagctggagaagttgttgtgcttgaagtgggcggggagcagggtctgggagaagacgaaggggtcggcgacaacaaagctgttgttccctttcccccacccga

SEQ ID NO: 18275 - DNA, 18423 bp, Oryza sativa
cccccccccccccccgctccggggaaccccacccggtgtcccggtatgtcgcggtgcgggcaagagggacccgcggctgtagacaatggcagccgaacagttttccctacgtctaaaaaaactcaattccggaatgtttgtctctaacgtttaaccgttcatcttatttaaaaaaattataaaaaaatataaaaatataagtcacacataaagtattatttatgttttatcatctaacaataatgaaaatactaatcataaaaaaatttcatataagatggatgatcaaacgttggacatggaaaccaagaatttagtcttttggatagagcgagtaacgttttatcatctactccgtcgttttaggttataacaaattttggctttactcaaagttaactgctttaagtttgctttaagtttggttaagtttgtagaaaaaaatagtaacatttttaacccaagacaaatttattatgaaaatatatttaattattgatttgataaaactaatttattattataaatattactatatttttctataaacttagtttaacttaaaatagtttgactttggccaaagtcaaaacgtcttataacctgaaacagagggagtaataaaaatatattaatcatcaaaaaaattctaaataaaataagtggttaaacgttatacataaaaatccacgactgcacttaaaatacgacaaagaaaaggtaataagtattgagatagtaccataggatcatgatactctatattttaaaagtacaaattttatatacaataataatatgttgtataaattaaagcatataaattgattttgataaatgtaattggtttttacgtaaacttaagcatatttatttatattatttgcaatcaaccttacttaaaataatattttataggattgtacactaccggagaaacggtttgtactcctggttggtaacccctgtagtcctggttttttaaccggtataacaatttgggactaaagatggatatttagtcctggttagtaacaccaattgagactaaatctttagtcccaccaactgggactaaggtttttttttcttttctcacgtccaatatctccaaatcattaaaaactaacaaatcacatacgcatcacaaatcacaaataacagatagttcacatatcacatatctctcaatatcattcacaaatcacagatcacagatcgcatcacaaatcacagatcgcacaaatcacaatcattcacatcacattaagaaggaaaaaagaaaaaaaggaaaaaaaaatcccatgccgcctcgcggccctccgctctgggccaccggccgccgcttgcccgccaccagggcagccctccgtacctccgccgcatatcaccgtgggccctccgcgcgggcagccgccgctgccaggcctccgcgccggccgccgcttgccaccaccgagaagacgggggagaggggaaggggaggaggaggaagaggagcgaggagagaggaggaggaggagaatgagtggtggggaagaagggataagaccaagggaggaaggacagacagatgcgcaaagagataaagatcgaccgagatatgcacgtggcttggggtgaattttggacccagttggtataagcaatcgggactaaagatttatttttagtcccggttgtttataccaacatggactaaagataattggggcctgacgatctgacaacttcttcaacggggactaaaaatgatctttagtcccggttggtaatgatcgaaccggtactaaagatcaaaaagtacccctaagcttttaaactgggactaaagatgctttttagtcctggttttattggaaccagaactattgtggaatttggtcgaccgtccgaagatggtttctccagtagtggtagggatcgtagaatcggaatactaaataagatttcataagatggtatgtaaataaatagtaagatcgggatattataaaaattaggatattagatatggttgatatcgtttcatcttgattattatcgtaatgtcgtactctctccgtctctaaaaaatcgtcgtcccataaaaaatcaacctagtactgaatatgacatattctcgtactacaaatacgtataaatatctgttcagattcattgtagtataatgtatcacattcaatcatatttttttgataaaggtgtactccatccgtcctataatataagagattttgggtggatgtgatatactagtattcgagattttggatagatgtgatatattctagtacaataagagccgttttggtttgataccaaaaacataccctaccaatttattggcaaattgaatagtatgtgtgttattttggattgaagacaaatatttggtagtgatcttatactatttggtcattttatagaagtttcttcactatactataagaatttgactttatattggtagcaatctaaatggtagccaaataattttaacctaccaatattttagtagtgccaaagtttgcctagactttggcactactaataaattaaattggtagggtagagaaccaaacaagccgtaaatctggataggctgtttgtccaaatttattgtgctaggaagtgtcttatttatctaaaacctcttatattattgggagggatggagtatatataagatagttcgggatgctgacagcgggggtggtgataaaagcggtgtgctcgggcacgcgaaagaaggacggggtgcttttgttcggctggtatgcgatttggcggatgtggctgtggtggtggtttctacggccttcggcagctgtaaccgcatggaaaggggaggaaaagcggaggttgaccatccgttgatgcaaattgcttgttggtcctactggatcggcgacactggcgtgcatgtcagcttttgtgggttcgaacagggactgaaaatgtgacgataaaccggtttgttttctagaaaccgcttgattgatcgatcctgatccagatttctttttaaaaaaaagagaatcggttaagaaaattaattctaatctcacctggtttggttgatattcccgttccagaaggatcattggaggttatcctatacacagtggttgagctacactaacaatgggtatgttcggctacaagggttgcagtgctgctgtacccgcaggaacagtgaagcaagcataacaaataaaaaaaatagtggctggctgcagccagatgttacacctgcctaccgaatagggctaatagatgccgcgtgaatagtggttgagatgctataccaatagattataatagagcatttataacgatttaggctcacgttagaactaaaccctagttaacgggtaacctcgtgccatctccataatctgcaaatgacataggtatatatcctagctaaaagtaactccaacatatgaagccatcgcttaggaagctgaattgtgtgaacatgttgtcccaccaagcaaaactaggaatgtttgttcgatgagtcacctctatcttatgtttctctttgccgttgagattagactctggagcctagccactccgatgtcaatatgtcgatatggcctaacccagcaacaagtagatctaacaacttcaccatcatttatcgttaaagacactgacccaagccactccgcaacttagtaaatctggtgctcctctacgacttccatgtcactcaatcgttgaaggtgcgcaccaccctgagccactctacctctaaggctgcaagatccgagatgattccatgacatggcaaacgggattggggaggacagcatgaacgcattggccacccggggtggaaccaggcctaggacgactagggctcaaactcctaaagcctagctaaaccctaaaccctaggtctaagatccaaactccatgtagattttatataaaattcagaaaaatgtatgaatttgtaaagaatttagctaggtgacaaaatagagttgagctctagacgtggcctctagttggctctgccactgttggtcaccaagaatacaatagcaacagatgaaagttgagagaataggatatgagcaacgacagtggccagtgaggggatggaaaagtgaggggagggcagtggccagcgatggggtagatgaagcggtggtgaagaacaaaggtggggataataacaacaaatgtgaaaggttgattcaaaagtagaagagggacataggagaatgaggaaagagatatttatattttggaccgtaagggtttattggggatatttttgccataaggttgatagtgtaaaaagttccaatgaatttggtaataagaaatttaataaatgctattagaaaattaattagaggatgaaacacaaaattgtttgtattgcgagtggctcgtattatggagctatcatctaataaagggataaaatgctttgcattgtttggtagtgaatggtgtgtggtcctcctacatgactagaaaggtcaagtggcacatggacctagcatccaacaggtgggaggcatggtagtacaatcaagggaaaatttgaaccatgccacacaaattttgcaaaatttgtgatatgccactctgacccatatgtcattgactcatgtgggtcctacatgtcattgagatacgggtggcatatcacaaattttgcaaaattagggtggcatggttccaacaaacccaatcaatcaaaccatctgataggaaattggaaatgatgtccagcgtgatgattagggttggggggaagggagcaacctaaggacctgttttggggagcttctagcagctgcagcttctcacagaatcttcagctcctccaaatagttcaaattgtcacccagattctaagaatatgtagttgtagaatactagaatccaaataataaactataacccaaaagttggaaaacctagcttctccagattctgagaagctagctagcaactagcagattctcataatcttaagctcctcaaagagggcctaagggtggccaggtatgatggtatgtattgtgttatttttttactttaataaatgtagttttatggttcacataaaaattcttcaagggctcaaaccccattaatgttgtcatatggatccgtgttaacctaaattatgcaccatgtattggtaactggtactaaaaagctatgaaagaaattgcatgttttatctggaaaactttatgtattgttaaagggtctgttcgggtgcaagctgctgcagcctataggaacagtgaagcaagcaaaaaaaaaaaaaagcagcggctgaccgcagctggctgcaggtagctgctgtacctgccagccgaacaggcccaaagtatgtacgccattacaaagtttatatgttgaaaaataaagtacgagagccatattgtagaaattatgggtaccatatatgcacacaaacaacttatctgactggcgatagataatggaccagatccgtatattatgtaaatagactagggtttagacattgaattccttgtgtttcaagatatagtctacagtcttagtcttatatgattgtacagttgtataagaaaatccatatcgagttcgattggtttttcctctttataaccttgcgcccctcctccctccccccccccaaaaaaaataaaccctatataagtagggcaaggagtccctcaagggcataaaccacaacaagatcatcggatcagtacaatatctgacagatacaattcctaaaatagaaatagggtattacttctcatcgagaagacttgaatctgtctaaatctttatcactttactcatctactttagatcttatgtggtatcccttatattattgccgattttccaaattgacacatattttccatatctatactttctatataattggtacccactaacaattattggaaactaaatttcaacatgcaagcatgccacatcatcacccactaacaattactattctagcctatttaaaatcgcatgcaaacatgccacatcttcactcactagcaattactctctccgtcccaaaataagtgcaattttgcactatttatattcaatgtttgaccgttcgtcttatttgaaatttttttatgattagtatttttattgctattagatgataaaacatgaatagtactgtatgtgtgactaaatatttttaaatttttcaaataagacggacggtcaaacgttgggcacggatatccacggctgcacttattttaggacggaggtagtactattctaacatattttaaatctcatgcaagcatgacacatcatctacaatattatattatagtgatcaataagtatgtgaacttattcttttcttctatataagccttgtgtattgctgggccttttgtgccaacaaatggcctagcactgatccggcccaacaaactgggttatagtcgattagagcaggtacaatagtaggctataagttataaacatattttaaaaagataaaggaagagagaatagcagcgggctacagatctgtagccagctgtaacacggactccaagatataacatgtgcataacaaatgggaccaggtattgatagtatagtatgcaactattgtatgaattgactattacattggctatatatgatttggaactagtagtgggctatactattagggtctgtttactttgatgtcattttcaaccttaccaaattttagtaaaattgccaaaaagtggctacatttagtttgctgtcaaaaactatataagaaatcttgccaaaattttagtaagttgccaaaattttagcaatgccaaaatttagtaagattagttttggcgtcaaagtgaacaagcctttaaactagcttgctcttagtcgttcggaacgctcgtgacgtgcggtaggctagtcagcgcattggcgacacgtgttgcatcatttcgtgaggaattaagctgaaaccataaaatttttcagcagtgtatgcgtagacaatcccttatttttattcagtattaatttgacgtgcttatagtctctgctctcatgttcttaggcgacgactaataatgtactccctcgaatatttaacgttgttgactttttttaatatgtttgatggttcatcttattgaaacacttttatgaaatatataaaactatatatatacataaaagtatatttaacaatgaattaaatgataggaaaataattaataattatttaaatttttttaataaaataaacaatcaaacatgtttaaaaaagttaacggtgtcaaatatttagtggcggagggagtattagcagtaaggtaataatgtgcctagctcatatacggccgcaagacaacacagctcgccgtgttgactactgtaaattacagtagtaataattactgtacctttttcttaaagataatctacagcaacccttttctgccatcaattaagtaaatcaattcaacatataaacttgtatgtctacaagatctttgaaactctgttgttttttttccgttgaatgcaaaaaccaactgtaaattcacagaagagtaaaatatcaaattgaaataagatgtacacagaattaattgcatccatctcgtcataaagaaaccaagcaaccagggaagaaacaagtgcaagttagcttaggtaaaagcagagaccagttcatcactaaccaaatcaaactcatcttattctcttaataagtacatcgccaagaaactaagaaaagcaaacaaagcatgcaactaagcaccgacgacgagacgtcgtcgtggcgccgtgcacctcatcaatttaactgcaaacgcacacaagccacagctgaggtcagatctgaacactcacacaattcttgaataatatacgcatggtttgccacgacgcatccatgcaaggacttattcatcatcaacaccatgacgacactagctaccaactagctaagagagagagatggccggagagatggccggccggcggcgaggtatgggtagctaggtgtagtggcaggcgaggttggccttcttgaacaaggcggcctgctcgatggcggcggccttggaggtgaggccgaggaggatgcaggacttgacctgctgcgtggtgtaggcgaacttggcctgcttcttggcggccacggagttgatgtacgcggcggcgccctcccggagcaggtcgccgtagcagtccttgcgggtgctgcacagcgcgtcctgcagcgtctgcagcttgctcccgaagaagccgctgcacacgtccccgaacgaccccacgatgctccccagcgacccgatgcacgatattatcttctccgggtggctcttccagaaactgtgtgtgttcatcatcatcagatgatcattagcaacgttaattgcactcacaaattgatactcactccgtttcgaaatgtctgacgccgttgactttttagcacatgtttgaccgttcgtcttattcaaaaaatttaagtaattattaattctttttctatcatttgattcattgctaaatatatttttatgtaggcatataattttacatatttcacaaaagtttttgaacaagacgaacggttaaacatgtgttaaaaagtcaacggtgtcaaacattctgaaacggagggggtatatagctagtgacatatagtttgttcttactcgcagctcccggtgaaaccggtcgtgggcgacggtgagtagccgccgccgccgccaccgccaccgtaccctccaccgccaccgccaccgtagccgccgccgccgccgccgactgccaagaattgagatcgtcggtacatggatgcatgcaagaatgtatatatagacacaaattaaatgaagtacaaatcacttacacttcttttccgcgacgtgatgatctccgtgcaggttcctggtggcagagctctgctgggaggcaatgccgaccaggagagctgtgaccaggagaatcttgcagctgcccattctagctttgatctcttcaacttggagaagtagctagtgaagaagagagatgcttgggttgagtgagtgtgagacactgctcctgcagtgtatatatacaggtgaagggctgcacctaccgtgttgtttgctgcattgcatggacggtggtgtgtgaagtgtgatcgatatgatcgatcttgctgcaatgctgccaaggcataagggcagttggcctccattgaatgcatccgttgatccatccagctcgatcatatcggtatactaatactacagtcatctcctggctggcctcacaccgctagctgaatgatttgcatatggatgcttcattagatcacagttctgtattatgacaaattcagagtaccatcagatttcagtaatgctcctggccctgcacccatgatcagcttggccaatggccggtatcctacaaattaacagaggttacagtatgagatggaggattaatttcataattgataaatgttgctatatgacgctcgaagtttgtgtaatttgttagaggacatcgcaaaaacgtattatgactagagaacaatgaatagtaataataatttgtaagaggatatttccggtctaattggaaagagagacttttcaaaaagataaaaatacccctcggctacaattttttatctccactgtaccgttaggttagaagcttgtggctctaggggcactatcctttttttttatagaatttatctttctaattgggtcgaaaatgtcatccagcaaattactaacttttttcaatccagctatgacatatttctacgatgtccagtagtaaattacacaaattttgaggctcctatatatagtgaaatttgcattcataattacactcaagtttacagtatgaaaatccttatatagctaggtagttggaggctggctttggtgatgatcactaagatataaagcacatgtttctacaaaaccactgatatagcttccttgtgcaggccagtagtacaaaactgctgatggcttatttcctatgacaagggacatgcatggcatggcactatcagcactaaaatggtgtacccgacggaggggattaaattggattcggcgcttgccacctactcgctatctacttaatcagatcggactatgcccttaattagatatggccctttaatttgccaaaatggaagttgcgacgtcgcatacgtacgtgtattgcaattggttctaggtaaatattgtagaatgttactcataattgaaatatatatctatcattgatttcttttagggttttctagaccagttaattaattatgtttctcaactgaaaatggcattacatgatcgatcgatgttgtctgccatttttttggctaatccagtgactttgattctattatgtttaatccagcattggttttggtttatgtactcctattttaatttggtgctttttacaggtacactatactggtagtatatattgccattataaacaatccaagagttgtagattgatttttctacccgcttaaatcgaatgagtataaaattaaaagggtaaatgatccatgttttatgtgtttctctagttatctgggttaatgtttttatgtgtttgatgaatctatcgattctatcaagagcatatgattgtgccatctattcgaccgtatccggtcagtaatccgatctgatgcatggacaattatgattaccatcggagtgaaaatatagcatgaataactattgatcattttctatttttgcggtagattcccaacacctcattttatactggtaatatatactaccagcatattgtaccataaaaatccttcaaaaaatggcacttctctagtactactagttgttgttgcatttgcatatgtaaaatgttctggtagttttctactagttgttgcattttgcatatgtaagatgttctggtacctatgtatacatccatcaatccatgttagtaatggcaaacattatactagctgctaccagcaaaatcctgcaggtttcctgccactaggtgctgcctgcaaattaagctgcatgtcactgctacatttcgagttgcaaattaatggcagaatggaacccgccgccatttttgttttgaggaaagagaaagtactaatgctttcacttctatgaacttaacaataaagatatccaaataataagctcacaagaacatcagtacaatatacagtgtatagagtacaggtgaattgaccatttttcctagttacttttactttcggatttgaatggtacttgcagctcaatatcaagttagaatacttgctgacacgcaattaaaaacagtacagcccacctctattaattcgatatttaaggctcaagggagttttcatctgagatggagagtttgactactcatcgatttcatattataaatcattttgactattttactaataaattttcttaaaagattgataagtttataaaagaaattagttaataacatcaataacaccaaattaatttcattaaaactatcatctaatatattttgataatatgtttgttttgtattagaaaagttgctatatattatatttttctttaaactcaatccaacttacaaaccttagaagtaaagtgacttagatagcataagtgaattggtggtctcgaattcaaatcttagctgatgcaattaattaaaggatttcccgcatttttatcaatttaaaatttttggttcaatcggaccagtagtccatgcaattgacataatatatatttcagaataaatataataatcatgaactttttttaaagaaatggatgcattttgaccgaacacaaaggattaatgaaatgggacaattaaccttataggagtattaatttattcaataactaaatcatttaaaccagagggattttttttttcagaggggcatttatttgctctaccaatttcacctactttcatatatgcattactaaattatggagataacagaacaaattcatctttttttcttaaaataatcacaaattgatgaattaattaaggcaacttctaacagcactcggatttagtggcggcgcataaatactagctataaacaggatgtgatgatacacttattaacatgttgagttgacgtgaaggggacagcctgatctcatcaggactcgaaattaactctgaattagttagctggggctcgtctatagagttctatagtacttccttcgtctcacaatgtaattagttattctatcatttatattaatgttaatgtatctagatagatatatgtctagttatttagattcattaacatcaatatgaatgtggaaaatactagaatgatttatattgtgaaacggagggagtatgtatgtttgaatataatgctataaacagtatgctagggaagatttgggtaattgcgtagtctttgtccaaataggaaggaaatttagtaacatatatggaagtaatatatctagtactatatttttttcatgaccgatgaaactaacacttcaaatttgttacagggcagttattaattaattatacatctaaagctttgaccatgcaattccttggtaccactactacataataattgacaagaatatttgcaatagtagacaccaaccagatgctgattaatgaagtgcagtgggaggaggaaaagaatctgttggagacttggagtgtactttgcttgagaagatttgcttcggacagatgccatgtgatctctccattactggtcgacgaaacagtttaagggccagggtttcgggttagcaacttgggccaaacggatggcttaattaatggtttgtacaatattgatggttcaactaatgagtactacaatgatgcgtccacacagcacacatgacacatctctctctctacttgttactcttaaaggtgattaagacgagattattctcactgatcgatgctgatcataccacaacattcagacaaacattactacccttttgctgtttcagaaattaaatcgctgtcattcagaaggtcccttcaaaccgcacattcagctatctgttggtgatgatcaatgtgaaccaaaattaagcaaagcatattttgctttagcagaggctagagctaaatattacatccctcttctgtccctgcgtcacaaaatcaagatcgagcacctccatcatatatattcggataagcatctatttaggctctgctattgaacaagttatacatccacaatatggcagcttatcgatcgaattataaatatagtatgcaaaacacgtgaacttgttaagcacttaagtctttgcctattttaattagctttgcattatataatcaaagcgattttgaatttttttaaaagttttttttaaagaactatagttgcactataaaaaaacatacaaaaggggatgacaatatagatgctggaaattaaaaaaaactaatacctataaacctttttccgcctgaggtgcgtgcccacggggcaccatccggtagaaccggcacctttgtggagaataggtactggtttttaataggaaccgacacctttgagtgttatcccatcgtagtagtttttagtggggctaagacaaaagtgagtttttaaaataaatcagcacttttaggtcaagagcggagctgaaccacctgtggttatcgttttctcgccatccacccctctcattcttcatctcgccactctctctgaaaccaccgtcccacctccttttcctcctcctcccctagtccataccttcctgttcttccttcacgccggggggtcacggcggtggcagcaatgagatgtgggccacccctactcctctcacctcttcacattggccacccgcgctcgagggcggctggatccaacgccgccccttcccaccggcgctcgggggcagctaggtctacctccgcccctccccataggcgctcaggaacggttggatcaagcgccgcccctcctcctctccgccccacgcccttgcaaccagctctcaggggcggccggatctggcgtggcccctccccacaaggtgaggtgggacaaactttgttttttcttcgttcatcttgttattataattggagtgatagaattctttatttgtgccaaaatttgtgattcaaatgctttgatttgtgttgtggatggatgtaggatggatgaatggtaatatggtgatatgtgggatgaggagttgcttgatgcttcggctcaattcaagccaatgcattgagctggcttttttatcctttctgaaacgtcaaagctgctggtctttaaaccaacacctttagtcacctcaaaggtaccgtctgctaagtactgattaaaagaaatccggaattaccacatatatccttggaaataaaaatagtggtgaaaacccttaatactagttattcctaaaactaaattcgaaatttaaaatacggagtaatctatacactaggccctaatagagccagttaactattttagaatcactaactctcgagataattaagattctcatcgttacgatagtcataggatttagaaaataaagtaaaagtcaaaagttagcttctcacctattacttaatttttaaaatacgaaccatatatagggacggttcaatttgatgttattttcaactatactatttttttgtaaagttatcaaaaaattgtctacgtttagtttgttgtcaaatttggtcaatacataagaaatcttgtcaaaattttggcaatatagcatcttgtcaaagttttggtaatggtaaggtttattttggctataatctgaaacatgcccatagtctaaagataagacagacatgcaatgaagcaatatggtgacaaagaggaagcaggagtatatatttctaggatggtgacaaagagaaaggagagtgatgatcaagaacggagtagttggatggtgaccaacaaatccttcattcacttccactttggcctaccactactgacgatgtagatgatgcctactactactactcatgcgacccttcttgtgcttgtatggcatagtacgtagttgggcagaattcctggatgaaaagtggaaaactctactgtccggccgggcttcgatccgggcatccggggtggtgatcaatcgcgatacatattatgtgtgcgtttgcttgtgtagccaggttgtacgtacgtccccgtcacggtactgtacatgtgtgtggtggtggatgagttgtcgaaaactctcaatacggaataggatgaatctgtggaattaacccgtacgcgagacatatatgtacaagacattaatattctagcttcacctgtgaagctgtgacgtgatgacgccagcggtgatcatccgaaactgaaatgagcagagaaaacagcggtgctacttgttagatctccatcgtttggcttatttcctaataagccaaaacagcttattagaaaataaaaatgaatttgtaggtaaaacttttataaatgtgttcttggtgacttaaaagccaatgttgaaaaagaaactacgttgaaaatatctcaaaatcaatctcaaaattaagcttcaaaatttaaattttggctttttctttagctgattaggctatccgatgggagccttaacctttatgcgtcaaaagtgatcttaaccattaatttataaaattgtactactcctacagttggattagaaaaaattaaactgtcttatattggttctaataccagtacagagctttgtaacacatctcttctcttcacctatatttgcagttctcaagtcgtattgcccgtagtttgttgccggcaatcgttcggttaccgtgattatcaggctcatgcagccgtccgttcatgggctgggccgccgtccagtgcaagtgccggcaccgctcgacttgcttgctggcctgtgaacgatcgacatcatgggccgggagagaacctgctggaagagtatgaggaaggaataagtacattttccattcctattcctaatctttacgtcgagcttaatcgatatccctaaactgtaataccagaaatttatacccccaccttaacaaaatcatccaagtcaagtctcatggcagtatcgattggtttttgctgatgtagcatcttagttagtaaaaaagaaaaaaaaattaaaatttaaaacgtggggcacaaatgtaagtggacttccacatctccccatctatccagggcccacacgtcagagtcaatccacacgctgctagatgccacaccggcatgtgaagcattttgttcgagtatggtgtggttgtgtcagcgttcttaatgagagaatggagctggaggctgtggttgtttttccatggacactcctgtcgtgccccgctgttctcactgttgttgcgcgattgcctcgtcagatgtctccagtggtgaggcgcactacacaacccttcctaaggaaccggtctgaaaagttgagccgcacgttcttgctatggagcttgaaggtctcacggtcgtacgccatggcagcgtcctcggcggtgttgaaggtgtcgcgtgtggtaaagcttctgcggtggtggcaggaccgggagcagctttgtcgctctaacggtggcggcacatgaaggggaaaatgtgtcgcgtcgacagcaatgacgagatgatgcagattggagcatcagaagccgaagaagaaggacgtggagagcaacgacggggaggtggtcgggggcaccacccaatcttcttgagatggcaaagcaatgccgctgatgaatcctccaaagatgtccccaatggccaccgcaactgtatgccggtcacccctttccccttccacctcttgccgccgccaccaccaccaccaccaccactgccgctagggtggtaatttccccgcatggtgcggggatctagcggggacccaccgctacgggggctagggcgggtcgaaatttctactcgtcggtgaactggggcggaaccctgcaattttgttaggatgggagtgggacatggaattaatccgtgggtcaaacgtgggggccccaaatggtccatcaaaacacatgaacaaaggccatcattagcaggccggcccaaatactctagttgttaataaatgaatcaaaccctaattcccatccatctcccagttgatttctgaacatcgccgcaaatgaccgctcggtgtgatgatttcccagaccatggctcctgagcaacgcagctcttcgcgttcctcacacaaagatgtgagtagctgtgtgatgcacataggcacttcgccaagctgagcatcgggactgtcgcatccatgcataaggaggagaaagtccttttctaagtgcatacttctcgaaccgctaaacgtttattttagcaaatctatagaaaagttgctttaaaatatcatattaatctacttttcgagtttaaaatagttaatatttaattaatcatacgctaattgctcatatttttttgcgtatcttatctttattatctcttgccctcctctaaaacttaataggctaattcatccgcatcaatttacaaaaggctattatgcaaatatgctgtataatagttgagcactttagcccttggaggggctctggccattgctttatgtcaaaatttgtattcctcgacttcctctcactttacttgattttaccataccgataatgtatattgctgtgtagatttccattaactttggatagaggtttagtaacatacttaaactttaaataagttgctaattttctttgtttggtgttgtcatgctggtgtgtcgtttttacatctacctttgtttaattatatcatattaatttcaaaacaacaactatgtaataagtggatgtacctttattgaagtaaatgccgtgtttatatcaattatccttaaagaataatatatattatgtctatgttaatagaatagtctactcttctcttccctcgccttctctatcctctaccacagccaattaacaatcggatttgctaaaatgatgtcgccatattttatggctgattacagtcgaatttctgaccgtcagatgttgttcagtccactcaggtccttagcatctctcggctgtcattacacgattaattaaaacttaacatgcttcattagtttaagattttgatggttttactcatatgtatctgtatagtatataaatatatgtaatctacaatgcaaaatatagacgttgcataattacattgtacttacattataattacattgaacttacatatgtaattttgaaacttacatgataaatacactaaaattacatatgtatttagggacttacaatgtaaatacatggcgactattt

SEQ ID NO: 18276 - DNA, 7412 bp, Oryza sativa
tgatgtgacataccaaaactttacccccctaatctaagcacacattctttatacttatgttctaacaaatttaacttacacagcggctgggccaaagagacaccgcgccgtgtgacacgctcttccttcgccatcgtcctctcctaacgctgtacacacgctgctggccggcgcggcgacagtgatctgaccagctttttgccgtgcgccggccacccccgcgcaagcgtgcgtgcatatgcactgcacacgggagaacgaaaggatcgagtttagttggatgatcacttcatcttctcgtcgtcatcgctaattgctgcacatttatcacctttttaatcaccaatcgacgagaacatgtggcctctgatcgatgtatcgaccagctgggccagtgaaaagctattctttcgaccggcatcagtagtaaggagtacggtatggtgctctgtcacacgacgattggtcaggcaggagtgtctaatctactgcgattgtttactttaccaaagccaaaccgacctcttctcatcagccagccaactggtagctgcggcaaagtgtgtctcctttgtcgttatactccatccgtcccataatatataagttattttgactttttgcttgttctgtttagccattcattttatttaaaaaaaattagaattattatttattttatttgtgatttactttattatccaaagtactttaaacacaactttttattttttatatttacataaatttttttgaataagatgagtggtcaacagtgtaagtaaaaagttaaatctcttatattatgagacggagggaatatttacttacttttactgcttgctagaattgtgccaaattgttaatgtattatccattttgtcctgtggttggctgctgaatgcatgcatgcacattgcaaacgcggcgtggttgaaacccagccgcaagccccacaaccacaagtggttggatgctgaatgcatgcgcacttgccggcggaagcattttatgtaaaattttgcaatacgtgtcttggatggttttgtcaatcaaacatgtggaacatattgttttagacggtttttgatggaaccataatatgcaagtaacaagagatgattaccaacaaacttaattatgccttcatgattatattttctcttctactttttcgttggatttttgcaagttacgaaaaagcaatgtttcgctttcttcaaagccagatagtaaaatgatcttcaatcaaaaagaggggaggatgaattttttttttggggggggggagggggaggaggaggtgggtgtttggagacagtggactggcagtaggcggcaaacaagggtgagacggtggtgaggctgcctcgaaagaagagataggagggagatgggtggggccagtggtcaggcgtgagatctagagtgcctaggaggcgagggtgattgtgacatttctggtgaaattgctagatgggaagaaggcggggtgtggggctactcaaaggagggggatggtagggctcaccggtgctagaggcagagttggcgaggtagagggggtagcctaagcccgtagatgcagcgcatggcgtgaacaggggcagcgctgtgaagcgacgtaaggatgaaaaagatatggctggaggactacccatggaccattgttgtatgaatcttggcatgacctggggcatagtggcgtatctaggatttgaggtttgggtggtccaacttaccaccgtgcgccgcccttaccaccttgttgttagctagctgccacaaaggcgcgaacatcgtgacacgacgtttgccctttcctgcttgctaacatgtcggcttgactacttgatgacctttcatccttgccgtgttagtttgctgcctccatcttggactcctagttgtcgtctggtatgatgactgctgctatgacagcaagatacacccttgccgtgctattttactgtctctgtctcggattcctaatttttgtttggcgtggtaactgctgctatgacagtgcgttgcatccttgccataccagtttgttgtctctgcctcagactcgtagttgccgtctggcatgatgattgctgccaatgtggcgagaaaactaaaaaaacacgatatgggaccaagacaaccacgcatcgacttcactcttcacatggcaggagttttttattagtttttactatatttttctacaagggtcttaggctaggaaatttttgggttgtccggcttgtagatacgcccatgttggggcattcaaaagtgaatagaatttattggtttttttaggggagtgaaaactagacagccccaaaaacaagctaaggactcatcaaccaacctttcacatcctaatgcacagatacatttcaaaaccgtgtagatataaatatgtgcaaatagttcccttttttttctattatatattgatatcatgatatgacattttaccttcagccagctgattctgcaaaagttttagcattctatgaagagccaagtttcctcaaagagggttgggagtacaaaatctctccacaaaaaacaaggcatagtatgacatatgcacattaattgacatgtgaacaaatataggacgtcaaccagtccacgtatgaaacatccctacacattcattccactgttgtaccaaccaatctacctatatatacatgatcatagtacggattcatctactagcttcttctacaacaataggccaatttaaggcctctccctctaatatgctagctagatgcatgtagtttaatactctagctatatatctagtagctagaaaattaattaagcaaacgaaaaagagacaaagtattctccctcgaaattattttttcaaaaaaaacagagagacatatatagtgtccatgcatggccggggacaatccaggatggtcatcactgtcgcgagatccatggaacgcatctacgcatctcccatgcctcaccgtttggtccctccgtgtgcatgcaagcaagcgtgcagtcaagtccaaatcacagggaaaaaaagttagctgaacgtagctgaactaattaggctactgatagtagaacttattcattcgagtttttttaaaatttaacatggatactcgtatttatagctaactattttttaatagtagacgatacgctcgtcgatataaaatcgtcactggtcataatttcgtcaatactaagattaatctgttgtctagtttttagaagtgtttatataagtaggatatatatgtactgtagaggtgtacatggaatgtttattttagaaaaaaggacggagatcgagacagacaaggggcatgcggcacgcatgcacaacgaactcaaggcgatggtcgatcgatcgatcaaatccatgggtgaaatcatcatgcatgcatggcaagtggacgacacgacatggggctagccggactctgttcgaagttttactccttctatttatttagtactataaaaaatacacgtgcgttacaacgggtaaagtctattttaatcttattattgttatatggtttagttaagatgaaattcactatgagagttcgcttggatatatatatttttaaaaaatcatgagttgcagttatgagtctgatcatgatttcttatataattccttctgtattagtaaaagtgaacgatattaacaacccgactcaaatacggatagtcggacgcgtgttgcgttggtatactatatggaacggagtaggaaaataaaagcatgtgttattaggatgacgtacaaaatttccaggcaaaaacatcttgaatttttataatatagaaaaaatgcccgtgcgttacaatgggtgaaggctattttaatcttattactgttatgtggtttagttaacgtgaaatttattgtgttaaattctcttggatatatactttgttagaaaatcatgagttacaattagaagtctaattgtctcaagttaatatgcgagtttttaaaagagatttcttatacgattccttctgtattttcaaaagcagacgaacttaaaaccgactcaaatatggatttgtattttcaaaagtgaacaaatttaaaaaccgactcatacacgattgacataccaaagtatcggcaaaaacatcttcaatttttataatagtagagatagaaaaaatgcccgtgcgttacaacgtgtgaaggttattttaattttattattgttatatggtttagttaagatgaaattcactgtgggagttcgcttatatatatatatatatatatatatatatatatatatatatatatatatatatatatatatatatatagaaaatcatgagctgcagctaggagtccgatcgtctcaagttagcatgcgagtttttttaaacaaatttcttatatgattccttctgtattactaaaagtgaacgatcttaaaaaccgactcaaatacaaatatgtattttcaaaagcaaacaaacttaaaaaccgactcatacacagatgacgtatcaaaatatcgacaaaacatcttcaatttttataatagtatagacatatatatagattaggtcattctgtactattctcgcttttggattggccatttgcagtggaaacgatgtgagagctatccatcgaaggcgtcgtcttgtgagacgatgcgacgacgaggatcgggcaaagcttcgtacttgcatagctagcggtcctgagtcctgacgcacgcaaattaaagtcatacacaagggggcccaggatcgattggtacgtgcacacctgggggttttctatccacaggatggatcggaagagaacaaaggaaatgcaaggaacagtgaagtgaccatggcaagggggtgccacatgcatggtggtgacctgtggacagtagtggagtagtaccaagtcatacaaaactcgtgttatactgttacatttgcagaaaaaaaacctagcattaattatacgactttgcgtgttgcgtcctatttttaacattgaactttataaaccggacgaattaccccctagatcgatcctgtagtgtggttttggtcctacgtggacgcacacgtggccgtataagttagccaaaacaaataaacatggtagggcccatttcaacccaattgctcttcttctcacctcctatttaccccttcccttctccctccatctctggctcaccgaggcaggcggcggagctagctaaggcaagcagcagaggtgagcggtgctcacatcgtggagctcgccatcgatcttgctgcctccaccggcgagcttgaagccacctgtgccgcctccctcttgagttcaccgttgcgtgcgcaccaagctgcggaggccgaggacgagtggctcgtcggtggttgcgagcctcctttcggcggagcccgagataaggcgtgcgccggcagtggctggcccgtcaagctcatcagcagggccttgtcctcctgtgattgggggagcgatagccgacgccagacttgcacgaaaagatggcgagcggcggtatacacaatagcggcgacaccaaaatctcttgttcctccatgcaatttgatccaatcccgctctgaccccccctctcgtcggccggacgaggatatgctgggtcatggctccggcatgccgggatttgacgccgccggcacgccgggccccgtcgcacagctcgtcctagccgccttgtttgcgttccccgcagatcgacgacgcctcctctgcattgcccacggatcgccgccaccttccccaacctctacatccccgtcggctcctagtcctagatcgataccggccatggccgcctcttcagccgcaccttcgcctttgtctgtgtcgccctcaccgccggtcacgccaccctcgcctctgcctccataccactggcctcggcaggtgccccgccgtgtcgcttcctctcaccccgctgtatggcccacatcaccgaagccctgcctcactgatttttttttgctgactaggctgccatgtgtatgccacgtaggctaaaaaccgctctggattgagttagcgcgggggaggggggagggggaggggtgattcgttcggatttaggagtttaggagggcaattcgaatggccgtaatagttcagggcaacaattcgtaccttttcctatatatatgactgtactatgagcagggtctcacaaacctcacaccatactaaaacaatactagcaaatgacatcgttgattttggatacatgtttgatcatttgtcttattgaaatatgtattatttattttgtgatgagtgttgttttattattaaagtactttatttaagcattatttacattttatttatttgtaaaatattaataagacgaatggttaaacgtgtatctaaaagttaatgtcattatctattataaaacggagcgatgtatttttttttatttcatgtttcatgcatgtaataattaacgcctttgtatgtgtaatgttaaattgttgggtattattaagatgcactactatttagaaatggcctttggaacagacccatccctactcttgttggggataaaaaccgatagagtgatactatgtagtatatatcaccgtccatttcaaaattaatacaggcaatgaacccgccgatgaatcagctaaagaggtcaagttgctcgcccgagtcaaagccactctcgctcggactctcttctattcctctcttcctttctctccattttcgcacttgatccctctttgtgctcagccgctctcttcctctcttccctaacaatctctctccagtgccaccatgtctcccctaccacaactaacaagcaggcaactgcaatggatgagaggcaagagagggaatttaactatttgacacttttacgttcgacgattattcatatacctttccgagttttatacgtaggtatatatttgtcacggatagagaaatttttctaattatttgtcactttcgacacagttgtatgaagtcacatatacacactttcatggatagggcattcaaaatgaccactctacccctgatagccaagttgcggaaagctagcgattggctgcaatataagatacatcagaaatggtatcttagcaaaatgatacaaccatgtattactagcagattgaatagttcattgtgagaaaaattcgacaaatgcaaccagctcatgataacacagtgaaacattgtgattacattaggtgaaatattttttgtggaacaaaaaatgaaacgaattcctttaatagagggtttacaaaatatatgggcgatttgttgcaaaagaatatttcaattcactacaacattagatctttacatagtgaaacattgtgagtacactaggcgaaatatttttagtggagacacg

SEQ ID NO: 18277 - DNA, 4173 bp, Oryza sativa
cctttccccctcctgggaaaatgatttttttgccagctaggaaaacgatttttctagtagtgattgtgcattactggagaacagatctttgctgggtcagcctaaaaccacattagtcccaatttcaataggattcgggattaaaaatcatttttttccggttaaagagccgcacgcacttttatggactaaagatcatttttagtctcggtttagaaatcgtccggccccttactatctttagtcccagttgttattaccaactggaactaaaattcaacgcatattatataatcccttgctcgtattttctcctcctcgcgcgcaaacacttcctcctccctttcctcctctctccactctctttttcctccctcttatccttttctttttctctattaacctctattttgcagagagtgagcggctgttttgcagagagcaagcggcggcggccccgcgcgggagcgggcagcggtggccccacacggcgacggtgacaacgcggtggttgagggtggcggttgatttgtgatttaagtgttagattagttttatgtgaatttgttgatttgtgatgtctttggatctggaaatttgtgatgtgaattgtgactgtggatgtggatgatttttgtgactgtggatgattttgtaatgtttatgtgaatgctgatgattttatcgtggagtttggttagaaatcaatatgcaaacagcaacaaacaattaaaaaagaaaaaaaggactagagatggagtctcagatttggggtcccggatacgtacatagattaaagggggttacgaatcgggagtgaagaagggtttttcagcggtggtgttttagcaaattgccacaaagtgtgtcatatgttaattaagtcatcagaatgtcttataaaactacggtgttcgatagctaattttgtcttgatcgagcgtaccaaattgacaacacttaagttttctttgcatggtttggttggacatatgtagaacgtacaaggagtcaaggacataactacacagagcatatccaataattagttttaaacagctactatttcaataaataacgaaaataatacgcatcccttttccacgtgggagtatgaaggcattaataaaaaaaaatattcttaacactatacttagtcttcaaataaaatttatttatcctatatatatatatatatacacacacacattttgattataccataatgtttgttgcaactaaatccttaaagatcttatataattatattctaatgaaataaatatgtgttttgcgaattaattttatcatgtaaattactttatcatatatatgtatattatatttagatttgattaaattactttttatacattcataaagttgtgaatatagttctagtttttagttagttataatttgtgttgatttgatttattttttatatatacgcatgtttttaccccaacaactacaatccataattttcttaagggcacagaccacccaggacagtatcattttggccccacaaaaaaataattggccgccacccgagcattctcgattcttgtatcaacagatttatttttaatgttgtgataacttatttttattgtgccaagttacttttatcatagtgtaaattagttatagctaggctttattgaatttaattaccttttaagaagtaattaaatagaatctaaatatatatgataaaagtaatttacaacatatatttctttaatcagaatataatcatgtgagatatttttataaatatttaattgcagcgaatacaacagtgtaatcgggttataaaaataaggccgggtttaaaaaaatgtaggttcactactacataatcccaaatagggaatggctcataggtatcgattcatttaaaaccgacacctttaagcaactatatgtgtcagttatagagaaaaaccggcaccaataatattggtaccggttttttaaaaaagaattgacacctaagtaccaattaagtaaaaatcaaatcctagccaggattttttttgtctctcctttgtagtgcaaagggagagagcccatggtcatccttatccactcgcccaccccttcacctcccgctctctcgcccacctccatcgcatccctctctctcgcccgcccctcctgcctcctctccgacgccatccctccggctccagtacctccctcctctcccctcttcagagctgcagcccctcctcccctctctgacggtgcgggtggctacaacaatggcaatggcaacggcgggcagatccgtcagtggcagaggctcccgtatgcggatcaggcgatggcacttctccggcgagcggatctggcagtggcggcgacttctcgttgattttgttcatggatgtttgtgtacttggatgggatctcatgggtgattaagagttgcttgaagcatcggaccactttttttattcttggaacctgttgacaaaaattccatgctcagacgatggtgttggaactgtgttggcgcgttggcgcaaactaagtcaacgaacacaacggcctgggagattttcttagctccattgcaagtccaaaatttgatgagatgcaggcgtgccaatctatttaatcctgcaactgagaagatatgtaaacaacagatcaaatagccgatccgttgacaagccgatggagtagttccagccgatgtcggtagggttttgagcaatcggctatatatccaatgtatattttgacacttgagtaaataataatataaagacaatcagctgatgataatgtaatataacataattcaacagaaaccaaccagcttataataatatgatagaataaatgatccgatgattaaagcatacatcgactgaaggttcgatgtcagataaacaatgaaacctttgttttgatcagctaaaaccaacttgtatgcaatccttgtaagccgatgcaacatccagataactcatcagctgaaaccctgatgaaacccttattataatcaaagatatgttagccttttgattctaagcacgactagtaatgatgcattgcaaagtatgctaagaagtataaagtcttagctaacctaatctggcaaagcaatttagccgataccggcaaaaaccctaaagcacatcccagcctatacagttaatcgagctatcaaactagattaactaagatatatgataaatagataggcaaatatactaaccaaaccagagcgatgcaagagatcgaagcgatgaagccttgaacaacaccaatgtagccgatacaactgtctgggccggcaaacagtaggacttaccccttcaccgaagatcgaaagctgatgcagccccgtgtcaggtgccaagtttcaccggatgataagtaaaaacctcgaaaaagatggtggcgatacgccgagagtatttttattgatcggagatagtttacaatgaccccgggtgcacaaacttatacccatgggtagatacgagtcattcttaaacaagaaataaattttcctaaagattaaagggaaaaatataaagttcttatcggacactaaacacacttttctaaagataaaaggaaactactaaatcatgcctaattaatatatagaattacgccgtcatgccacgtcttcacgattccttaaccgaatccactaaacaatcttactaaattttggcgttaacataaccttaaagatgccagttccaaaaccggcactttttatttctcccataattgacgcctatgtgtcggttagaaaaaccagcactaggttcccagtcagcatctatttgtatttctgtagctgtggttgtcaaaaaaagttaatagaaaaaatagataaaacagtaccttgcactgtttgaatgttgccataatatatgtttggccctgcttagtttgacgatgtcataataaaactaaatcagagtaaatagccactaccaactagcaagcttgtactggctatatgtgtatcaagtactatcactgttgcagtgtagctagcagttataatcacaataatttatatgcagtcgattgacacttgttttgacttgatggagcataattgctacgcctttagactttccatgatatctagctagagatctaatataatgggtgttcagaccgaacagt

SEQ ID NO: 18278 - DNA, 3329 bp, Oryza sativa
aaaatcagtcaagggcttgattgtctagatattatgtttcttttcatacttagtgctgcatcagttaagtttgatctactaagtcgtgcttagaaccataatctctagtcttcttcttggttgccaataagggtttcatcagggtttcagccggtaagttatcaggacgttgcatcggtttataaggataacatgcaagttggatttagccaatggcaacaaaggtttcactgtttatctaatcatttagattttatgacatcggatctccagccgatgtatgctttaaccatcggattagtgtttattctattatattgttagccgattggtttctactagattattctattgttatcatcagcggattgtcttcatatcattatttacatcgtgtcagactctacattaaacatttagccaatagctcaaatcctatcgttatcggctggtatcagcataggctggaactactccatcggcttgtcagccgattggctctttcatctgctatatatatatctcgtcagttgcagaatcaaactgactggtacgcccgcatctcatcgtatttggacctgcaatggagctaagcagatctcccaggccgttgtgttcattgacttagttcgcgccaacacagttcgggcaccattggctgagcgcggatttcttgtcaacaacgtttcaggctcgattccgtaaagacctttgtatatggtgggccccgtcaagtttaatatacaagtatatcccatatgtagcgttattttgacaagtagcccttttaagatgaccgcttgtagaaatatatttttgcaagcggtttactaacctggacctccgacttcagtttcacaagttttttactttgtctgcttaaaaaaaaataggttggcatcagcaaaaatctttggtagcggagtataaagtcaacgtcatttaagagaaaaggacaaattttaggtgaatagtgtcatggtaatatttagccgaaatttgtttcttttttactctcaaataaaattgagtttgaagtaagaatgtattccatgcctacatccatctctattaatttttttattaatttacaaaacttttcgacctgattttaaagggtttcaccagatatgttctcttgtgtagctagttaactttaaaaaaaatacaaccttcgtcgtttttttatatatgatatgttgactttttgcacataacgtttgctagttcatcttattcaaaattttggtataaatatgtaaaagtataagttaaggttagagtttcttttttttttttataaacagtataaatataagcgcccacaatgagcacatgttatgaacatacacgcacaccctagctctatgagcaccttcgaagactggaccggcatagtttgagattgatgaagtcaccacgggtgcctcactgtcgacaggtatgtcgcaggttagttctaccacaagaatgtaaccaattgagttacgctcacttggcggttagagtttcttttatggtaaaacaaatcaaaagaaaataaatgatatatatatatatatatatatatataacgagtggccaaacattacatcaaaagtcacaatgttttacaatcttttttctttttttaatgattgaacactcatattgaaactttgaccaataactctttttcattctatatacattctataatacttttatgatacagtaggtttccaggtatttataaatatattataggaaaagtagtgatcgaagtttgtagaagcttagtcaatgctttgaattatttttttaaaaaaggaggtagtaagaaataaacctgacaaaagagtttgaacccccactaatactactaagtgatgtggactagggttcacgatcttccgaaagattctgataagcagtcgatttggacggagtcatgacacaactcgatccggcttctgaacgaacacgctcttaagccccgcaatcgcagccccacgtctcctccggttattaaccatgtcgaaacgtgattgacgtcgctgataaggctaatccctgtttgcgatacgaagaacacaaacaagaacaaggaagaatacaaccaaaattacagatgaatgattaagcttacaagttgggatcttacaaaccaatctagcggcgagactgttcttgatagaataatctaagcaaaacctgaaccctaaaggtgacggcgggtactgatatatagagtttagggtcatgcaaacaacccttgacgcaaccctaatgggttccaacacaatatacggtccaaaggcccaaatacggtgacgcaacaccgggacaaattctaaacatcaatttgtttggttgattcctattgacttgaaaagaatttggacgtgggactagaaccattggaaatgttatcttcttagctttccatccatataaagaacaccctaatccgagcatgtatgcgatctgggcgtccgttttagtgcagactagtcttggactccgaataatactcgaagtcgacttggttgagcctccatattgatttgggtgcccttgatgatttccacgcctctaagtctttctctaagcgtcgctttgtcctctccatgattcttaatcataatataatcattagataggaatctattctcaaaatcatgtaaaaaaacgtaggaacaagctcacctctaaattcaattatcgtgcgcgagctcttgtaattggttttttaatgaccggtggaggattgttgtgtatatccaatggagtgatgtcctcatcactaaagaaacttcttttataagcaacagagagacgaaataaacaagactggtatcaaagattgttatgaacttttgtaaacaattgttttctcccaagtgttgcaacggttctttccgaaatttatccgttgcatccatggtagtcgctctctcttcttgacccggtaaacacaaataaacatattcactcactccgtcactcggagaagaacaaattaattaataaacaatggagaatttgaggtaaatcagattcagatagatatatagatagatggatggatacagatgtagtgagattgggcgaggatggagcgttgctgacgacgacaaggacgtcgatggcgagagaggagagaagagcgcgcgcgcgtccggtgagacgtcgccgtcaccgcgcgctcccaccaaccactactaaaacccccccacgtatctcctcctctcgacacggtctctcgtgctctccattcgagctcacgtagtggctaagtgtttgtgtgtacagttgtttgatcagctcgccattgcgggctgcaggaa

SEQ ID NO: 18279 - DNA, 2488 bp, Oryza sativa
gcatctggctcggcacgttcccgacgcccgagatggcggcgcgcgcgcacgacgccgccgcgctcgtcgtcaagggccccgccgcggtgctcaacttcccgggcgccgccgcgtccctcccgcgcccggcctccgccgccccgcgcgacgtgcaggccgccgccgcgcgcgccgcggccatggcgctcgacgccgtcgtccccgcgccgccgtcgccgccgcctccgttaatgccgccccaggcatcgccatcagaggcggctcgcgcgcacgcgctcgttgcccaggtcgaccaggacgacgacgacgaggagctggaggagatcgtcgagctgccgcccatcgacgagctcgacgccgcggcagagctcgtgttcgccagcagcggcgctacgacgttccactacgaccccgccgccgaccagccgtggtacgaccagccggcggcgtgtctgcaggacggcggcggcggcggcattgccgtgcacgacgcgctcgggttcgagctggaccatgtctgggcggacggcgtcgtggcgtccggcttcggcgcgctcctgtggaacatgtagtactactatactactatctctctctcctttttgacctgtgattctgtgtatatatatatagctagccagtaataatctttggcttatggcttatgagttctttctctcttttttgtttttctctgggtattaattcagaggcaggatcttctgaatatgcttcattttcatttgacaattttaatagctatatttatatgatattactatgagctagatggcttgttactggtgcctgtccattattaatacagacgcatcagtcatcagtaatatgattaatgagctgtcagtaagataaaaaaaagaacactacacttgtttcattctatatttgattatcgcattatttaataattcaatcatttgatattataagtcgtttgacttttttcttagtcaaacttcttaaaatttgaccaaattttatatactattattttcaatacaaaacaaatatgtttgatcaaaatatatttaatgttaaatttaattaaactaagttggtgttgtagatatatattactattttttcctataaatttaaacaaatctaaagaactttaattaagaaaaaaaagccaaacaacggaggaagtactttttttttagaaaatagattaaaatccaacctctacatccacaataaatgtacacagcccaacggaggaagtaccttaaatatcttttttataaatttattctaacagtagtaaacaacgtcgtatattcaagaacagagttagtatagctcactcctcgtgagatttagtatagctcactcctcgtgagattatctcatcaatgagcatgcatgatacatcgacaggcaagaaatgcaagcggttgaggaggagacgaactcataactatcagagaaaacctgtgtgcgatcgatccgcaggaaaaagacctatctatctaggttgttccaactcccaaccaacaagagcgtaccaaatcatggcatgacacaagccagagaaagcttaattaaaacatgtggttcacgaagctcaactcaagcatgttcatgatggaacggttgctaaacgacgtatgtatactactgtactccgtatgtactccctccatcccaaaatatttgacgccgttgacttttttttagacatgtttgaccgttcatcttattaaaaaaaatttaagtaattattaattcttttcctatcatttaatttattgttaaatatactttgatgtatacatattgttttacacatttcataaaagtttttgaataagacgaacagtcaaacatgtttaaaaaagttaacagcgtcacatatttatatttaagaaggagggagtaagtaggtacgtacacatgcatgcatgatgcatggattgctcccagccaagaacgtgtgtacgtgtacgtgggtaaaacaagacaactgaaactgaagctgctctgtcagactgtcactagctagctagttgctgtcaaattaaatggtgctattagactttgattggagtagttcattaattcgatctgcaagagaaggacaagtagtgatcgattgattggcatggcacaggtggctggctatggcagtaataagctgaacaaatcaaatgggaatgctctcgcagaagtaatttcgtctttatgcagataccgtcgcatcgtttttatatgttgtttaaataattattaaaaacttacttcttccaattccataattcctgatattttttacaatgacacgatcttcaaaatatatctttaactaagtttttctattataatatatacaatcaataaatacatttttacttttacttttacttagtactttacaatacaaatctgtatatgatggtctatgcattaaactaacatatttttcaacttattgaaagtaaaagttataaaaatttgggctgcagga

SEQ ID NO: 18280 - DNA, 1343 bp, Oryza sativa
attttgcgctccgcaaatttggtaagattgactacatttttatcttgtttgacgaactcaattttaatatctttactatatttgtctaatctcgtatgatgctgcaagttactccctatcataagatgtttagattagttggttgccaaacgactcataattctccatttggcttcccttgtttatgtagcatcaaggaggaacaactttaaacgagctgctgccggagaattacgtacaattccagtgccacaccctgttattgcagctagacacactgcctcacaacaaagcgcccatgcaatggatagcttattgagagtgaatccgaggatgatgaattggacaatggagtgtcagctattgaccaaatcaatcctccagctattccaaatcataatggatgatcgctgtctgtttcgtctagtttctctatttgagttttgccgaccacatcttaccattttgaatcggctctcgctttactgtccttctacctatatctaaggcgagggtaatcatgattcatccattcagatggcaaagtttagggcagcaaagttgacaccattacctccccatatttccctttttcactgtcatcttcattgccaacaatatcaagtgatactcccatatatttccagttcatattgttgtgcttttctgcataccactttgtgtgtctaacattttagtatgaaaattatttgtgtatctaacatttttagttaaatggatcgtttgtgtatctaacaattttggttaaaaagattgttggcatatccaacaatttttgttactaggattgtttgcgtatctaatatttatggaatggcttgtagatgactcattgctaacaatgaatgattgtttggggccagcattcctcaactcagtctgaagtcaaagataaataacaaaattcaagtctgatgcaacaaatttcaaaacaaacattgctacgcatatactaattaagaaatgacgaacttaaaaatgatttgaatgaatacaaatttagccttccttctgagaccacattgttcaaaagtactttaatgatggtccaagtatcctcgataggccttctcagactctttgactccattagagttgggtccattgctatgaaatacttgattagggaataactattctgtaagttatcaacctcaagtagtttaatagcaaatcaccttttgcaattatatggatcaaaaatggatgaaaacttccctatgttgtggaaagcacaggcagagccgaaggatcgtttcttcggtgtgcttgtactacatcaaagagaatttaccgcggagaacttgcacataaggcattgg

SEQ ID NO: 18281 - DNA, 787 bp, Oryza sativa
aattcctgcagccctccgtgctctatggaacaatcacctagaagcaatgtcagaagactatcgtcgcaactattaatgtgcacacacagtgcaacagatggttctaataaatatcagagatatgttgcagtcaatggggaaagatatacgatcgtttcctttgcccgaaatagacgagttacatgacacgacaaatggtttacctagggagatcattgaagaatccacgattaaggtagaccctcaagatgtaccattatcagactccctcaacaccgaacaaagggttgcttatgatgagattctagctgcaattgatcgcaaggaaggaggcttgttcttcgtggacggcctaggaggcacaggaaaaactttcctatacaaggcgttgctagctacagtccgcaaacagggaaagattgctgtggccacggctacatctggagttgctgcttcaataatgcctggaggaaggaccgcacactcccgattcaagataccactaaggatagatgatggggctatttgtagtttcacaaaacaaagtggaacaaccaagttactttagacagcgtcgctaatcatatgggacgaagcctcaaagattcaactttagtacaatacaagtataaatgatactctagtatgggaggaagtaatgccatgtattgagaaattatactgttcagcatgttcaacgcaaatatgtgagaatatctgtttgagtttttttttacaaaatatattttcattaattaggtgcattgttcttcccgatacttggaaa

SEQ ID NO: 18282 - DNA, 13524 bp, Oryza sativa
  unsure (1)..(13524): unsure at all n locations
cgcatattttccatacatttgtgtatcagtagactataatagttctggtagtatgggatagcaaagaaagctgatgtagaaaggtctcctccagcgtcactcaaaatacagtagctcccgaatacagtagcctcccataggccatgtaatgtatattccatcaggtaaatgtgttctgtttataaatatttaacgcttaaggtaaaatttagttacatttttaaaacttaatttgaccatcaattttatttagaataagcgcgttcttgtaatttaatttatagtggagagtaaattttataaaactatatatgttttgactaaactgtctcaaaactgtagatttaaaaatgtgtcggaaaactatagattaagccctaaatttaaatttatcataaaactataaatttaaacatcgtattagaaaattacagatttaatgacaaagctatcaaagaactacggattttccccgcaaaaagaaaaggaactacggattatggagtttatatccatagcactgttgaggttacaaaagttatagttttctgattaaattgattttaaatctgtagttatctgatacaatactttaaaagtttcgtaaaaaatatggtattaaatctgcagttttataatacacattcttatatatgtatatttgtaccagattgattaaagtacatatagttttatcaaatttactctttatagcattatggcactccattcaagagttcttatttgnctttcatgcccttcttttagaccttaaaatatgaaatggatatattccttctcatataaacatatacaagaaaaggataatgataatcctctcattgactattccatttttatttatgaatggaaatccatatccaacgaagacagattttcgaacttgctatcctttataattttcatgagaaacacatatgcatatttttttaaaaaaaaagactaagcaattaagagatcgttgatgttaagttttatcaagtctcgaaatttagtcaaatactctattcatggttctaaatgcccctgtttgcaggtagctagcccaaaatacaggcagtgacgtttattttcttgattgcccttgaggtcgacgcctatgtctccttttcctctttggcgaccgatgtgcacacacggtgcaggcgcacttgttgcgtttgcttttgtttagttacctttattagctgacgagcctagctatttcgatccatatatacatcttcacgcgcgtgtgtgtgcaggagtcttgtttgtcaatcattgttaagcctaaaagcgcagacgacacatgtaatgccggctgcgattgtgccgctagctattgagcggagtacatattttttaagataatggaataaaaatcacagcctctacatcatgtgatgcacacagccgaactatcgagctacatgtgtgtgtatatgtgctcctctgatcatcaaagatggaaacactgaaagaggagtagctatctatctagctttctttcctccttcctccttttggtagtgaagggctttggaccatgtcagtatacatagctagatactggtccctgcagccgtgcgggctccctaaaccgtgggcaaaatgcaagattcgaatataatgtgctactaacacgtataaaagtgaatttattttggaacgggcagagtactgctgagctataacgctgatcatgcatgtatttttgatttcccaatctttcaaatttgtattcagttgcatggagcatatggatcactcactttagccaaaaagtttaaattgacaagaaaataataataattcacttatactttcatagaatatactggcataactctatccatgatataagctacgaccaacttaaaattttaaataatttaattggggttcctttcatcaaatccgtcactcaatttgtacatgtcgcccaccacctctcatcatcctctcacacctttatctgacatatatccataaaggtttagaaatataaataaatgcaagaaaacatttctcatgacaaaactattggtgtttattttcccacatgaaattataatgctagtttctaaacaacgcgttaaatacgagtaacctttttgcgcatatcgaaagtaaattatcaagatcgagcaacaaaataaaggttcaggacaggcccatggtggcaccccctttgttccctataaggtcgatcggtcgatcggtcagccggtcaagccaaccttgatcgatcttgtattgccatcctacactgcaaagcacgccattggagagagatcgatagatatagatggagaccccagtgatcgagatgggccgggagagaaaaggaattaggaaggatggatggatgagggtgtggtttggaagccgccacttggtggagcagctttagttttgctgctatggctgctttagcctttaatggaattattacaatcgtgattggtcccaatccaagatggcatgcatcaggagcagccatgcccctcctctgcctgatgcaggcagcagctgaatgctttggtataggagcccccacatgaggttgaggtttaggttgtgtttggttgctagacatattttactgtagttaatttgtcacgtctaaagttaagcgggtttgatcacattggcagctgtttggttgtagccacaattgtagcacgattatcctcctataaattaggtcccacacgtcattaactcggaaatgtgtggcactattctcttagacttgctaaggcatcattaaaaatttgatcgtctcagcttagacatatgtggtaatatttattggcaaatggtggtaaaacatgactatgaaccaaacacaccaattttatctagcttagaaggctatagagagctacccctgtagagcgatcagtctcaggtcacgagccttactcactaagcaatgggaaggatcatgtagccgtcttttctctcgatctgtggctactctagatgcatgtttggattgttttggcatatagggtatgtatgggcagcataattattgcttaaagcttagcgaaagcccaaataaggtgtgctatatgtgtatctcctctagctaacttatgcctcctgagctcgtacgtcctttgttctcatccaaagaatcctttaataattctgctttacccctcttgtcacctaaaagaaatggttaatctaggttaggttgctacatgcatccatatctgttatatatactttgcgaggttgctgattccagtaactttaacgatacgttcgactacaaatacagaatacctatattgcagcaccgtcgcatctctcatgacttgtgagttgacgcctggagccccacattgccaccactacaacaaaaacccctcatgcggaggcattttgtagaagcgttttttaagttgcctctaagatcagaaattttattatgtaagcacattttttagagccactttaaaagttgtctaaacaatttttactcaggagacattttcatacattttgttaaattttatattgtagaggcattctttccgtaatttaaaatatgtctgatatataaagacatttgttgaggtatttttaaactttgagagacacttcctagaatgataatgtatactaagagacttaaatataaataacacaaggcacaaacatataaatattttttaaacaacacgcacaagataatgcgatgttacatattgatatagcagaaaaaaattacaaaactagaaccctgtgtctacaccatgtgtctacacccggatcccgctataattgggacaggaactcaacatcctgaaggaaagcatcttctgttttcaagaaggaaagcatcttctgaatgacgttttcaggaaggatacggcatcgagagtgccgccgccgcctgtcctagggtcaagacgtggttttcacctagagaaatccatcagggagtaggaaagatcattcaacaacactccaaggggaaagtgtcaccgttgctgacccgatgagtctaggcttttgcctatgatctttctacttccccgtgtcgaggatgcctgccagacatagagccaccaccaaccacacttcttcaacgcgcagccactgcgctagctcctcgccaccggccgaccatcaagaaggtgctcgacatctggcgtgctccaaatccatccacgcagttaggttggagagggagagggtgagagaaaagaatggatcccctctaccccgcactagccttccaacgtggccatctcgtggtggcaagacgccaccgcaagaggagtagcgtttggatcaggaccgtggtaagcctacaacgcctacctcacggcaccaccatcatcgtcgtatcctgtcgtggccgtgccggattcgacgcctccctcgcctggggggagggggggcgccaccgccacctccacctctagacctcactctcgttgtgcttgatccgcctctcctgcgccagaaatggggcacccggtgtggttagaccccgccaccaccatcccggcgatgagctccggcaatggcgaggtggaagggaggagggaagggcggcagcggcaagggctagggttgtgcccccgagccacctgcacgatgcgaggaccctaaatttttttaaaacatataagtaatgatatgtttagttggttagtgtattgaagataaaaatgatttgtccaagagatcctaagttcaaggattggaaatagcaaaggaaatcattttattcgcttcttttacatgagtttgatatggctatggtataatttaatgcctctagaaaatacatctacccctttatagacattttataaaacacctattcgttcatattcgtttgtaaatttatagacattttataaaacacctattcgtttgtattcgtttgtaaagacaattcgctataaggtacttattagttattttttaaaatgtctttacaatattataaaggcatttgggaagtatctataagtacttggaaaaatatttctacaaagcattttcttgtagtgcgcactcacctataaaggcatttgggaagtatctataagtacttggaaaaatatttctacaaagcattttcttgtagtgcgcactcatctcaatctccaaatccacgttgaggagcaggatccatcctggcgaccccacgtctctgattttgatctaagtatgtttggggttctgccaagtttttagtaggtttatttgctcgggtttgtcttccatgatgtctatggagttaaatttatactcccttcattcaaaaatataaggcacaacctccttaacccaaagaccaagaaataattattatcttttatagtttggatcatcctaataaatataatgcatgcatccaatagtattagataacatgagagtggaggatttagaaaaataataatttaatgaagaagatgtcatagttaattgcatgcttgcatgcatgccttatattatggaacatgtaagaaaaatgtggttgtgccctatattatggaatggagggagtaattgtttagagttttatcttttcattttctttcaccactacagaaaagggaaacagtgccgttgggaaacccccttcggtgccagtttttccaaccggcacaagggaagtgacactgatttgaaaatcaaaaaggtgccggttccgacaccttttaggttcgacgaataaaaaaaaagccggctctgtgtcggctcgattgagccgacgcatcgagccgagtagtccctcctcccacatccgtaagaatagaatgaacacgaaaaaaaaaagttggcaacattcatcccacaacattcaaagatagattcatccacatatcaaattttggcaacattcatcccacaacacaaattttagcactcaaatttatgcaataaaaaaaataacacctcttcagtcatcatcgcacggtcggtcgtcttcgagccgtcgcgccacctcccgtcgcgccgtctcccgtcgacgagcccgccgccgcgtctcctccgcgagcccgccgcctgccgccaccaacccctggtgagcccaccgcccctgccgcctccttccctcgctctggcggaggagagggcttatccccgccggcgagcccttggccgcctcccctccttgagcccgccgcccgccgccccctcctcgagccctccgctgcctcccctccttgagcccgccgccgataatggatctggccaccccgcccaccgctgaccccacctgccgctgacgcctcccctcctgccgccgccgcctcacctcccaccggatctagtagagaggagggcgcggtcgccgctgccgcctctaccggccagccgccggcagcaggagagaagggagggagagagagaagagaacgagagagaagggagggagagaggagagtgagagagaagggagcgagagagacagagagaagagagcgagaagggcaccttatctcctcgcgtcgcctcatcaaggtggggcccgccggctccactctagctcagctcgatttctatgggtgtcggcctataatatcttataggtgtcggtttttaattaaccaacacataatatattataggtgccggttttttaaaaaaaccgacataaatataataggcgccggtttttatttagaatcgacacctataattacttaaaggtgccggttttttacgatttcaacctgcggaggtgggaaaaggcctataggtgccggttttagcactaccgacacctatagtggcgatacctatttgatgttttgtagtactatttgtcagtgcagtggttcgtttgcgaggtagtaatgacactactaaaaaatcattttcccgtgctatcaaaatgtattttcacgagcgggtgggcgaactgcttctgatttagggcttgtaaaaatctatgatttgacctttcgtgaaaatcagtttttttaattttgtagttgaaaaagaaaaaaagtttcgtattttaggatgtatctttatactcgaaatatgcgtacgtttggtatcatctcacatattaagcagtttgtgactatggaattgacgctattctgacttcaattaaaattaaaaatataattctaatttacttagtctagttcttattgtgaagaactagaattaatttgagcaatgctacacgtactaaatttttcttactaaacttttactaacaatcatttcaaccgtttgatttaagtagatggaagttacaaaaaatctagatgcactcgtagcatgacacatcagtgttagtaaaaatttaataagaaaaagttagtacgtatagccctttccaattaatttacttggattaacgtggtcaacacatgtgcgtcaagcccatccctatagatcaacatcaataaagataatgatttcctttcaaaaaagatgatttcaactggaaacaaaagtgagaggccctaataatgatgtaataaattccttatttttccaatcactagacaatatttagacatgataaccggggagaaacaaaagtacgtgcatgcatgatacatggtagaggggtctgatcatatatatatatgcagcattctatggaaagttcttgctatgaattattatttttttgaccttgatcttgctatgaattattaggaattataaatacaaaaaaaaaggacattcttgttctgatgtgttgcttagctagctgaccatagtagagcagtcaagtagcagctacagggcacatcattgttcataaacatatgtatgatcagagtctgattcaaaaaaaaaaacagagaagaaaatctagcttaattatatcactttcagatgtagctagccaacacaatattgagcatatttttagacatttaaatccatgctttgatgaaggagctacagtcaatatagtaattgttaaaaaatctgctcatgatgagcacgcaccaacaagtctataatagcacacaaaacattaggaagcgatgcacactagaaatgtctagaccctacaattattgaagcttaattatgaatcttcattcgtttcattcgtagttggtgaacatccgcataaacattgtttctaggttacggcgtacagtcaacataagtttgttgtcctcgtcacatctttgttgctgtgctcaaatattaagcgtaaagctaggtgtattgggttatcatgcaaattaattgccactgaaaccaatactgttacagcatgtggacatgatactgcacttaatttgtgcttggcttaaaacttaaattaattatctcagcagtaccctagcagcttaactaatttactcaatcacttgctaataatcacactgcgtgttagggagggaaacggttgagactgagatatctcaagttacagatcaagaggagcatcgatcatgtacgtatatctgaacaattaatcttcttttcgggtgcatgcgcatgatctatttgtgcaggaatataccaagaattaatcgatccacccatagattcagtccgggtcgaatcaggggagatctagagagagagagatgagagaaaaagaaggaatccagatcatgagatgtgcaggttccatcgaacagaaaagagtgagctttcactaaatgatttataagattctgtgatgtttgacaacgtactcgtaccaccagatcgaccaaaaggttgtaatatatagatcaacgatgttctagcacaatacgtagatcgaattaaagccaaagcagatcaggccccttaaaattgtggccaaggcaagaagaaaccaatttactagcacacagcagaaaaaaatctttgatgacaacgaaatgctacgtggaatggacctgatcttgcatgaaacgtattgtacagtatgattataaggttaattaaatcatggcagatatatatgtctagctacttaattactctgtgaacaaaatcatatatatcagccaaatattccaatcaaatcattgagcctcccatgtatagacgtacatatatacatagcttctttttttcatgacttgaattctattaattcatcaatcatatttgcacacaagcttgatcaatcaacataaacaagctaggcaagattgcacagtactagcagctactacctaggctaatacagtactagtatataataagtactattaattctagatttattaatatagtgcatatacatatatgcatggattctaagcatgcaaaatctctcagctcttaagaggaaaactattgcagtgcagtggacacttctctacaaaacatgcttcatccatgtacatatacaaacacatatatactagtacgtactacgtggctacatgcacacttcacactaaggcacaaaaagttgtgcaaattgacacgcatgcatcgccggtgaccagccggcggccggccggctagtaggcgacgccggtgaccggccgagagtagccggcgtagtagtccggcgtggcggtggcgaggctctgctgctgcgtgcgcagctgctcgtagaacttgttgatgaactcctccgcctccaggtccaccagcccggccccggcgtcctcgccgccgtcgtccctgatcgggaacggcgagtcggtgatccggagctgcctcaccggcgccgggctgcggccgccgaagctggtgcgccacagcgccggcgacggcgtcgcggccacggcggcgccgccgtcgcccaggagctggtcgctgctgttgaggatctcgaagacgcgggcgatgtccgccgcgtcgtagttgtaccacccgggctcgccgccgttcgcgccgcgcccgccgccgccgcggcggcggccgttgctgccgttgttgttgcggcggcggcgcttggtggggatgagatggaacgacgacgggtaggagggggtgttgctgcagctgaactccacctccaggccggcgccgcgcgggtcgtagacggcgagcgccgggtcgagcgcgcggccgcacgagaacggcgccgccgccgccgcctcccccgccgccgtggaggcggcgtcagcggcgtggccgtggccgtgggaggcggtggcggtggtggtgttcatgatcttgccgagggccttgttgccggcgatcttgccgcggtggaggaggaggtggaggtccatggcgagcttccgcttggacatgcccttgcgcagcatgaacagcacggcgcgcaccacgtgccacagccgccgcgccatcgtcgtcgactcctccattagatgatcgccgtctctttgatggatcattcttgcaattaattgatcttgtctcgaataataattgagagagggatcgatgagcttgtggtgtttgtgtgggatgatttggtggttggtttggttggggttttggcacgaggaagagaagggagggaggggaggggtatttaaagggaggtaataatggtgggggatgcatggacatggttgcctaagggaaaagaaaagggctaagggagcttttcttgttaagggttttctattcagtggtgggagcttctggtttggagttgctgtttggttggatctgcagttgtttgtggaggattgtgatcaagtatacatgatagtattttgatgaacaggtgtagaaactggatcagagccattggatccgagcttgatggccgagatataatatagggagccatgtcgttccttgtttgcacttataatggccatgcattttggattttatttgcgcgcaccaggaagctttctagaaagtattgtattatcagtcgcctggtttttattttcaaaatcttagggtttttttttttacaattgggaatattcgagatttatgcgttagtttgtagtcctaacctagccccctcctcttttcatctcttttgatttactgcaaccatgacatggcccactctagctacttgtcaccacagttgtcgcaacccggacgatctacccccacctcgcctcatctccctatcgccctagcacacgacctatcttactagcgaaaacaatatattcaagagagaatatattatatgcccgtgagtttactctagctcaacgatttgtcattgattttatctatttctataactagaaaggtggcccacgcaatgcgtgggcatccgtattactccctccatctatttttgatagtcatatttcatattttagaaaatctagaaaatctgaagatagatataggtgttagctaaaaaataggagtagtcaccgagaaaagaggagagaaagagagaggccggagggagggaggtatagcacgtacctgcacatgccgcatatatgcacgatggggatgagggctaccggatttttaatggttaaaatatatgggtccaccgatttaacagaaaatcaatggctagatgtttattagattttttatgatattctatattttattagagtgccacgtggtaactcgagagcgtttataggatgacacatggtggtttaggagcgtttgtagagagtttaatagacttttagtatataatagatatatcgccgactttgtcatttttttctacaatatgtcattagggtgcatactttttttaaaatgcctaaaacgcccttcaagatatagagggttgacaattaatttacctactagaagtataaaaaatatataaaatttttacatagtctccatacatcacatgaagtgtgtgtggatttttcaatttgcatgtattaattttttaaaaaaaatataatttatgtttcataggctaattatagaaaactctagcgttgagttcttttatgtaaatcatctttcatatgctacacaaaattatttttctaatgtatctacattttgtgtatgtgatccatctttaattcataggagtaccacataaaaataatttttcaaaaaaaattgaagataatcttaaaaatatatacacaaacttttatgtagtatatgaaggctacactacatattacgaataaatcaactcaactacataaatctagtagtacatgtacacaagttcatattaaaatggtatagacgattatattgtacatactgatatatatatatatatatgctatagtacctaggccagtataaattaatatatgacattgtggtgaatacattgcaagttatatgatgtgtatacaaactcattttatggttttatatttggtgttttgatctaaatagtcagtttctgattcagttactcactacaatatagtgtagttatcctctaagaaaaaaagtattatagtgtttttctcggtcaatatccatcatgttttatcaagcacaatcctagacttctacagcaaggccaataaacacaagatgctctctgttttgctgaacaaattaagtatttgaactcttctagtcatataatgttaagttacaattgatatgtaacacagtaaccattttttaaaaaaagtaaacatatgcgtcaaatatatgtgttaaacatacgtataatctatatgtgttaaatgtagttactgttgtcaacctgacaacaaaccaaattattaggatcaaaagcaaataaaaaaaagtgtttccaccatgtttttaaccttttccacgtttgtcagctacgtgggctcaaacaacccaataacctgctaaagcatgcaaaccctacacatgaatgcaattattgaacattaacatttacttaggggaggacgcttgttgcacataatgctgaaaagttttcatggtgtacgccatagagcacttagaagaaaacactttcagattaaaggtacaatttctaatttatccatacactttcattagttgattatatattaacgtttgggtgcattagcactacccaatcaccaaattaattttaatgagaaaaaaatccctgtaaattagtgaaaaagggtgtttatttgtaaatagttattaatatttacacaccacatgggtttacacaccacatggcacatgggtgcaaaagaatttgcttcaagtttattcgaaagttttgcctagttacatcccttctctaacaaactagtaatcactaatttggagttggcataacttatggacatatcaaattgtatagtatattaattagtatttgtattaatttccataaattaactgaccaaaatagttagctatatggagatccctcaaggttgagaaatcaaatatccacatgtttacactaagagaaataaccaagcttatgcaacaattaggacatgaaaaccatgaggttcacgacacatatgcacatatattccgtgctctccttgtaatttccctcttcctttagttgattttacgcgtctgtgtactgtatatatagtatgtgaaacacacgttaacacgtctttgattcattggggaattttggttagattgattcaaacctcacatatattaagacccctttgatagtgttatggctttattagaccaaaggttttttaggtaaagctagagaatgcgtcattttcc

SEQ ID NO: 18283 - DNA, 11577 bp, Oryza sativa
ccacagcccccagacagcaaaccatgcagacgtgcacatatagctagctagctacttccatgataccactttaaatttgcccagttgcaatacaatccccaccctgagaccaaaagccttaagcctaattgaccacgttaactgaatgaacacatagtccacagtttaatttgttcccaagcaaatgatccatatatgcatgcatgtaacaggccaatgttaacgccatatgtgtaaaaaaaagtggtaacatatattattcttggagacgacagagcataaaagcaagcaaggtgtgtatatcatcatgcatgcataatgctttaaaggcattacgccatgcaattttatctcagcatctcttgattatatgtctgtgcgactgtgacctaattctaattctatatatctatcgtaacagaataatctctatctcgccgccactaccaacttccatttctattctcctgtaaggatagatagagcaccattgtccctgcttgcggctcgacttggacttcttcgacggattacaaaggcatagtgttatcgaacttacactcatcttctcaatgctagtagcattccttgaaatatatatgttgcctaagaaaatctaatctgaaacttacaaaaaaaaatgcttccaactactagttccttaattaatctcaaaatagaaaatcagtaactgtttttgaaaaactgtaacaatgccgaatggagcccaatatctatattttggtccatcgaaatatgttgccgggatatgcaccaaaaacaatggtgtggtttttatgtcgaaacattaatatacaactcgagtgatgaggcaagggactgcgtatcatgacagtgcaaggattgttgaatgagcaagccaaaaagaaaaacagaaagatgatcagttaatttctttgagctagacagctagtttcaagtgaagaaccactctcgcggatgacatacgcaacctggagtggatgagtggagaagttttgaaagatccttcattctctctctctctttccagatgttccacaatagatgaaagattttagttagccaaagcttctcctttgttctgagggccgttttggattagtgccaaaacggtgccctaccaatattatggtagtttgaacagtgcatatggtagttttggtttgaatccaaatcattggtattgccaatgtctagtttgatattttctatactctactcaaagcttgttctaaattggtctccaaccaaatacaactctaccctaccaaaatattggtagtgccaaaacttggcttttggcactaccaatattttggtagggtattaaaccaaacaaaccctgaatttttcattgcctctgctgaccaccattagttccattattgaatgaaaggaggtaaggtctgggaggttattgtattgaaaccatgtaattgttgtaacaatttttaaccaaggacatgagttctgacatttatttcaagaagaagagaaatgcattggaccacaaatagagaatgcaagacgacagggtggctccagatggaacaccaacaccaaagaaagaaacctataactgagttcctttcaagaaacacaacaaggtaggtgaggaggcgtcctcaattaaaatagtattgatgatgacgaccatgcatcatcatggcgacgtagaagctctgacttcaccatggcaaccttcatccgtcgcttggcataaacatcaccagcacgaacagccgtaattgttacaaagttaatgtataaatgtacgcattattatgttaagacttctatactgtatataatgtttgcatcttcccccaagacactctaaagtgtggacttggtttggcttgtggcactccaaaatggtggcaatcaatctgacacaaacctctattctacttctctaatatttattccaataccatgtaggatgatcttattaagtgtgaaattagacaaaaaaaatgtggggaatgatgaattcgtttgagagatcaccgttcgataagatcacttgagaggccaagtagtataaaatgttacaaagttgtgcctggcaatttggtggtgcttctaaggatgccacacataaagcagaagtatctcatttaggtccaattcagatttcagaatacgggagttctctcagtttcttgcagcaaactaggaatatattgacctttgttttaaaagtttatgtaaaattcttagtagttccaaaacataagaacgattagagtgacacttactggaactgactgcgctccaaaattttctaactcatattgactatattgagactggtggtcaaactcattttccggccggttgacttttttgtgttactctcattgatcgctttatcatatattctaatatgtcgatctaattgaacgacataaagaactgattctagcccacattatggtctgtttcgttacatactttacattattccctttttatctaaaaccacgagctctttttttctgcaaaagttgacagcaacagcgtggggtgtacagtaaaggcagggataaaagaactgcacaatcataagctctctctctccttttggattgtcttctagtttagagtcattattattatttgtatgaattttgtcttttatagcagaaaagatattaatacaaacaaatgcatggacattagatcaagacccaaaggacagaaaaaagtgaccaaaagatgacagaagcttgagtcaccttaccagcaggcacccacatggtatacttcgcgacagtgtagtatggtctgtgtacttgtttcacattttcagcttggtagtcatgaaatgaacttagaattaaactttctagtttatccttacagaagaactacatgtaccgaaagtgaacctatatgagttaagagtggctttagtttggtgggctggtgtggtgaccatgggttggacctatcctgtgctggaaacatcatttctagaaagaacaacgtgttgctgggcgcagccacaagtatgaaagtcggtgacgatggtggccagggtacttattcataagaatgaagaaaagagtagtgaaaccgaccccgacagaagtcggcacagccagacaaacactctctctctctctctctctctctctctctctctctctctctctctctctccatccatcccctgatcccctaagtgaagacgtgacatctcttgatgttgtcccagaaagcaatcaaggaaaggagataacctgtgggaggagctcgtccggagagaacaccgtccacctcctacacattccgtcgaacaggtggcgggcgcccacgcgacgggactgtagagaagcgagagacaccaaattacaccactgaaacacagagaagaaacaagagggcctccacgcatcggcgccgcctcacctcactcgccgtcgccggagaagatacgctccccgcaccgccgccgctggcacaccaccgtcgcgcgctgcggtgcgctgatctgatcgctgggctagagggtggatgtgactgaattaaattaactgggcttaaaatgaagcaactaactgaattgggcctggttacaaagcccgcacccacctgagcccatcctatttaggaataagttcaccgaaggtccctcaacttaacagcgagattttttgaagtccttaaccacaaaaccagaaatgtttacccctaaacttactaaaaccgttcactcaaggtcctacggcagtatatataggtggtttcgctgacgtggcatcctagtcagcaattttttttaaaaaaaaagtacatgggacccacatgacaactgcacattttttttcttctcttttcttctccttctcttctcttctctattcctcttcttcagtgaaagaggccggcggcaggcggagcggtgcgcgcggatgcgggtggcatagcagagggcgagcgcggcagcggagtgacggcgggccgagaagtggagcgcgagcgcggccacgggcaaagaagcggagggcgagcgcggcggcggagcgggcggagggcgagcgtggcaatggcacacgattaactgcatgatgcatgcacactgtgcagtatatatgaacatgaccgattgattctatctggtacgtgctgctgctgtcggtacgtgctgctgctatcggtgaagtagacgtcgccggtcctctggtcgacatcgaggccgttgaggaagttgaacggcacgccggcggtctccgtcgtcaccacctcggccagcccaccgcgcgccggcgccctcaggaggcccaggtactcgtcggccacgtacaggtcgccggaggcgtggtggaactgcagccccagcggccgcccgcacatgctctccggcaccaccagcttcttctccggcgagcaaatgccgacgctcctggtggtgaacaaatcgtcagtgcatgcgagatcatgcgcgcggcggcgcagctagatggatatggatagcttacttacgggcgccgacagcgtcatgacggcgagactcgggtctatggacttggtctcgtacgtcggctcgtcgctggcgccggcggacgtcgtcgccgccgccgccacaagaacaagaacattgcgtccccaccggcggcggagggagaggaggagaggaggcagccgtcgacggcgagctcaccttccgacacatcgcatacagcgcgacgagagcgtcggactggccgaggcgtatagaaggacgagtaggcgagggagggagagagggttgacggggagagcgcgccgctcgccggcagcggggccctaggtcgagcacccggcgcgttcgaacatctccgccgctaagcacgccgtcgcgccggacgccacttctcctcctctcccgccgccgccgtcccgctcagctgccggccaccgctctccccctctatcgcctcgcctgctcgagagaacccgaagagagaagataaaagaaaataaacagagagaaatgtgggacccacaccattttctcacttacacgtggacctcacataataattttaattacttttgccaactaggatgctacgtcagcgaaacccggcctatatactgtcttgggaccttttatgcacggttttacatagttcagaaatacacatttctgattttgtggttaacggaccttaaaaaaatctcggtgtaaagttgagggacagccgctgaacttattcctcctatttatagcccacaaagcattggcccagacagccaccaaatagtgaggcccagaagagagcggcccattcgacacggtcaggcccacgttgaagcccaacataaagtgggagtgtaaagctcacacaagagcggcccaatgggttcctcacgatgaggacacatgtaaatctcgtccaagaagagaaagttcccagtaaaagccggcaactagccgacacctaatggcagcagaaaagtccatttttacacccatgaacttttagatcaagtttcagtctcatcccttaaccacgaaaccggagatgtaacattctccaactatgaaaaccagagtgtgcacggtctctaacagcagcccaatttgaaaccgaaccaacaaacagcctggttaacacgtctagccatgaaaagctaggccccatacactagcttgattgttctgaatggattaatagatggtagattatatttgattttgtgatgataatcgatgtaaaagcgaaagagagttaactattacccgtataagttatattggcattattccatcttcaagtttaactttatatatacaaatacaaaacataataacagttataacacaaaacatatatcatatacaaatatactactccctctgttttagattataagtcgttttgactttggtaaaagtcaaattacttttagtttgaccaagtttatagaaaaacagtaacattttcaacccaacacaaatatattataaaagtatattcaattataaatttaatgaaactaatttagtgttataagtattatactatatttatccacaaacttgtttaaacttaaagtagattgactttaactaaagtcaaaacgacttataataatatgaaacggaaagagtattttatagtggatgaaactaatttagtcgtctagatcttagtacgtttcatcataaactaaaataacttacaatataaggaggatgaagtacacagttgagaagctatttaaatctaaacaaagtattacaagcaatttaatttaggtatagactacagttttgcgaaaattgaatcaaggccttcgagcaatataatcggtgaaaccgacgacgaggtgctgggccaacaaatatacaaaatattattgtgcatgtgtttgtctttaaaaaaaagttgagtactaaaaaccagtgcaatttgaaggagtggaaacagctataacagccagcgagagaaatgtatatcaacagaaaaaaaatattataatgtaaaaaggaaagacaatatcaaagtaaaaaatatagagtaattaaattgtatttatggtataacaactcgtggctgtgatttagtacaataatttgagaagtgaatattcaagtccaataacttgacaagtaggcacgtacattttagtataggaagttgacaatttatagtattttggtgtaataaataggtatatgttgttttggttaacaagtaccgggtgagttttatcacaatgtcaatatgtcatcatatagcaatcatgtggatatatataatcttgaatttaatccataagaattacactgctcattctatttacaccttagatttaatctataagatttacattgctcgattaatttgcatcattagtttggattttttttcaccttcctatatctcaaccaaaatataaaattttcaacgtagttaaatttatttgactttcaattactagaatgacaaaaattatgtatacttatacaaatctatgttatattgataaaataagttctaaaaactaaatgtgtcgacgtttgatgtcgcaattccggtatttgcatagtatggggatcgttggtaccaggatatatgcgagacatatgtaaaagagacggagacgaggatttttatacaggttcggacccctgaattgtcaggtaataaccctactcctgttggccgaagccggtcgttgctcttattcatcataatcacaccggtacaatatttggggtagcctatctaactgttgtcgacttggcggccataaaaccatcccgtaatcgacaacagagtagttttcctccttgaatccatgttcggcgagatcagagacatcgctagatccctcctaacggttgtcgtaggaactgtatggggactaactaggcttatctccgatgtcgatatccggcggcttgtcttggcgtatgttggcttatatgttgatcttgtgtcttgatctattgttctatgtcccctctcctctttgggggtcttgtatgtatacccataggtgtccccttgtccaagtagaactagggaaaccaatatggatacaatccgagtagtacttatcgcttccatatagaactctattcatcattccttatgcggaagtcctcctatatccgacagttgtttccatataagacatggtatgtggtgggtcttgccgagatttagtcaactactattaggtatgtggtatctataaccctgacaaaatgaatacagaaaaaaatgcttgaaataattaagttgttacaacgcttcaagttattgtagcaaaatcatacccaccttgtaagttgttgtaactatatgctcacttcttaagtccttgtactagcaaataacttggaatgcccctttgatccatcggttcaacaaggtttttctcaatgttgtgtgtgcttggaacattgatcacacctcagtctttgcatgcttttctcccatatttggcatacgaaggtgcggtccttgaacagatgatgtgttatttcgaggttgctagcaaaagtaattattgggccattgctagatttgcagccggtctgccgtctatatcttattttgtagttggagctattcaaaattttgcattataaaagtacccatgctttccatattagttttgtggccactggatctatcctcccattgaattgtgctatgtatgctgactttgcactatactttgcattgttcttccatcaccatctaatggtgtcatcaaccctttctgctaggattgttgacgaggacatcactagctcaaatatgaccatgtctaccttttgtattcatcaacaaaaggtgcttgcttgttatgtaggatttagtgttatatatttgaacaaagttactgcaccatgagttatgtgtcttcttgtttgtagaaatacttgcatgggtgaagaaaagtggagcaggcatacatagcacttggatgatcaatgaagtttattggggaccaaccggttgcctttcccaagtctattcacatgttaccgcgtcacttttgatccatagaagacaagaggtgaagttccccatgttttagattcaaattcgggccttttgacaagatccatttcaaacgaacatagcccttgatctagaaggattctcgggacccatgagtacttgctagaaagcttatggagtctaatttcatatggttttggtcccacgtcaaaatttctcaattgtcaggaatatgtaaaacaagccacgtacctcattcagtaattttattgtcgggtacgtgtaatgccccgattttcgttcgggattaaaaatcaataaataaatcatttctagaatttatattaaatggtaaagcaatttaatcaagtgaaatattgaggaaataaaaaatttcctttaaaaaatcatggccggaaatatttttgtaatactctttgtgtcctaatattctctctagattttttccgtgaattttcggagctcgagaagtaattttaacatcacaaagttcatttaatcaattaaattaattgaaaaaaaaattaaattctcctcctttcccttgggccaactccggcccaagtttccttccgctcgggccggcctccctcctctctcctcccttgcctctctcggccccggcctctatccgggccgcccgtgtgtccgcacacgtggccgcctcgtgcgcactacatggtgcacccactcatgcctccgtggacttggtccacggtgggccgaacccccttagtcaccgacaggtggggcccgcttgttggcgccaccctttttcccctcggtgacgtcataaatcaatattaattgcgcaataattcgagtttaattccggaaattcatttaaatggctcaaaagttctaaaattcatatctaattcatacgaacttcgaattgggccattcaacttgccaaattcatctaaaattgagctctacatgcttgtttactttttatgtacttttacttggtttttattagtgtttttcctcattttgcgtgccaatgtgtagattccgtcgtttcggaagatcgcgatcgcgaggaaaagtgttcagaagattgattgaggaagcaaggcaagtcacacattccccttgggcatattgagcctactttataatttttttaccgtttgcagataaatatgcatgttttgcttattacatgggaatagggtttacctatctactcgcttgtgccatgtttacttgacatccgttctttgttaaacttgggtgataattcgactagcttatgttacttatgttgacctagctagaactgtatgcttagccatgcttaattaattaccactagctcacataatgggataattacattattagacatctagtatcttgacgagctgcgtgcttgagacatccgaccatgtttcattagtcgtaactacccaactaaatacgacttaatggtgggctgtgggtgcatggttttgctagtcgcacccatggcaattaaggaccggttcacaggaaaccctcgaagacatacatcgcttaccacatgtgggagtgggtaactgcttgagctgtagtatagctcgaccctttcctaggcacccgtggcgagggtgggcgtgatggagttgggtcggctggggtgtccggttgtccaacttccggattcaccagtggcgcacgaggggactgcccactcctggttaggggtaggggtgaaaccttagcatggtgtggatggttaggggagggttatgcgaagggtcttgcattgtcacaatcactcgacatggtgatgtgtcaggcctggcacaatgacatgccggtggattgtgtcttgtggacacagttgtgcacctcttgccagagtaaaactattcgaatagccatgcccgcggttatgggcgatcgaccagattcagcgtgattagtctcacctttaataaattggcttaatgaactggttagttcaggtgggatggttaggcctattcaacgtggtgtagcgttgatcagtggagatttaatattaccttaattatcaactattttaccattttcaacaataaatgctttacaaccacctttttgcaaatagccacaaaccctccttgtctcccattgcacgtttgcatcattggtgtggcttgctgagtacggtggttgtactcagtattgctattatcccctcttttcagaagtgtagtgcttcttagctgaagatgaagttagacgacaagggcttagagcccagttgagttttgcctgtggagtgaagatgtagccccgctaggatcgcctttttccgttgctactgctttcttttctgtgtgaggactaagtgtctcttctgtaagtatttacgctttatttacgtttggatgtgtatattatttgtcgttttgtgtaccctggctgattcctggacagggatttaatacacaaaatagtctagaaatttgggcaaaatttctgggcgtgacagtatgcatcctagggctaaccctaggacatccctaatcatatttattcagtagccgtcatagtttcgagtcgggtttcacttagattaattctgtcgttacatttttgccgatggttcggtttgtggaaccccaacttcgagtctttaatcattcatctgcaaattgagttgcaatctacattgttcttgcttgtgtttttcgattcgcatgcagggattaaccttcttagtgaggtcaactggatagcacacgattgataaccaaaggagacttggatcctattgatcggaagccggatcatgtgtgtcaagtttccaccaaatctagagttatcagcatatcgaaagatctaagaccttagttcctaaacatctgtgttgttactccatatctaaagtagcatgtcaaagaattccttcaatagctagatcgatggtgagcctgtgccacttgtatccaccaatcatttgttagtgtttcatataccgatcgactcttctgctttgagtggttgtagagtcaattgctttgcttccatctcctatttatgtctctgttgctgatgttgcacattcggtacaagataaaatttcgattgttactcattc

SEQ ID NO: 18284 - DNA, 11523 bp, Oryza sativa
cccttaagacagcccttactactgctcctgttttggcattgccggatttcttgaaatagtttgaaattgaaactgatgcttcggctttcggtgtgggcgctgtcttgatgcaggagaatcatcctcttgccttccttagtaagtccttgggaccacgaaatcgtaggttgtcgacatatgagaaggagtgcttggctattcttcttgcggttgatcattggcgctcttaccttcaaggttctgagttcattatttgcacagaccagcggagtttgattcatttgggtgtccaaaaactcactacaccttggcaacagaaggcacttactaaacttatgggttcgcgttatcgtttggtttataagaaggggactaataatcgtgcaaccgatgctctctcccggcgcgctgctgacaattctgcagagttgtgttcagtctctgtttgtgttccgatgtggcttgaggaagtacaagctggttatgcttctgatgcccatgcctctcatcttattactcagctcacattgaaaaaggatgtagtacctcatttttcctttgatgctggtattttgcgctataaagggcgagtgtggattggcaataactttgccctacagtctcgtattcttcagtccttacatgctagtgcccctggtggtcactcaggagttcaagtgacttactctcgcatcaaaaatctttttgcttggactggtttgcggcgtattgtcaaagagtttgttgatgagtgtgctgtttgtaagcaggccaaggctgaatgggtacgttatcctgggttgcttcaaccgttgcctgtgccagagcatgcttggcaaatggtctctctcgacttcattgaaggattgccgcactcgtcgggatttgattgcattatggtagtggtggacaagttttcaaaatatgcccattttgtggctttggctcatcccttctcggcgtttgatgtggctcaagcttatctcaccaatatctataagctccatggctttcctcaatcactgatttctgatcgtgatcgcatctttacaagcacactctagacttctctgtttaaattggcggacacccagcttcggatgagttcggcttatcacccacagaccgacggccaaaccgagtgggttaatcagtgcttggaaacctttttgaggtgttttgtccatgcctgtcctaagaagtggtatcaatggctggcgcttgcgaagttttggtacaatacttctctttactcagctctggggacaacaccctttgaggtactttatgggcatcctcctcggcactttggtattgtggatattgcagcttgtgctgttccagatttgcaagcatggttctaggaccgtggggtggtccttactctgttgtgtcaacatctgcatcgcgctcaacaacgtatgaaggttcaagcggataagaagcggtccgagcgccaatttgctgtgagcgattgggtgtttttgaaggctcaaccttatgttcaatcattgtgtttttgaagattgggatcgcctgaaggagcgtgtcacgaccggaattgacccaacgggcgttccttacgtgcgtgtattattccttgtcccaggaggcaaggtacaccaaaagttgatacatttcagagtttatcaagcggaagcgtaaatagttaattcattacatgggcagcgaaggcccagcacacacaaagacaaacgagaaacagcggaagactagggcgacgaccacaggcgcttgacagcaggcacgagctagacaccaaagccttcatcttccagggactcctcttctgggtttggaaaaattgagcaagactgagtacaaccaccgtactcaacaagacacacccacaagtgcaggataaatgtaaaggagtacaaggggggttatgatataaagggttagggtttgcagtaacagcattaaaagacacttagttgctcaaagctattttgtaaacacgtttccagagctatacaatattattaatcaaggccgtgaacccacacgagcctgccttaacccaaggcctctgatgattcagaccgaactagcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgtcacataccaccacggtatacggacggaagacatgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccgaagaccggtccttatatggccgaggtgctactatcaaaaccatgcaccccgagcccagcctaaaaccattttggagattttgaatagagggtgaggtgtgaatccaattccacaataatcaaaccattccatagtgtccaggtgatatgaatctcccaaagtctagagttgtaaaaccacctaatgttacctaattaattagcgaagcatctacctaaaattatactagtggtaccatgagtagagtgtctactagttggggttttgtttattctagggtgaacaaggaaataataacaataaaaataataaggtcataacaaaggtaaataggcatggctagataaaacagtgataacgcgggaatttaaataaagcgataatgcaataatttaaatcaaaataattttataaactgggatttaatatgttcaaggatgatgtgacttgccttgctcgctttcccaaacgtcggcttcaacttccacgaagagcggatcttccgaagctgcggcgtctacacgaccaacgaaaaaaagaaaaggcttttactctaataaactccatataacaagcaggaacaaagcacaaaaatgggttcttgacttattaaggaaaaattagagacttgaacggtccaattccgagttcaaatggccaagttatggccatttgaagtttatatgctctttaaatgaatatttgcgaatttcttcatttaaattttaattaaaaaaaaggtttattgcgtcagccgaggggaggggcgcgcggaccgggtccacgggagtggggcccacgcggcagccccacggtccacggtggaccgggcgcacccgggctcacaccggccggcgccgttggtcccacgcgtcagccgcacccgagggcgcgggcggctgacagccgggccccacgcggcagccgctcggtgcgcccgaaggcggccacgccggcgcagcgacgggaggcggcgcgcccgcgcccctatggtcgccggcggcggccataggcacggcggagcggcggccgagagaggggagggaaagggggaaacgaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcggcgaggatgcggtgaagccgaaggaggcggcgccgaggtgggagatggtccggggcgacgacggcggcggaccggagctcggcggtgacggcggagagagagagcgacggcgcgagctcgattccggcggggagagagggcggcgagaggcggaaacggacggaggaggtgcggggagggtttatatagggttgggagtgagagagggcggccggaggagggggaaatgggcgcgggagacccggccgccattaatggcgccggcgaggttaggggagaggtttccaaacgaatccgagggagagagggagggaaaattggggggaaagggggaggggatcccggggaataattccccccactttgttgcgcgcggggacggcgggaggcggcgggattcgcggcggcggcggcgctagggtgcgggcgaggcggcgggagcggcgggaggaaggggatgacgggtgggccccacccgtcagcgagggtggcgggcgggcccgcccgtcagcggcgcgcgcgcggggagaggccggatgggctgcggggagaggagagggagggggaggtagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgctggaggctttcacacagattttaattattctaggcataatttagaggatgtattttagagtcgttttgggacgtgacagagcgttttcctgtagtctcggcttggggacaagccagttgcgaagaaggggagaatgttaccaaccctgttaagcttaggcccagtaggagtaagcggtccaatccacgcgtcagtgggccagagtgggtggcgtgagtgttcagcctgtgtatataaaggctatgctgtaatcgtgctggttatcgaattgaaaatagaaaaagctaatccccaacaacctctgcttcttccctctctccctctgttcatctctcttcctccccaagtgctcggtcaaattcttgacagaggttgtgacaaaaaacccctttgttttttaatttgttaagagatgcgctcatagcatagtggcaggggttgctgcatgcaccctatcggtccaggtttgattctcgtcgagtacacacaccaggttcgattctcgtcgactacgcacaccaggaatcgtcgagtacgcacaccagaaatatttacttttctttcttcttaaaaccattgacaccaaatcctttcttggtgtctaacctttttttaattgtttaaatccatcagttgatccaatgaacttggttattatacaacaatcagtagtcggcctcaccaaattggcgatttctcagtttcgatagaacatttttaacaatgaatcagcgagcataacagatgctgtcaacataacagagtagtttgacttgtttctggcatacttcacgtacagataattaagtagaaaaatatctctatactattcaaaatgttggtagctagcagtggtgttcattttcacaccacctctattactagcatttaggcttacaatctatactattacaccacattcaacaattcctctcttttattattggcttcaccatatttcaaaatcacaaatttgttcaataagaaaaattgtagtattacttagaataaatatatatttattacttgatttaataagctagaaactcaatttggttttcgtgacaacacaatcaattagtcctgaacaaacaaaattccaagagtatctacgttttgatgactagctgattggtcatcctacgagagtctcgaaccaaactgtatcgaacgtccttttgtttacgaggattgctatagcacgggatttcattccaacgcgatactttatgaatctaatcctgcacctcccgtttttcccatgttcaagctcccacattacaaagaaacaagtagcgtagctccttgctcccaccggtcacagcaacaacagaggaaggagggagctatcgttgagaggaaaagaaaagagaagatgagacaatgataggtgacttgccggtaagttagacgatgacaacgcgctcttttcccctacgccttgacccggtacttgataccattggtatcagacccgatatctaatacctgataccaggcatgataccccgagatatcagaccttggtatcaaccctctgatacctaaggtatcaactgtgacatacttgtacacacatcagtgagtacaagtgatgggttggcaagaagcagaagaaacccaattccaaggtcgccatctacgtcgagactagtcgcttccacccagcctcttcctatcgacgcctaggacctcatccccctcctccgccgcctccctttccttctggttgcacatgacaacccccaatctcacagccatagttggctcgctccttgactataacccccctgcccatgccaacctctactctttcacattcttcggatccagtgtagctagaaagggagaaaagatgataaggaatgtcgtcggtgttggagacgatggtgaaggagtcgaggagagtgaggaggaggatggccactggggtagaggagtggatggagggaggagaaaaacgaagcgctgctacttggtgggggagaaaaacgagtcagtggggaaacagatcttgaagatatgtaccgttcacacctattttatcacgtgtccttgtgcccccgatgggattccgtgtattagttttttctgtttgtttgtgggagtttagaattttaaggaataattggttggtagctagattctaataatcaagagaagttggatttcctattttttgacttttaattatttttgtagattttacacagcttctcagattttagactttgtattgtttacgagagcttctaattctgaaagaaactacagtcgctagaaacttccaaaacaagccctttgattggatgaaccagccgggattcgtttgtgcacggcccaacgtgtcacggagcccattcagtgacccggcccaggtaaccatgggccattgcccatgaggccacgcttagtcgcctggtcgtcgcagccgttgcatatgccatgcatgcgcgcgagcgaaactgcaacaaccgccacgccagagtccaccgcacgccacgctctccgcttcgatcggcggcggcgatccatcgatcccctcctcgctcccgcgcgcgggcgcgttgacgtaaccacctcgtcctcatcatcatcctctcccgcctcgccggctctcccatctcctataaattccgatgataataccatctcctgatcagttcaattttgtcataatcggctgcttcttcgcttcaattctgtgttggtagcaggcgacgctcggtgtcttagttcatggctcggagggatcagctggtctctttcctctgcttcttcctgatcgtctctgccgtcgccggcggcttgtgcgtctcggccaccgtgctcccgatgcgggtggggaagcagtacgtcgtcggcggccgtagcgggtggaggacgccgccgccggctagcgtcgacttgtacgccaagtgggccgccggcatccgcttctacgtcgccgactccattggtaaggcccccaagctagctataaaacaattcgaacatcgaagaatttgttcttgattcaattcatccatcgatttcatgctgcaaatcgaagagttcgtgtacaagaacgattccgtggtgaaggtggacaagttcgggtactaccactgcaacgcgacggcggcggcggccaacgacggcagcgtgctcttcctcctcgacgcccccggcttcgcctacttctccagcgccgacgccgatcactgcaagaagggccagcgcctcatgatcaacgtcgactccgccccgtcgccggcgcccgccccggcggcgtcgcccatcgcgaaacctcctgccgccgtgacggcggccacgccaccgccgccgccgccgccgccgtcgccatcgccttccccgagcccggcgccccaagaagccgcaacggcgagcgccgcaacgtcgtcgtcggcggcgacagcggctcacgcattgctcctggccgcgatggccatgatgggcttgattcttggagagtggtagtaacaacagagtttgcattgagctaggccatcagggtgttagttaattaggatggttaattacttcggtgcagtatggaacgtactggctggagcttaattaccgtcgctgaactgaataatttcgatgtgaattagacgattagttgttgatttgtcgctttagaatcgaagaagaaattaagatctctccattttcatgcaaatttctgatttgtgggaagagcttgttgtttcggttcattatacacaccacgtgtcatcaacatctgcaccgtgtgtagggtgaaaacgggcatctcctaggaaacgaagctcgatcgaccggtaattgattatatatatttattatttaaactacttagtgtcgacattaatatgatgcacaaaaaattagaaaaaacaaaatttataaatagataaaaaacgatatggtcggaaactgtactccatatacgaaaaaggcgttttggtcgatcaggaattttcgtgaccgctttcaccctactgtgcggtatgaaaatgccttacccgcatgcagtctatgctagtggtaccaactgatgactaaactaggtcccgatcttttcataggtattgataattctcgatttggaggaaacttgacacatacgatccgacttccgatcaacacttcaaaccctgcaagcgcagcaccacgtctattctagttatcaaccgtgtcaaaacccggttgacctcaccgagaagactaatgactgcatgtgaatcgaagaatacaagcaagaataaagtatagcaactcaattgcatataaataattaagaactcgaatttagggttccacaaaccaaacaagcggcaaaactgcaatggcagaaataatctaagcaaaacccaattctaaattatgacggctactaaataaatataatttaggacgtcgtagggttgctctaggatgcacgctcccttgggcttagcccacgacacaattgcaaagtccaagacccaaatcaaattcgaactggacgaggtacgtggcttgatttgtagattcctgacaagttggtgggaatcttgaagtgtgaccaaaaaccatctgaaagtagactccataagttttctaataaatactcatgggcccggagattccttctagatcagtggctagttccgtttgaagttgacgttgtcaggagtcccgaatccaaatctaaaacatgtagaaatttatctcttatcttatatggaccaaaagtgacgtgatgaggtagaagtggacttggagaaggtgttgatttggtcccaaattaactttttgatcatccatgcattccttatgattggtctcttttccttcacccatataagtacctctctaaacaaaaatatacgaaactcattgtgtagcaatgtttgttcaaatatataacaagtacatctactatagaccatatgtacccttagttgataaatacataaggtagccatgatcatatttgagctagttgtatcctcgtcaacttggacatgggcttgaatcaaaggtagaaacaactggaatggtgcacatataaaaagaacgcacaaatgtctatgttttctttaataatggaattaaatctggcctttgctttaatgaaaatacaaccaattattatagtattctcttaaaaaaagcaaacactcaagaaaaaaataacttaaataataaagccaacacataaggagtaaataattattgaaatctatttgtgaatctccatccgtagtgcagaagtgtctacgtgcactactcaaaacagctaatagcgggtagatagcagattattgttcatgtagtggtcggatcacagatagcgttcgctaagttccaataacaacatctagttaccactcataaatttctctctctgtctgtgtgtatcataaaatgttattacgtgtatcgatatcaacatggtatcgtaggtactagacacaataatcatatgtaccaggctttggtacctacgtaccatgatgatattaatatggtttcataggtaccggatttcgtaacgagagtatcaatcataccatgctgatatcatcatgatgtccagttattccgttgaaatgtatacttgtatgtagtatttgtgatatcataaataataactttctaacgaattaacaatggaacaaataaattagtgatagatcaatacacatataacttaagagtataaatagatatctagttgcatttaaggagttgatgtgtcgtccatcagttacatctaagactcagtcgatctgctattatggtctgctatgtcatattgcagccgctaagttccaacttgctatcatatatctgacccactagctacctcgtagcggtagaggtagggatactaccgatacaaagggcatcacatgatttttttttgaaacatagtacaaacactgacacccacaacgtgcgcacactcacctctatgaacgcgcctgcacacacaccctacccctacgagcacctctggaagactgagctggcatatctttagattgacgaagttaccacatgtgtctcgctgttgaaaggtacgtcgcctgctactaaaaaaataattaatcgtaaatatgatcactcttgtcaaatcttgaatttgaacctgggtgggctggttccaccacaaggaacttaagtagctgagctacgctcatttcacattaatttttttgttcgatggtaataagcgttgttaactcattaattgtacggcatttgcaggctatattaaatcgcccgattgaaatggtgcaactttgaagatgcatgtatggctattacaatagtgcttgattttgatgcaaaatactactagcatgagtagggtgttcgtgagaaagaaaatagatgaaaaaaatggcaaataataatgatagattaggttggtatcttgaccatgttttttcggagcatatggatagttggtgtcagggtatacgtgagattgaggtaaaagaaagacatgaatttttatacaggttcgtcctcccgcttactgataggtaataaccctattgttattggctgaagtctgtattgcctttatagatcaatatcacacgagtacaatatatgagatgacctagtttgtcgctgtcgacctagcatcatcgctgtcgacagtgtagtgatctttttccttgaatatgaactcaacgagattggagatgtttctagatctctcatgtcagcctctctggctcatacattgggtttgtctatatttgtattggcttgtcttttgacttggcatgtcccctgatttcctcctagggggtcttgtattcatactctgggtgtcccattatacaagtagaactagggaaacaagtatggatacgatccgagtagttcctgtagtgtccgaatagaactttgtttgt

SEQ ID NO: 18285 - DNA, 1271 bp, Oryza sativa
aaaggtgtaggttctaagaatgaaaaaaagaaaagcaaaaatcccggcttggtgcatcgcttcgaatcgagccaatacatcaaacagctctccatcatcactgagatcaacatcatctccatcaaccaaacacaatgatatcaccgtcatcctatcaaccaaacacgatcacaaactcaacaaaatcacaaatacaaatacatagaaaacgacattgtcatcatcgtcgatcccgcctcccccgtaagcacaacagtgatccggtcgcctccgtcgtcgtggcggcgtcggtcggatggagaagaggaggaggaatgaggggaggcgacggttaaggaggaggagtgacggatctagaaagaggaggagggaggaaaaaggaggagcggcggcgagggctaaggaggaggaggaggaatcccttcttacgactataaagttatcacacggagttctggacaagctctcgtcatcattgaattgcatgatgtatgatcgctgaccattcacatgatgtcacactcgagcacatgaccaataatttatcacggacctcctgttctttcagaaactgtactcccgcttcttttgcaggtcatatcactcgcaaacgccagtgaagcaactcccattagttacaagcagtgcgtgcgtgcattatcacaagctcttgggctgatgcacaattaatgtgggaaggtaaggaataaatgaagttgtacaattatatcctacctcttccgttccataatataaaggattttaacttgttacttgtactgtttgactattcgttttattcaaaaaattttagaaatattttttttgatcgacttactttattatccaaagtactttaagcataaatttttttttatataagcacaaattttttgaataagacgagtgatcaaacagcgcatgaaaaagtcaaaatcttatattatgggatggagggagtaatattttagttgcacgaaacttaactcaatcaatcaactactccctccgtctaaaaaaaagcccaaccttgacatggatgggacatttcgtaggacaacgaatcatgacagggagtagaacttaatatcaaaaagtgattaaagtttgtgaccattttcatgttattactcccctcgtctcaaaatataagagattttacaaaatgtgacgtactccctccatctatttttgatagtcatatttctgaaaaatttatttttgataggcatatttcaatccaacaacctatcatcttaatgactttctcg

SEQ ID NO: 18286 - DNA, 1326 bp, Oryza sativa
ctatacttcctggggacctcttctcgatctccgccttccaaccatatagcttgtcaaagctactatcccagtcaccatacaatttactcatagctaattccctcccagaatgtactctcttgtaggggatggttaacttatgtgtgtcctttatcctcctttgcaattccatggccccaacactagcatcctcacgtagccaccccataaccttatcacaaacccacgctctctttgcattcctgaccttctcgctttttctagtactaagacaaccatggtacatctcatggaccttaatctgaaaaagaaaaaatatgcaattagataagaaaataacaaaatatgcaatgtaacacattaatgtaacacatacctgcactgctggaccaccatgaatagttgacgcatgaagcctccatccacatccttctttgatacatctagctctgaatctactaggatcagttttttcaacaaaaaaactcgaattctttcttaatggaatattgagccacagccaatctaaactcacacattgaaggataaatagtctcaacagtcatgggtgggttttctttgtcatatgcaacttgtgggattactggatctgcctgagcatctcgtgcaatccactcttcatcatcactatcagtgatactcagatcatctcccccttctacctcaggcacattatcagtttcagcaatagagtcatcactctcagatgaagagtcatcactctccgatgaagagtcatcaataccaactgagtattgtttctcatcatctacacctacatgctcatagtgcggaatggattttctaggtatgcatcacttttggatgcctgactagtgctgccttcctgagtaaaaaatgcctgagaggggactgaaagtgatggagtgcaaggtacaatagcttgggacaaattaatttggtttcccagagtgattaccactttaccccttttagtatgatgaaagcactccaacattgctgtcaagtcctgatctttgcatattggaatgagttctttgctactagcatgaatataatgcaaacatacagtttcatttaaaccccatggatatttttcacaaatatcacccagaaaatctttgaagttgttacgtctgcatcaataggccatttgaaagaaaaaccacccggaaattcaggcctacatgtcttacccattattctcacgtcaagtaaataagtagaagatgtgtccattctgttgatgaacacatcgtcgatgtgtgagaagaaaaatgtgaaaaatgtaactgctctgactccctaataaaagtatattac

SEQ ID NO: 18287 - DNA, 12785 bp, Oryza sativa
ttagagtgcttgtcaatggcatttcatggattttctcttatattaagagtaaataaagtaagagatagttatattggtatttgataactgatggtattatatttttttttacttttttattcatatgtgtggaatgggtgaaaaatgattctattctgagacgttgatgagactatgactgtatttgtggaattgtaaatgagatagtgattatttttttaagataatggaaatgcttaaatgggaaactgatacacttccgttttgccggctgcccatgcttttcccagcaaaaaagagtaacatcactttgctgcctattcctatcggtagttacatcctgcaagctcttttcgcttgccatctgtcgcttaattgctgaaaccatgtgccggcctctacagctacagcacctacacatagtttcagactccagatcaagcctgaaatgcagcgatcagtaagctaagggccctgctttaatcaagccttaagtacgtgtctttcaaagttttgcgagcttatgagaggcagacacatcgcacggttaggcgcgaaaacaacaggggcacaggacaccgatcgttccattccatcccttgcgaccaccacaaccatcaatggtagtacagcaatgctcctctttcccttttggcctcttaaactaaagaatttttctttcgtccgaatctttctttaactgctcttttttttcgtgtcacgaactcgggaaggcgtgcatattagcttcttgtaatttgcaagatgcaagtggttacgagacgtattagtaccttttgtcaaaagggaaagaaaacaagaaagaggttagtacatgagacgctacctttgggacactttaccatgcataggttgattgatagacaatgcatgctacgggtgtgtttagcttacgccaaaattgaaagtttggttaaaattggaacgatatgacggaaaagttaaaagtttatgtgtagaaaagttttgatgtaatggaaaagttaaaaaattgaagaaatattttggaactaaactcggcctacattgctacgaccgatctgaactgtactccctccgtcccaaaaaaaggcaaaccctgtgtttccgtgtccaattttaactgtccgtcttatatgaaatttttttataattcgcattttcattgttgttgaataataaaatatgattaatattttatacgtgacttgtctttttaattttttttataatttttttaaataagacggacggtcaaacgttggacacggaaactaggtttgtttttttttttttttacggaggggcgaagaatgtagcagctaacgtcctactacggtgctagtgtactggattgcatgtgtgcagttgatcgagggggtgaccggtcaagtcaatcgtccgaatgacgacgcggacaaaaggtgctggctgactgggtctagccacgcgcacaagctggattcgcttgatagttttcgcggaaggacgcttatgattttgctttgtgagagagaagcctctgctgctgcctttttgcatggttcggtttcagcggtcggagcgtgataactagccataggttacgccgtgtaaacagtgagcgacattgggctcaagaacgtcggaagcctcacgaacgtcttgggatggaagtacgcagatggctgtgctgtgtcatgtttgttttcggtcaccaaaaattacgcactgttaagctcaaattgcagtgctatgtgatagcctgataggtggtagtattagttttccccatcttttaaactgtactatagttctaaaaaaaactgtactataaaagatctctaattactcattatcaaacagtgcaataggtcatcatactaatcggtttgtagtactgccttaattcgtttgttcgttcgttaggaagccggcagcggccccgcctcaactgttcattttctttacatttctgcatttggggccaaggccaacggaccaacatcatgttgccggtcaggatggccaagatcattgcacaaaagcagctacaatgccttaccggttgatctgctcaggtgacaagttaatagtacagaatcgaggcacacattttacccagtaggatctacggctctcaaggatgaaagaactggttgcaacgacacagcatcaaagttctctcccacaggtcgaaaaggaagggaaaaatcctcacacaagaaaaaggggaaaacgccgtcatatacacgtattttctctaccgcgctatttctcttgctctaatacatgcacagaacaagactgcaagggtgatggacagaaaactggaattaactcggagcttgctgcttgccctgactcatctgaatattccttgtgcgttcatctcatctcgatcgggcgattccctttactttctcaaggggaccccggatgctttacttgcgcctatggcttagctcaggacgggcacattcgccgcgacggcgacactgccggcgtcgagcctgtggcgctgctcgtttcttgcagcgcgctccctcgcattcgtggcgctaaccctcactgctgcttcgtccatctccatctggtgatcccggcactcctcgctgcagaatggcgtgttccctctgtttgttcacaacaaaaagaaagctcagtcagaaactattcagaatcagagctcagagaagctgatcgcttggtgatcactttgtattctcctgcctaattatccaagtgattcaaccgataggagcaaaattgagcgtgaaacagacctgtacatgaagatgtcgcagttcctggtgagcggcttccggcagagggagcaggcgtccatggcgtggccggacaggcaggcctcgccgccgtcgagtggctcgatgtcaaagaacgaagaagaggacgacgacgctgacgccatctcggttacaacttacaactcgagctgaaagatccgaggagagaagaccgatgagctgagcaagtcttggggatcactgccaatacgggagagacttgaggctctcctcttttataaaagagaaagggggttagtggtggttgctgagtttggtgcagggggatgcgcgagaaaccacggctagatttccaggaatccgtggcaaacaaagcacggctcgcatcgccagcacacacgcgggacacggctaaactggccgaaccggcgcggctagggccaacacaagaagtgttgccccggtttttgtttgtttggttgctcgcgattagtctcccctggttgccttggagaccttggtggcgccggcgttgtgaactgcaatgctgcagaatccaccggaagatctgtaacaaacggggacccggtttctttatgcgcaaattcgattctatggggacctcttgttgtggccttttgctagctgtttggttttgtttattgcgccggtctcgccacgtgttgaggagtgcacatgactaggacacattaaattacaccttcaatgcggtattaaggacattaactgatgatagtttagtcacatttattatagtgtacaataatttcgaaacagagaggacatgtttctacgtgaagcatgttgctggctttatgtattttctcactcctttttggaggagaagttggcaatgaaaaagaggaggaaaggcaaggaaactaccggagcgaggagtgagtagtgaggctgtagcagcgatggcgacgcacgcgtctctagttctgtaccgcaccgtgtaaactttggaagcgtcaccggtgtggacacggacaatttacggtggatccaggaacaaattgcaggggatctagtagttaacatatgtatagttgcagtccgtgtttgattggttcttgacacggataggaattccccttgacccgtgttgaccacgttggacgtacgccagactgagacactgacgatgacaaacatttgtgtccgagccgacgaccccatggtcaagtaactaaagtttctgtcatgcatgtccttaacggacttcagggagagacagattcaattcgtctgcttcagttcagtacgccagaaaattcatagacgtgcagggcgcgttggcgtgtcgaatggtccacgactccacagtgggagtggatctacgatccaggaagcacattttccgtttcgtggttaatgcacattttctgttttgtagtttaatgacctggtctgaacatgcgtgatccactgatcccatactatagaattgcgcggtgcagcagttcagttcatcagaacggtgaccgggatggacaagggcatgcgtgccgaaatttcatttcatcaatatttcttcttgagttttgcttttgaaggagattgttcttgcttcttaaccatatatgtttttctcagagagaatcagaaatattgaattctaaatgctgtaattttttttacgtatgtatgtagatactccctccgttctaaaatataataacttttagccttcaggatttgtcccaaaatataccaccaacattctcttcccaaccaatcacaaccctccaccattaactttcccacctacctccactattcatccaatcacaactctacaccacccacttctacctaatttcttaacaaccgtatataattctaaactttttatattctgagacagagggagtaatagtttttagaatcaactagccaagcccaaaatgtttagaattcatactccgtttatgacgggctgggtatcttagcccgtgtaggcccatgaacgtcatgttgggctttgttagtttatgacgtttttttggggaataagttcactatgggtccctctatttgtcgtcaagtccgattttcgtcccttgaccacaaaatcggatatgacccgtcccccaacttacgaaaaccgggcaaacatggtccctcggcggttttgatagtggttttggctgatgtggcgcctacgtggctaatttgactcggtcttcatctgacttggcactgacgtggcgcttacgtggcaaatcgaatcgaaaaataataaagcccgtgggacccacatgtcattttcacacataaaatttttttaaaaaatagtgggactcacgtgggccccacatgtcatactcaccccctcatcttcttcctccctttccatctcccctctctccatatctctcccctcctctctctagcctccaggcgccacggctcactgggtcacgggaaggttcagcggtggtggccagcgacgcgacagcagccgccggcggcgagctccacctctcggcgcagccgcgcgcgtttctaaccatgcgtgcgcgcggctatctgatggcgtgggcggcacggatggattcatggatctaatcccgtgccagcacgtagcccccggcgacgcgacggcgagacgacgacggctggcgacgtcgctctcatgccggcaagagagagtacatcttcaactgccagcattaatttgcatcgagagagaaaattagcagtagcatcaaataatatcgtttcagtttcgtcgtaattaagctagctagccatgtgaggagtcagttccatgcctcgatcgatcgtcggcgtcgaagaggggtcaagaactcaagattaggcgatcgattccatctgactcatcggctgaatcatacgagctaccgtcaattaagtactcgtactaacgtacgcgtgtaaatgctattgactgcatgagagaactgtacaagtcctgtgcttacacaatgtactacggcctagccatgatctagatgatgcagcaaaagaccttttaattaattagtcgatcgacaagcgatccatgcatgcatgggagtaatttacaggcttcgagttcatacactgttgcattgtgacttgcgaaaaacacagtgctacactgagaattaatgatggtcatccgcagctaagtaatgatctgtgagcaattagcaattaccagttactgacaagaggtgagtaggtaaaggcattattagcaagaactgcatcggatcaaagttcattccggtggtcaaaactcaaaaccccagcgagctgaggcgtgagagcgacgtcgccggccgtcgccatctcgccgtcgcgtcgcgggggggttacgtgctggcgcgggattagatccatgaatccatccgtgccgcccacgccgtcagacagccacgcgcgcgcgggtcagaaacgtgcgcagctgcacggctgcgccgagaggtggagctcgccaccggcggcggctgtcgcatcgccggccgccaccgccggacctccccgtgacccagtgagccgtggcgcctggaagctggagagaggaggggagaaagatggagagaggggagatggaaacggaggaggaagaagatgagggaggtgagtatgacatgtggggcccacgtgggtcccactattttattattattttatgtgtgaaaatgacatgtgggtcccacggctttttaatttttccggatcaaattgccacgtaatcgtcacgtcagatgaagactaagtcaaattagccacgtatgcgacacgtcagccaaaatcactgtcaaaaccgccgagggacctcgtttgcccggttttcgtaagttgggggacgggtcgtatccggttttgcggtcaagggacgaaaatcgaactggccgacaaatagagggactcaaagtgaacttattcctttttttgggctgtttatgacgtcctaaaattacagcccaaaatgttcgcgggttcagatatgaaaagcgggagaaccgggccgtttcatacatgggctttccgggtcagcctttcgtatttctggataattttgcttttgctcaactgttcatctttttcctcgcaattcaagtatactatccaatattgccagattcccctctagaagttccacttcgtcagattaagatggaaacatgcacacttttttaaggtgaaaacatatgaccatctagtgctaaatcataccgataaaatacaacacgttattcggttattgctcttcatgttgcttcattagaacttatcttgagggtcaacgagcatgtcagctcttctgccccgagataattgattacttcgattggccagacgatgatgcgcgttgggttgacaaaacgcattggattcaaaatattatcggcgacctatcagctgtgcatgagctaaatgtggatacgcgaatccacaatcgttttaccgggagcacgcattcccttgcaagtttcaagtcacccgatgagactagccgatcatgcatggaacacgccgcatcaaaccatccatcaacaagatcagatcgatactggataggtcacacacggccgcgatacctatcaacctcgtgaagaatcagaccagactccaacctaaccatcccactaggagagaacgatggcgccccaaaattacaaggaagaaaagaaaaagaagagaacgatctgaacctgcaacagcgacccattcatccatcgcggcaacaacaccacccgtgaagaaaacggatcagatttcggggcggctgctacgagctatacgaccgattcgcggccggacttgcagccgccgctgccgtgcaaccaatccaatcctaagggggaggtgatgccactggcgtcgcacatgacgctaccggacggcgggttaatagccgggcgcggcatccatccatccatgcgaccatgcgtgaggcatggggtcagtctccgtcacgcacgccgcggaggcaggcggatcgcgttggtcattggtgacggcggtggtggtggtagcaggtagcgcgacgagaagtgcgtgccctcgctgcgatttcgctcatctcaaccacggctgttttaatggccctactaactgaacgctgctgcagtccaaaaggaccaacctttttatgaaggcacgcgtactcactggcagcatgcatggggatggggtgcgctactggtgtactgcttaccgacggtactagtagcgcgttggacggactaataacttatttcatcgggttaggctgcatatgcacgaatttgtgcatcatctacggcctggagccctggacgctagcaccttgtcactgcatccttcaattccctttgtaaagcttagcggtaaaaatttctcacagatcggaatcgctctacgccgttggtcgatctcttcgcagatacgtcaagatcgtaaggtagaagtaattaattactccgtcatagcagtggcagtactagtactactcccctactgcctactgtaatgacagtatcttgcatagtgctggtggtgcctgccgttgcgacgagtccgtcgaccatggcatgcatgaggggcaagggctcccctatacccacgtcccaacacccatccaccctggcaacgttcgtgccagcctgcggctgactgctcctccctgccacctcggcgaatccactccccaccaccagcgatgtcaagcagtcgcacgccccgcgattcggaagccgttcgctccgcgcgccggtggtgtgcgcgccagcaaccgacaaccgaaggcactgtgctgccgtgccgtcccgcgcccccgcaataacttcaccgctccgaggaagcgcgtcagttacctcgcgccaaggcattaacggcctccgcgcgggggtttgaggtttgagcaaatgcgggggaagggaaaccaaccacgtcgaaaccgcacggcagcacgggatggatgaccaccggggtagcatcacagcacggtgggtgtgatcggctgttaatatcaccaccaagtacagtaccccctataccatagtaccattggtaatatctacatcagttatgtcaatgggttgcaaagacgccaagacaggcacggtggaagcaaattaggagcgaccagttggggattatgagagccagaaaaaggaaaagaacgtgcagcttcagctttgcaaattgctccgtactactattaacaatgaacttatcaattgaattctcctaaaccccaaatataaaaaaggagatttgaggaagtaatcctcggtggtaaaaaaaagttggaaaagatatgaacaagaagatgaaagttctaagttttttttcttcttccctaattatgattttctgggatgggcaatgatgcctccgcaccagacactcacgagatggacggccgagatgagacgacgacagctcaacagaggatggcctccacgccccctgtccggacgcaatggcagacggggcacgccatggccacgtccacgtcgccggcggcgaagcaatcgccgcagaggctgaggtgcctgcaggggaggagcaccacggtggccggcctcaggcggcaggtgaggcaggcgcggtcagacccgctgcggcgcgggtccacgtacgccgacgaggacgactccgccgggcccgcctcgccgccacggagctcatcgccggacgcccgcgccgcggccgcggcctgctggagctgcgcgtggagggacacggcggcggcctgctccgagagggccttcgcctgccacgccgccgcctcgctgcggaggcgcgccagccgctcctcgagttccgcgccgcgccgcgcctcgcgctccgcctccaacgccttctccctgagccggcgcgccgcggatcgctctgccgcgacaagcagcgccctgttatggcgccgcacccgatcggccatcgcccgcctgagctgctcgccctgtccaagaacgtgccggcacatcacgccacggaaaaaacgaaccaccgaaacaaacggatcgtgtggggggcaaaatcgtcgattacctgctctttgatgaatcggtcgagctcctcatcttgccgcttcatctgtccggcaagctcgtcggagaacgagacgaacggcatgggcgacgacgagtagcacaaggctttcaggcgtttgctctcttgttgttgctgctgctgctgctgctgctcatccaatgccaggcgaaggccagtggacacgagtgccgccggcgcgcgggacggcgacgccgataccctgttgtggagctgcgccatgttgacaaacgacgtagactgctgcggctggagcgtgaacagattgaccaactcctccttggccggcggcggcgccatggcaatggcctccctcgagcgcttattcctccgattaatcccactcgctgcaaagaaaccaaaaccacatacgcccatgtcacaatccaagaaccgtagtgcggcggcgccatggcgcgaccttgaactccttcaacatcaggctatctatctatcaatcaatcagtcagtcaccaccacccacctcctccgctgggaaagtacacctccggcgagactccggcgaacatctgcggcctgggcaggtccatctccttcgtcctctccggctcacctctgtaaaccagacgacgaataatccatcagcccaaaggaggccaaacctttaaaacacgtagccgccctaacgaagaagaggagacaagccgcacctatcgtggaagaggagactggaagggtactgggcctgtaccgccattgttaagaaggaagagagggagggcgaggcgaggcgaggcgagaaacggacgggtgggtggttcgcgaagcgggaggtgacgacggggaagaaaacttcctcgcgtggttttaataggggtgcggacgagccgagtccaattccgagagcacccacttcgcacgcttgcttttaaaacctctcatcgcaaggaacaaggaacggaacgggctcgcaccgcgcgctcgctcgatcgtcgatgggaaacgagtgatgcgtgaggagggagcgttgcaccaataaaaacggaaaagaagggggcctaaatttactggaggcagaggcagtagaagaaagatggtagcggatatgggtggttaaaattaggatcccagaggatcgtgggtggattaaaagttaagcgtctgttcttgattttttttccttacgttaatgctgaagattagtgatcgataaatggtgtctgtggtttcgctgtgccacgcaataatggtggccaaggcttttggaatacgccgtagttagtaggaggaagttggaatacaaggacggaagaaagtttcctttgtactagctgagccattgaactttcgaaatatgagatcatctatctattttttttagataatggtgagatcatctatctatagatctaccaaatctttttctatactaatatgataatcaaatgaaatatttcacattatttcaggagacagtgaataagtatagcatttttttatgcgacagcccttaattagaacatgaataatggtataacatcttagtctaagaagagaatactccttccttgtaaccggcaacgaccgatctggtcagttgcgttgtgtaacaaaactgtattttttctaatatagtgacgtgtactccctccgtttcacaatgtaagactttctagcattacccacatacatatagatgttaatgaatctagacacatacatatgtctagattcattaacatctaaatgaatatgggcaatggtagaaagtcttacatcgtgaaacggatgaagtaatttttttacgcgttcgtgaaaaaaaagagagagagagagaagagaatgtcatgtagaatttaattttttaagtaatggagatgagagaagaataccgtattaattaccaaacggtatagtagacagcttaatggaataccatatatacaatatgtatattatctatataacttaaataattaattgtaatatattattagacaacatttttataagtcatctatacctcgtctagatataatgtgaaaatattatcgatagtggctgtacgaatcattgttcattcaattcacttagattataaggatgaacaaactaattacaacttgttaagtacttagagttatttagtaactaaatcattaaaaaaagaatttaagcggagttcgactttgtatactgtaatttcaaatttatggattatctatcaagaaaaaaattgttactccaaaccatgatgttatatttattaagtagaagcacacatgagttgatcaaacatataaatttcaaatattcaagagttcggatttgtagatttgataatgtactaaactgaactctgcaaccattagagctgggtacttattaatattcaatcatatcattaaacaaaaaaaatacaattgtgactctaaacccaatataaccttatatttcttaatttaatcagaaaaatagcattataacccaatgacaagtatactttgaactccctccattttcagattataagtcgttttgactttggtcaaaatcagactactttaaatttaactaagtttgtagataaatataagtaatatttataacataaaattagttttattaaattaataattgaatatattttcataatatatttgttttgggttgaaaatgttaatattttttttctttaaaataatttaatttaagaaaataaattatggaagtatttatgagaataaaagagtacaattatccttgccccaacaaaaatttcataggcacgtattagagcagacgagctacgtggcctggcatagagctagcgaaggccgttgcagtatcgtgacacacagctcaatgtgttgcttctacacatttttagttcatagaaaaaccagaatcattaaacgatattcctacctcctaaatatatcacctaattgtaagctaagcatagttatgatattaagtgacgtgacctatcttaggcgtattacactgtagcattgtcatcaagcaatattatgt

SEQ ID NO: 18288 - DNA, 7609 bp, Oryza sativa
catgcaccgttgcatctaccttccttgcaaacaacccctccccccatgtcaattttcgcaccccggatttaattcctcagccttttaaaaaaatttccatccatcgatctgcacgtgatggcgattgattctgcacactatagcagcaagtttacctgtagatgtgtagagccatctggagaaggatgcataaactaatcatcaacggcgacaaaagtatacaattcgctggtggcattgggggttaagctagcctcgaatgtatacttcacctgatctagagacagatacagatatatcatctggttccctgcaagactagacgacgcgttcgatcgtgggcacgcgattccggtttggaaatgcgtggcctcgtcgtcaaacccaacgcaaatgcgaccgaaatgtcaatcacaccaaacccacacaaacgcaacacaccacaccactactactcctatactaatctctttttgtcagaaagttcgtggtattgcatacctacaccggatttccggattggtttgatccccgttgtttaattaggccggtacgttgcaatcgcgaagaaacggccggtcaaatccggcgtggccaggacgcggccacacacgcgccacatcacacaccgagacgtacgtacaggcagcttcgcggcgccggcccggcgcgttggtggcgacgacgactgagagctacgggagctatagtgtgcgctgtttcagataacgcgccggttaggtctccgacgcgaacgcatgcagagaggggttaagtgcgggcgaaggaaaggcgggggaagatgacgacgacgacgtactcccatcgatcgatgccaatgaaatgatccgtccacggccatgcctgcactgcactgcaacctctctcttttctttcgcaagtgttccgggtgggcatccatccaactgggggcgtggcatgtgatgcctcgttgctcctttcgaccgccgctgggtcccctctctccctccatagcttggaagcacgcacgtaatactagcacctaactgttgaagatcgatcgatttttgcaattcttccggagcggaattgttgctagtggttgttgctgtcagaggcaagcgaccggcgcctagctagctccgatcgggattcagatcggtcgaccgagaccgatctgttggggtcttggtatgtacgtgcgtgtacatgttagttgatcgtttagtaactggtagttggagcttgtttcgcttgctcaacaatgacttcgtttaattatccatgcagagaaagaaaattagtgcatgtacaatggttgttaatagtggtctcttagcgttgctaattaggaatacttgttgacatggaggaaagagaaagaggagagacaaaacatcgttgttatgcatgacaatggcttaacaacgactcttagtcactataatatgaaaatatggttgcatgaggatataaatatggaaagaatattaacaaaaggaatattttttgagttaatgattaaagcctttgtcatctcaactattgtaaagatatggtctctaaataatcttatattgtttaagagaccatacccgtctctaccattgaacatgccctaagtccctgacagagacggtaaccaaactaaaaaaacgatctatccggatggattgtaaagacggattggcggtacgccatataagtaccttcaaaatcccctgcatgccggaccttgtcaaatttcacatgcatgtacttgagtgaggttaatggaaccagccaaccactaggattcaatcgaaacttcagcgcggattacatcgatctcgatcgtgttcacatgttgatctagtaccggcgttcatgatctttcagcaaaagcgatcgaatacgatggatgttacagttcacgaccgtggtggtcgcgtcaaatgtgacaacgaactctcctcccgtcttgacatttgaagcttggaccagggcctacctgtcactcgccggcaatgtacattgggggcgagccctgttgctatccgtctctccatatgcttggaacccgtgggtttgcaagcaactagctagagagcaagtttactagtatagccaactattaattttaaataatctatagttaattaaatagacaattcacacaatagttatatataaacatatactacactattaatacatggtccacctatcatatatacactatgtcttaagtccgtgctgtaactggttataaatctgtatcctactgccctcttctctcttctcttttatctcatcgatatatgtttatagctgatttatagtctgctattgtacccctcctagtactaatataaaacacatatgtacgaatacctagtaatattatattccctctatttcatattataataactgctttaactttttaagtcaaacgtctttaaagtttgataaattttatagaaaaatatagtaatacttgtagcaccaaattattacatttaacattgaacatattttgatattttttttgtttcgtgttaaaaatattgctatatttttctataaaattgatcaaacataaataagtttgactaaaaaagttaaaacgacttataatatgaaacgattgtagtacacttaatattgtctccccgtttctaaatgtatattgctattaatgtttagacatgatttgactgtttgtcttacttaaaaaatacataaattaaatattatttttatgttgagtacattcaaccaaactatggtaaactataaatttaagatgatatatcacaaaactatagatttaataccaaatttatcacataacttgaaatttttcaccaaactacagatctagtaatagttttgtgatatttaaactgaaacatgtagtttatgataaatttaatgtttaattaatatttttgtgatacaccattttaatctatagttttataatagttttgtcgaaatatccatagtttttatgaaatttactctttttatgttaaatgtactttaagcatgccattttgttcgtattcacaacagttatgtaacaagatgaataattaaatgttacatccaaagtcaacaacgtcatatatttataagtataaaaaatatttttctacaagtcaaaatttagtattggatactctaaaaatgtgatgtctaccggagggcgggaaactattttaaactctcgagggacatcccttcgttattagcattccatccaaatggttagattaatatgtgataattaaatcactccacaaacatgcactaccatatttaatgtctacaagttgcaacgaacaaaaatattttttgactgcgaatatacgttaactagccatagtttaatttgtttttccgttgcaacatgtagaggttaaatttaaactttcatatttgtggagtgatttatgatatattaatatatctttttgacttttttcaaaaaattttataacaatttagataacatacaaataacgaggggacgtccccttagagagtttataattcattcccatcggaggacaccctaaaaatgtagctttggttgtagacacctaaccaaacatgctttttttttctctaggacaacgcctgcaatattatattatttccgactattttagagggagaatcaatgtgaaatgatgagaataatgttcctagaaaaaaacttatgtatttaattggaccaagccacctcgacactgtcacgtttacaactgtagtcgaaccacacctcaaattttgaggggggtatgctagttattttgcaatttcctctatccaagttagttaaaaatgataaaataatattaccctcattttcatgcattaaagaaccatagatttgatgtgttcatgggcatagacacatttttagggtattaacgagtaaataccacgtttttttttgcggggaaaataccacgttcttagctagtgtggtgttgtaaatttttctctttttttttgagaggaataaaattttcttttttatacaactatagtagtagcctcgcttgatgtaaaactcaaggaatcgcaaggcatgcatgacccagacttatgtttctttgtacgagtgcatgcatgcacggttcaaccttagtttgagtcatccgagatgtattgctcggaacagccgtcccaaatggctggcaattaagctaatctaaacctgcaaaaaaggcgtacgtatggatgcatggatgcggttcgatcgtgttgcccccgtacggtttcaccacccgtcctgttttcctgcgtgtaaattgctcgccttttgcgtgttcttttcctgagaatataatcatgcacgcacaacgcctcgctttcccctgtgtaaattgctgccgcctgcgtcgtgtcgaccgatcgattgactttaaacaagaggagaattggagcgcaaaggcaggcgaggaagatggcagcagaagtggagtggcgagtgctgtgttggtgttgccgcctgcctggtgcctgccggctgctagatctggtctgtggtcgcccaatcaatctcccccgtctccttccctgcagattcccccccacgtctctcatattttttttgcccggtttctctcatcgctagctctcgcgccgtccgtttccgcgacgcctttctttttaacctgtggagactggaggagagcgctgctgccgtgccgagatgtgaacggaatcgcgatacggtgcaagcaagcgagtgcccccggtcgtgctcggctcgtacgcgcggacacgcgcggcgcggccggcctcgggttggacgagcgatgggtgcagcagatgttgtcacgcatcaccgctggatggatggacccagggggtagctgtgacgggagcaacgaataaggcgtgatgaaccgtagccgcgcaagcaattgcacaccggggttgttccattccatctcaacgtcattcaattttccccggattttctgcgacgtcgttcggttggtttggagcagcgccaccgctagctatacgcgccgggggccggccggacgtccggtgtgatgctttaccttacaccagtacaccactcagaggagaaaaaaaatgaattattactgtttatttatttattacctttatttatttctgaaatttgtgaggtgggtgactttgccgtatgaccagggtaagtggagggtgtaagggatggaatgtgtgtggctcctaacctagattcactcgagtaacacaaggctaagcttttatttttcttttcttgattacatgaaagacacatgtacagaatattttgcacgtacattacattcgcatcatgcacctgcaagagtgcaagggcatctctttatcacaggtttaaagaaaccatggttatcaataaatccctagcattactaaattcttattgaaagtgtagccttatacgtgtaagccattcccaacccaatgactagaatggtgtccatagcattaaataagctatcacctaagatgaaaaatgatgtggcaagtgaataaatgaagaaatagaagaaaaccatgtcttgcatgagacatggttcctacacaacatccaagatatcatgtgagataagtagcattaaatttaagtatgtaatagtagtgattgcattggaagagtagtgtctagtactagttttcttgatgatgtggagtttatggaaaccatgtctaatattttaggttgagaatggcctaatattcactagctaagttcttagtgggaaccacaaccatatatagattttgtagggcttttataccaattaatgaatcagttcaattctactattgttccaaagaaggcctaagattatctctggtagttcccaaatatccttctatcaaagaaaaaaaaaatacatattcaggatttcggtgtctaacagtttacccaataccttccactatccccaaaagttattgactcaataatccatctcaactccctcaaatatagggaaagttgcaactcccacataaagtagttgtctctcctattactgccaacatgcatcaccagctcagctggccgtcgaagacaccatgtggatcatctaagaggtgttgtctaaacctcagtggccattggccactatccaatcgtccacatgtcatccatcggctggtctatccgagccttagtgcggttctttcccacgcccttacttggccattgcttgagttccacctccccccactcccgtgattatcaacaagcctctgccgacaaaactttgtcgtcggcttggcctccttgagctctaactgtggtcagcccctgacgttaggggtctttcgcttttgctagatctctatagagatattacgagtcctccgtcccaaattcccttgccgcaaccatctggttcaccagtactatataccaaaaagtctcatgcttacgttactgtgactacacttcaccacacctagggcttgaccctgccaaaccctggaggagttgcgtccgatgcaccgccaccagcgtcgggaggtcctccatcactactagcaccatcaccggagagcagctccgtgcgagtacctcctctcctcgtcccgctcgagcccccatgctatcagatgtcatcactcgaagcctgctctctcatcttcatctgacatatagatctcattaatactgggatgagatattggatctatcaaaagcaccccaataaccatgaaattggtatttgggaatctccaataagccaattttgcagatgggatatgaatatatgatagtgggatactgttggagatgctcttacatattacatggcttataataacaagtttgaccaatttttaccatttgaaatcaattatacaaattttaatattgaaaatgtatctttaactgaaattagtgaagtattgtcttaaattcaaattattgacctcaaaattcaggaattctgatgaagtgccaaacacaacgaccaaaaggaatactccaaaaatcacttaaaaccttctagctgtgaggattatcgatcatgatcggcatgaccagcaggctgacttaacaacttggtaaattaaaattaaatccataagataaaaaacaaaatagcgagacatgcatggaaacatctctagtgtggacatcggtgctttggcattatcaaattaggtttgacatttgcacgcagaagacggctagacctgccaattaacaaggcacatccggatcccatgttgcaagcttgcaatggagaatacggttacagcttctttgagctgacgtgaacggtgttaaccatttacttctaaatggcgcagtggacctgctttgatagaactatccgcgaatctgaccaaaattaacctctttttttaaaacaaaaaatgacaggaaaacaacggatgtatcatgaatggtgatgatagctagcttggaaactggaataacgtttgtttgtcgggttcaaagaatggctacgtattgtggctagtgggggtatttctacttctctatccaagctgagaatgcgtacaatacagcgcaatcatgcgcgatatttgcctgcagatttctggtcccttgcgcggcttgcgcctaaaacacggccgattgtgt

SEQ ID NO: 18289 - DNA, 10701 bp, Oryza sativa
  unsure (1)..(10701): unsure at all n locations
cctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggggttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattatgtttgagtacatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggaaacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtgacaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggttctgtgcacagaaccaagagaagaaatttaatgagttgtgggacaagttggatgagttgacaacgaagcaaacagatgagcaatctcgcagaccacaagttgaaggtgacgagcctcccatacctcttggcgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacactgagtgcccaagttttttacattccagatccatctaagttaagggtgaaaaagggtcgacgccaaactagacgcatcagaaatgatatggatgagtcagaagcaggtgggaggactttacgctgcagcaagtgtgatatgcgcggccaaacttacaagaaatgctcgaagaatgcagaagttccaagcggcgcagatgctagtccatctggacaggcaagtgatggtaggcgaccacctggtccagcaagtgatttgcagccgggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaacgacgctatataattgacaatctgaaggcaacctctttatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcttattcattagtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcaagtataaattcgccctcccccagagcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctatcaattttcaaaatgaaaaattattttgtaaaacttttaataaaaaaaattaaaaataaaaaaaattcccgccaccaccagtcctcgcctcctcacctccttcccttctcttagctcgaactggcgtacttatgccagcgcatcgtccccttctccctgacacgcaagcacgatgttgcatcctccccaatgggcgatggcaacttaaccgagcaatggttccccatctctgagatttgtttgtgtgtgtgattttttttttggatccgctgatttctttggtgatttgtttcgatctcctaaaatttcggtcataatcaagattgagagcgaattacttgcattggtcttcgtggtaattcagtctctatttttacatgactgaattcctgaaaagactgtagactgcgactgatgtcatcaatctaacttaatatatttaatttttaaatagtgggttagttgtgctacaccgctactccatccatcctgaagagcatggctaataatatagccaaatgcttgctggttttatagatctttacagtttaccgctcagccaactcgtatagtggttagctcttaactataaatatatagtctatatgtctctctcatatattttcttggtttctgtacctatgccggctataaatatatggccatccgcgcctctctctcatctcctctcttctctcatccatctatcatttagccttctcacaatcttctattagtacttgcttgtaacataccgaaaactaactattttctaatcctgcatcatgccgctttttatgttcttaataacttcctaaacctaggaaaatacaattagagggaccttctaaaactaacttgcataaaatctctttctggtatttaacttcttttgtgtttttcatttaaaaatatagttggttaaattaaggtgtttcttgatttggttttaatttaaaaaccttctttagactaagattcttttattcaaatttagtttgaaaactctttctatttttttatgaattatggtcaaagaaacattcccatactgtcctagaacctaaaacaaagtaattccaattttattataattaattgttagcccattctttgttcttaaacccatcctttgattctcgatccaaatgtccaaattcctccttttgatctagccaccaatttaattcctgtggcttgatttcctcttcggcacaagaatagtattattgtaaatattgtgaataattgctcttgtgctaagaaaatagcaatttatattcttcactcaactttccctattagccacaaataattcttcaaatacttctactatcaaatttaggattcaaatcctatttattttacctccaaccattctcctccaaacatatatatacattgaggaattatattgttaattcccctctcatttgagtgcattaaattccaccatattccacttccaaaaatattgcactcaaattagaaaatatctgttttggaaattagatccaaatataatttcctttcaaccttccctattcaaattatctccaaatatattttcctttcaaaatcttctattcaaatccctttcaaaattgagaaaccaattctacctaaattgggccgaaattctttttctccttcggcccaagccggcccaatacccagccgagccgccaacttgcaccgtgccgtgttcgtcctccgccgctgctgtgccttaccctcctcctccgccgttttctccttctctaagaaaccgtcgccgctgccctaccgtcgccgccaagtcgcgtcgatgctgtgccgtgttcctccttccccgccgcccaactccctggcagccgacgtgtgtgcgcgccgccgtcgacatccaatcggagcacagagccgacgccgtcgttttcttttccacggcgccgtcacgaagttttccttgatcttcccctctggaaccgccttgcgccaccgccttttgccgcctataagtattcggcgaggctgccccttttcccctccacaccatcgagctctccgagctccttctctctcctggccattaccggccaccaccatcattggctgatctccctcaccggagcaataccggccaataactcgcgccatcgagatttcctcgattagaggattccatttttccccttccccccttcctccacctctgaatcaaacctcaccgaagctctctctctcctcccagttcacgaccttgcatccgccgttccggccatttccctcactccctttgcaggacactgccccttctaggtgcgctgcactcgggaacaccaccggccgccggcgtcgttgccttccggccactggagctctggcgcccctcctctccctcctgtcagtttgctcggcagtagaaggaagaggaggaagacgacgggaggaagaagaaaaggaaaaagaaaagaaggcagacactgacaggtgggcccctgcacagtaactcttcgtattttctctatttaattcaaatcctaatctttagaagcccatatctcctaaaccgtagatccgattccattcaaacttggacctaaattcatataaattcaaaatctatattttgataccaaatttgctattttaagattctgtttgaatttccttaatttattcaaatactattagaataaatatttgattaaatcttacaattgaatttacaacttaaatttatatttgcttttcaaatattttattttattccaaattacccctttagccactaaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggccgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtgcgtctcgtccggtcggagtatgtgcaatgtatcagtctttagaattggccaagattggtacccggccaacatctttcaaacggccaaccgggccaacaactttcaaacggccacccgggcctagctgatcccatcagctgtagatttctcaaacatcgatcccctttttcacaacggcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18290 - DNA, 1357 bp, Oryza sativa
tcctgcagcccatgaagtccttactcacagaaaacaaatccaattttataatataagctagaagtagatttgctagataaatttctagggcgatgcagggagtccatcctatggattgtatcacccttgatggtggggagatggcaccccctgcagcggttaattctatattagtaggaagcatagatatatatacaataattaaattatgacacaccggcttgatttttatcttgggttgaacgacgtgcttgatgtcctaagcgtcgaccttgcatttcatccatatacattggaattcggttatgtcttcgtcgacccaactgtatcaacctagcatcaggctcaataattggaccattataagttggccactccgattgatttccatatgggtgaaactgaccagcccaagtgtttgcgagtgttgtagaagagtagtaaggatggataaactgattctcattaaggtttctatcttttcaaacagcaagcacatgagcacaaggaatactagtaaggttgggcttttggcactcacatgtcggaatagcattgttgcgcataactagcttatacttgaaatcccttcgaacatacacaacacgatctccttgatgcaatgcaactcgttcacggtcaaccttcacctcatattctcctctttcatcaccatatgatataacatgcatggatccggccttggcccctcgtttcactaataacttctcaacccgtcgagaccacattttccctgagtttgcaagatcaagagaagatcttcttctatcaataaaccattctaacacttgttaaatgtttcctccactattgccatgactggtaatctccttgagtacttgaacacattatttagagactcggagccattacttgtcattatcccccatcgatgtccaccatccatgcactggaaaacctttttagatttttccggctcattcttatcttcttgccgatattttcccaccttaccaagataagcaattgcatctggacaagttttgaaataacttccataccttcattgaatctacgtggtttcttcttcttgacaacccaattaaaagtttttaccacatcatcatctttacattgcttgtaaagattctcagcaatatgttgtgaacaaaatcgatgcacacactcaccagcactttcattccatccaatatgtggctgcttgaacacccatttgatagctttgtggcgatcagaaataacacacacaaatttaccaaaaccaataacctctttccgcaaccatctcatgaaccatccccaattgtcactgtcttccttctccactattgcaaatgcaagaggtaataatttg

SEQ ID NO: 18291 - DNA, 1803 bp, Oryza sativa
ttcccatatagcttccacaagcaagtattgtctatgcacttcatacttagtcttgacttgttacttgtggtaacctttacttcttgattggtactaatgtgaaattcattaatagcaaactgcaaatgctccttggaatcaaaagttcggcctttagctaatggactgttaaaatgtttcctcgaaccaaagaatctctcatcggccgttgtattctgtagcacagatatatcatggaaggcacttacagggtgcttgtcagacctgcccacgagtggcaacgatttgatcaatttgaccacaggctgaccataggtgttatcattcacatcctcttcggcttcgccatcgctctcatcttcctcaatcatatcaccctcacgttctgtctcttcgtccacatagccatcatcttgagaattttcttgcgcttcatttatgatattatcagaagacaagcccacaattggtgcagaattactcacatcatgaattttaggagatataccatgcttaggcgactgatgtgatgctgacacaatattctcagcaactgtagccatagttggttctaggttttctcttattatttcactaacaatgtggttttggctgaatccactatttgttggagtgaactcaacatataattccaccatacgccaactgtttagtgctaatgtcatgtcaaaaatcatttgccatgatctggtcttatataatgggatcaactggaaaaaatgtggacttggtgctcctacatcatatcggccttgtataacaagtgaatattcagtttcagaatattttagccctccataaatctcattctttacatcttcgaaagttgtagcttcggaagcaggaaaagtaatcttgggtggaatgctatactctgcaccagtcgctccatatacaatttcacctccagtgtatacaagaacaattatcatggtctgatgacctaatagtaataaagaaaagaaaaatatatatcaatttccatattcgatttattcatgatcagaatatttagtatatacatggcacagagcactactaacgtggagcacatagctaatgatgatataatcatttcatgcagtaatttactcatactttcgattagcagtgccgcaacctttccatgatagaagaataaaatgatacaacagatctgctagttttttttacggggaaaaaactgatatattactcagctacagcctcattcacaaaatgtgagatgagattacaagaaccatctggccagaactcggagagatatgctacttgactagtactaatgtctaatcaattccaaacaacgaaaagtaaacataccttgcaaataatcttactcgtgatctctgcttaaactctaatctcatctgatataagactagggcatgacttctgcagtaagggaaggttagggatagaaagaaagacactaaccaatgcgtagatctgtatttcttttctatgttgcgggcgtgcagttgctcggcggaggccgctgttaagttttggcgtccaagttctgtccaggaacgcagtaaaaaccttgcgtccaaattagtcgctgccaaatgacagcgtccctatcaaacagatggacgcttcttgaatcagaacgtcctgcttattaatagaattagatggctgtggtgcttacataaaaaaatatatttcttattttgctcagaattaaaaaaatcggtgaaaattctgtgtgcactttgaatggttggaactggttgctttggcagaatcacctggctacaagtcattagtgagtag

SEQ ID NO: 18292 - DNA, 54266 bp, Oryza sativa
caagtgggcagcaaagcactacttagaaattggaattttgtgatgcttgactattacctgtatctggagtatttttttaggcttgtgatgccggtgtccaactgtgcaagcggtgctggtagcgaactagtaccaatgtcatttggactgctggactcgtggtgatctgggctaacgcccggccgctctgtacatttggagctggaataagttcattttaaatcccttatcttgtctccgagtttgaaatgtcgtccttgaaatcgtaatactggatataacgagtctctcaacttgcaaaaccggtgtacccaatatctcaaacagcgcatattaccatctcccctctcctctctcgttcccacccaattcacccaattccgcagcttcagtcgaaccgccgtcaccatcacactaccacactataccatccaagttatgtacgccaacgccttatggtcgttcgtgccgtgccccctccaagagtagtgctccgtcgtcgccttcatcgtatcccccaagttgttgatggcagccacctccatgataccgcggatgttgagcatcaacgccatcatggtgacctccctgaatggcatgacgaagaagaacctcacgtggaataggagatggacgagggaaggttggaggaagaagaactagacatgacatatggggttcactcgtaatgtcagccaaaaccggatagtacactagttttgcaagttgagggacgtgttatatctagtattgtggttggaggacgaaatttgaacgcgacgttaagatgagggacccccaatgaacttattcgtttggagcgagacaagtttgttccgggcctggaaaatcaccttccttttgtattcggccaacaattaacatacggttcgtactggccctactatccttattttagattagtactggtcatagtttcgccttttttttcttcgtcatgtgtttacgctgctagagacaggttcctcggccccgttcctttcggggaaaaacagagcagctcaggtacagggagacattaggtcccatgcatgctcgggggagcctcggaagagaagataatcaaaagtaccaaacccatgaaacgtacgttgagatcagtttacgaatgtgtcgccttcgcccctgaaacagaagaacccaaaagataacagctgccaaccagtgaagagcagccggaaccaccgcttgaatcgttcgtcctgtcctgccgctaccgatggtgatgccgctcaacgattgggcacttctccagcaacacggctcctaacccggtctagtacgtgtaagcttagccagccaagatacgcacgcacaccatacgtgttggaattaatgaatgggccttagcccactcgaagattaattctttggaaaatcacaaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgtgcgctcgctcgcctcgcctggcagggcaggcggcgcgcgtgcacgacgtacgcgtcgaatggtccgaaaaattggctcctcacccttgcgcagatgtgttccgaaaaatctggtgcgtgcaaacggcgtggagtccggataagttatgcgcgacttatccggttcggttacgcgcagtagagatcgtgcgagcgccctgatcaagcgacccttctctatataaaccgacccgccgtcttcacgcagtatatacgcaaaatcaatctagggtttgcctcctactctgtactgcgctgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcaccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaatttggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagcgccaatgttgtgcacaaggcccagaacaagagcaaggggaaatacaaagcttagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactattttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacgaatttaagatggtttttgagtctaataaagtagtcgtgtctaaacatggatattttattggtaaaggttatgagtgcggaggcatgttccgcttttccctttctgatttctgcaataaatctgtaaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctagtgtacttgttgaaaacgaaagacgaggctctagactattttaaaatttataaggcagaagttgaaaatcaacttgacagaaagataaaaaggcttaggtctgatcgtgtggagagtttttctcgaacaagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaagctgtccgtagtgaaatggattccattatcgctaacgggacttgggaggtgacagagtgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaataaggcagataaatgtgtgtactatcgccatggtaggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgacggagcgtggggctcctcaccgggagactgcgcaggcccccctttgccagttcggccgggggccctgggtgagattctaagctcctagtctgtgtgtggaaggttcgcgagaatggaaacacacaagacacgggcgatgtatacaggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccacacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttccttcctttcgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccacgggggccggtgctgaaccgctacattccctgcgtcctccgcaagaagtgggatgactggaagagcgactggttctacacccccctcgccgacgaagcgcgcctccgacttccgagctagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactaggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggtgtcggaggagcgggctcctcgaggccacgatggcgtgggcgggagccgcagggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaaggtgggggggacagaaccatcccggggaaagctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtccggccagcctgaggccgaggacccggcgaccatagaggcccggaggcgggaatctgaccggcgagaagccgcggatcgccttcgagaaaccgaggaggccgctcgggaggccgcccgggctcgccagaccgaggaagccgctcgggaggaggccggactccgccaggccgaggcgacgacatcctccgaggcgacccgtgaaactgacgggcaagaggccgcggatcgccttcgagaagccgaggaagctgcctaggtggccgtccgagctcgccaagctgaagaagccgctcgggaggaggccagacttcgccaggccgaggcgacgacgacttccgaggcaactcgtgacgaggccgcgggcgcatcgcttgggcccactccctcgtgcgacgctcagatcaaaccaggtccgggggacatccctgagtccggcacgtccatcggcgggccaagccgcgcggcatcctcttcgaggcggctcttccccacgccttccgttgctccactgagcgcagaaccccttctgcaggccttagccgtcgcaaacaccacagtgttggacgggttaagtgcccaggtggaggccctgcaagcagagcgggcggagctcgacgccgcatgggtgcgtgtcgatgaggggcgacgctcggtggaggccatggtggaggtgggccgcaaggcacaccgccagcacgtctcagagctcgaagtccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaaaaaactcgacgcagcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagcgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgaactcgaggcgcaggcaagggagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgggtctctggggcgggcggactgtgaagtacgccgccaaccaggggggcctcgcccagcgcctctcggagatggccgggactctccagcggctccccgaggaactcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggtgacccgggtgcatcggagtgagcccccaggcccccgccaatctttaaatagtttcttcttttcttcttccgagtccttcgggcccccttcttgtatagactaatttaatctgcaatcaaataaagaggaaattttttgtgtcaattctatttgttgtgtgtatgagacgaggatgcctgtgccgcggtccttttgtgtcttggcttgaacaagggctcgtgcccaggtcctagtcctcaaatggctcgggttggggctagtgcctggggagatccacatgtcgagactggccaggccgggagcgtggtgaccgagggttatgggttacccgattgtgggtttttgccgattcccccccggagttcaccacgccctggggcacggctcggttctgggccccgtttggcgattttagccgacccgagcccccgagggcaggattgaacacgagtgacctatttcaagtcaatatccttcaaaaggaaacaatagcacagatacagcctttaggaaatcgaaaatgcttttattgaaatacagatataagagaaataagaatagacatatgtggtagcccccggccaaccctgcacgcccgaggggggtgcggggttggcccaagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatgatagcgccgtaggctctgctggtagcgcgcggctcggagggccgcgcgccaccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccacgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcgtccgtctcctctaaggggtcgggtcgcgccgacggctgggcaagcctttcttcaaaagcgcccggtggggtctgggctcgcgaggaagcgagccgtgagagttcgtcggcaaccgtgttatcccgtctgggcacgtgccgaagctcaatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagatagggagccgtcgaactgcatcacccagtgggcggtgtgaggcagctgcgaggggcccgagctggcctcggggactgagacgggctcgagagctggggtccattctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagcggcctcgcggggcgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgtttggctcgggggcctcttctccctgctctctcccgggtcgagtcggcacagggttatcctcggggtcagagggcgataggtgcggccttcccgcagtggccctctggccatcctgggggtcgggggcacctggcaccgtctgacaagcgggcagagggcctgctccggtcgtcgggggccttgggccactgttcggctcgggggcctctcctccctgctctctcccgggccaagccagcacagggtgggggtgcgcggaatgaggatcgtcctcatcgcgctccacaaccaacgccgcactaaccacttgcggggtcgccgctaagtagagtagcaagggttcatttggctccgaggcgaccagaactgggggagagctgagatacgccttcaactgagtgagggcacgttcagcttcctccgtccaagtaaatggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcggaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcaccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggctgagacgggagcggtccgacccctcggggagacaaagagaagggcggccgtatcaccctcgggcccgaccccccccccccccccccgagggggttaggccgcgtgggtgatcgtgtctgcctcaagtctctaagtcatgatactcccggtcccatgtcaccgacaactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttacaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcataaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgcgcgctcgctcgcctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatatgcaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatacgtgtaccgctcctagccatacccgggacggcagctgcccccgcgccgacgccgtccgcgacctgtcacccaagcgcgcctccggtggtaggccgtacccgcgctggctgtgctggtacgaggggccccgccgtaccagcacggcagtcgatcgccgaagtcggagaagtgtactccagctgctgcctgctgcgccgaaatgtcaaaccggagtcgagcagagctgaggagagagagagagagagaggcagggcgactcttgcgttcgggaagaggcactctgccacgctgcttcaccttcgcgatcccatggctgatcagcaagagaagggtgcaaaatgtctgatccgtttagagcggactgaaagcagcacaccagtacgtggcgctgcaagcgtggatcgtcttcatgtcatatactcatatcctgatatccgtggtggatgtgattggtcaggaggaaaacgacgcatgcacagcttgatactgatacagtactgctagtatgaaatagcatcgtatcggagtaagatactatgagattttattttttaaaaaagtttaattaagatttgtattaattacaaatagccattcaataaaaaatacatagtaataatatatatcatgcaaatagagactttatcaagagaaatcacattagttttgatatatttaactgatttttatataaacttaagcatatatatttacgttatttttcaaaccatcttattttaaataatattttgtagaatcgtaagaatcgtagaatcaggatactatctataatttcgtaatatcgtgtcgtaataaatgaaaattaggatactatattgtttcgacttggtaattacgatacggatcgggatactaacaaccttggatatagtagtgaatatgtcgccatcacccctttcacttacgtgtgggcccacaatgctggcagtgttagtgtttcatcccgaagcaacataaatgtgtacctttagctcagcctaactcagtaagcatccaaaaattgatggaaaaaatggcttataggtggacatttttaggctttaaaatgaatcaaaatatattttttaatattccatggcaacacacgggcaaatcatctagttattctaaagttattactaccatattgtatctgaaaagcactctccttccaatcttaaatattattgcgacataattctcactgtctaaagggagggccgaatttattccctttatttaaaagatcacagttcactcacttaacacgttaatttacatgtctatagataattttcttttaaaaaaagataagtacaaatgcatgtgctcacatacacatgtacacgttgtgcacatcctatatctccgagagactggaccgatatatattgagattgacaaagttataataagtgtcttgctgttgacggggacatcatctatcaaaaaaatataattactcagaaaaatgatcacccatattaaatctggaatttaaattggaatagatataagaaatctaactagttgagttatatttgctggtatttatgaatcttgtttcaagtgaacaaggccacttgagacattgtttttaatttgtttaagtcaaatatcagttctaacaacttaggcagaacaaaaatctcaaatatatgagcaattttgaagcttctctgcagttatagcctggtttaattcctaactttttctttaaactttcaacttttctatcacattaaaactaattttctacacacacaaacttccaacttttctgtcacatcgtttaaatttcaatcaaacttttaattttcgtgtgaactaaacacacactatatatgtgaaactaagacgccgtacgtttggtctaatccatgaaggaaaggagaacgtggttttgagctttcatatgccaaatttgtcactatcgactcacggttggtgtttgaatgtttgttaggccacagcaacagaaaagggccggcaacttgttcgtaccactctagcctagtactccaacaatcttactccatctattctaaaatataagtatttttagatcatggcacggtcttcgagatgctatattgaccaacaatatttataaaagtaagatattttaaataaaaatagttgtatattatgatagtttgtttattgataaatctagtaacatcaattttatatgattgatgttctttactctttttttttttgctattaatagtcaaacttaaaaatgtttgacttatcactgtgctaaaaatgcttatattttaggacagaggaaatactattgagttactactggtattcctagtatttggtaggctagtattcataatttcctccgttttagaatatagcaatttaaaatcagatgagacttattctaatcatataaatttagagggagtatatccagattcatgctattaggatacgttctattcgatattgctatatcgtggaactgcggaagcacatggcaattgccaacagcccaaaccgcgggacacgcaagtagtacgtgcttgactacccgttttttttatgtgcatgcatgtgctgttgtgataaaagcaacgggtgcagatactagaagatatctgcctgtaccattcgatatcttggagaagtgccgtttatatatactccaggcagcatcacgaggtgcttttgtttcttcttcagacgtgcaggcgcaaatgggtgagatattctcgacgcattcattgagccgcctccttccggtgagtgggatatttctgatttctcgtcatgttttgatcactgcgtattcggcatgactgcctaggcacgtcttgcttttcagagcgatgcaaactcgcagatggaagatacacgggtgacgggttacggcccatgtttgatgggaggtcaccatttcgtagctttcccttgtgcgttgctcttcggctgtcacctgtcatgcacctgcatcccggatgtgttcttttccactgaaaacggaagataataggaatacgcgctctagctataatttaatgctgcgaaagttaaaaaaaaacgttctgcatatgaatctttaaggtgctattttaattctattttgttcgtttacttcctctatcccaaaaatcttgatgtttttagattcctcagcaaaattatcttcatgccaaaatgattaaattgctcccgtcaattcgattcagttgccattttatcaagtctacacgcactcatcaggttatacagaatcattgcatgcaattaattaataaattctttctaaaacacattgccaaataacttgacggaatagactagataaggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaatagataaatggtctcacttctccgatcaaatttactactccagcgactttttttattggtagaacggctcgtttgtagggtggatgaaaagaatcatcggttggccatattttctaataagttaaaacaactttattaagaaataaaaattaatttattggtaaaaaattgtatatttgctctgcgacttaaaagccaacataaaaaaatacattaaaaatatcttaaaatcaacttaaattttagcttttgctttagcttattaaaccaattgatagggcttgaaatatacttttaatcatttgaccatttagccatacaatgtttccttccattttattctgtccaaaataagcttaaagtactactatcttcgttctactatcttcgttctaaaatatagtttatttttaacacagtacattattccaaaataaagttatctgtttaatacctatctcctcccttctactattcacaactattttccttcactactccctccgtcctaaaatataagtatttttagttatgaatctggacaactgtgtatccacatttatagccaaaagttgttatattttaggacggaggtagtattttctattctcaaccaattacaaccatcctctaattcaaactatattgtccagattaatagccaaaagttgttacattttaggacggagtgagtaacatttttaatgcctatgtcaacaaaaaaaatgcttacattttgagatagttgtagtcctatgatactagagagtactttctctgttttagaataagttaatctagtactaactccgtcccaaaataattacagccgtggatattcgtgtccaacgttttaccgtccatcttatttgataaatttatgatttttttaaaaaaaagtcagacataaagtactattcatgttttatcatctaataataataatactaatcataaaaaaatcaaataaggcgaacggttaaacgttgaacatgaactatgcaaaactacactattttggaaggaataagttcacttcatgaccctcaaaagtgacccgaatctaatccatgaccctaaaccgcaaaaccggatatcttcacccccaaattattgaaaccggtgcaatttgactcccttggtggttttggagggcggtttcgctgacgtggcgctgacgtggcagtattgactcggtcttctttccacgtggcgcttaggtggcattagaaataaaaaatatgcgtgggacccattagtcattcacacacaaaataaaaattgtggggcccactgacatgtgggccccacatgtcatcctctctctccctttcttcttcctcccttctctctttctttctttttctcttctctccccttcggctggccacggggagcacgagcggctggagctggagcgccggccggcggggccagagcagcggcggctgcggcggtagcctcgctatcagcctcgccaagtggagagaggagaggagaggatgtaagggaggaacggaggtggtgggttacacgagaggcggcggcggcgcgtgagggcaggaagggagaggggagaagcggagccgctgagctcgtgctgtcgccgccggtgcctcctcccgcactcgtgctcgcccgcacgccgccggagccgctgagctcgtgctgtcgccgccggtgcctcctcccgcactcgtgctcgcccgcacgccgccggagccgccactcgatgcctccgtcgtcgacgtcccgtgcccaccgccgccgtcgacgtcccgcgcgatgcgaggatggatgcggggaggtggtggaagacggctacgaggagctctgatcccggtgatgcggatggatcgaaagccgtagccggcctgtagaccaccgtgcccccgctcaatctcgtcggcgtcggcgctgccgtcctctctcgcgtcatctgtagcccgccgccgcttcagctctcgtcgaccgccaccaatccggcccacgccccccgctgccagctccagcccaccgccgctcgctccccgcaaacgcccgaagtggagagggagaacagaaagaaagaagggaggaggaggggaggtccgggaggaagaagaaagggaagagatgacaggtagggcccacatgtcagtgggcctcacaatcttgtgtgtgtgaatgacaaataggtcccacatatatgtttttaattgaaatgccaccacagtgccacgtcagcacacagactaggtcaacaccgccacgtcagcgccacgtcagcgaaaccaccctccaaagccaccaagggagtcaaattgcaccggtttcaatagtttgtgggtgaagatatccggttttgcggtttaagatcatggattagattcgggtctcttttgagggtcatgaagtgaacttattctattttggaatggagggagtaggactacagcaaaagtgcatccagattaactgcatcccaacaaatctgatgacgtggaccgaattatgtccccgtctgaggactgagagcccacgaagcaccgagtgcacgacgctattctttactccccgccacgtcatccccctcccccaccccacggcccacccctgtgcccctgtaccaagacaaccactgccacatgttgcgcctcggacgagtcccgccatggccccacgcgtcatccaccgggagaaaagaaagcaacaaaaacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatatctggacttggtttcatggtttgttaccatagtacgattttggaccatgtcagagcaggtacaattctagattataaaccatcgataatataataaacacatatcgataatataaatgagaagagatgagaagagataagagtagcgagttacagatttatagacagctgcagcgtagactataagacatagtgtgtgtatgacaggtggaatcaggtggtagatgtgacaaatatagtacaatgaatctggacaaacatttgtctagattcattgtattacgatgcttcacatccacccaaaatctcttatattatgggacgaatgaagtatatgtttatagggtactacctccgtcctaaaatataagcaactagttgggtggccaacgcaattacgcggctagcacccaaacaaaattatatattttcttagtatgattttacttaaaatttattaaatagctatatcattgtcttaagactttgaaagactaaaccttatcatcatcgtgtttctaattatatagtttttaaaagtcataccagttgctaccccttgtgtcatcttcttctttatttgcttgctcgatctaccattatttctattcattctttttggaacctttaaaaattggattttatagtttttagagtttattgtcaagttggatttcatttttataatttctaaatgtcccgtcaaacgttgccattatactcctctacggcccgtccactgtctcttctctttattgtcattgagattttaaaaatcgaacataattatcgtttgggttcattttttactttctagaagtccagccaaaccgtcagcagctttgccattgtactcctctacggctcgcccgctgcctcccttctttattgtcattgagattttaaaatcaaacattattatcattgttttttttttatttttttagaagttccaaacctttaaaaatggacttgtagtttcactttttataacttttagaagtcccatcaaacgatgccactatgcccctctatagcccgtccgccgccaactctttattgttattatgattctaaaaatcgaacataactattgttggaattcatttttttattttctagaagtcccgtcaaccttcggcggctctgcaactatactcttatacacccccgctgcttctcctttttattgtcattgagattttaaaaattgaatatgattatcaatgagttttttttttactttctagaattcccggcaaccgcattactaatttgcttcacggcctgcctaacgtccctccttttaattgtcattaggattctatttggtgttttattaacaatttttatatctcgtatcaaccgccaccactctactcctttataggcatgttacttaatttatctcgtcatatgttttagatggtcttttctttcaataatctttattttatcacaaattttagttatttaaaaattgtattcctaattgatatcttatttttctttttttaatttcagaatttttttaaaaaaattttagttaatatcatattgtattctttgaatgtttttattttttattttcaatttcagttgttttaaaattgtattcctacatgaacttttgtcatgtgttttagatggtcttttctttcaataatctttattttatcacaaattttagttatttataaattgtattcctaattgatatcttatttttcttttttaaatttcagaatttttttaaaaaaattagttaatatcatattgtattctttgaatgtttttgttttttattttcaatttcagttgttttaaaattgtatttctacatgaactttcttttaatttttctaattttaggtattattttatttttattctcaattttaattaatatcgtattaggttcttatatggattcttctttcaatattgcatatttttaatttcgaatttcagcaaattttaaattttattcctacatgaactcttcttttattttcttttgctaatttcagatttatttatttttatttcgaattttagttaatctcgtattgggttcttatatggactcttcttttattattccttatttttaattccgaatttcaactatttttaaattgtatttctacttggactctcattttcttttttaattttggattttattttatttttgttttgaattttgattaattccttattaggttcttatatggaaacttatttcaatattccttatttttaattccgaatttcagctatttttaaattgtatttctatttggactctcctttccttttctaattttagattttattttatttttatttcaaattttgattaatctcgtattgggttcttatatggaaaattattcaatattgcttatttttaattccgaattttagctatttttaaattgtacttctacttggactcttcttttttttctttttcttttatttttatttcgaattttgattaatctcgtattgggttcttatatggaaacctctttcaatattgcttatttttaattccaaatttcagctatttttaaattgtacttatacttggactctccttttctttttttttctttttcttcgattaatgtgggaatttcttttaatttttctaattttggatattatttttttaattctgaattttaattaatcacgtattgggttcttatatggagtcttctctcaatattgcttttttttaattccgaatttcagctaattttaaattgtactccgatttgaactattctttttttttgctaatttaggattttatttttatttttactcccaattttaattaatctcgcattgtgttcttatatggactcttcttttaatattccctatttttaattccgaattttagctattttaaaattgtattccgacttggactatccttttcttttctaattttggattttattttatttttatttggaattttgattaatccctcgtattgggttcttatatggaaacttctttcaatattgcttatttttaattccaaatttcagctatttttaaattgtatttctacttggactctccttttcttttctaattttggattttgttttatttcatttcgaattttgattaatctcgtattggggtcttatatagaaactattttcaatattgcttatttttaattccgaatttcaattatttttagattgtacttctacttggactctcattttattttattttctttttctccgattaatgtgaaaatttttagcccccagagcgaacgtggtgcctcctttcaaagctgttttaataatataaatagctgggtggcccgcgcaattgcgcggctagcaaaaaaatcatatatttttttaagtatgatttccttgaaatttattaaatagctatctcattgttaacactttgaaagaccaaaccttatcatcctcatcctcatgtttctaattatatagttttaaaaatcacaccagttgctaccccttatgtcatctcattctttatttgtttgctcgatctatcactttttctattcattcttggacctttaaaaattggattttatagtttttagagtttattgtcacgttgggtttcgtttttataatttctagatgtcccgtcaaacgttgtcgttatactcatatacatctcgtccactatctcttctttttattgtcattgagattttaaaaatcgaacataattatagtttgggttcatttttactttccagaagtcccgccaaaccatcagcggttttgccattgtactcctctacggctcgcccgatgcctcccttctttattgtcattgagatttcaaaattgaacatgattatcattggtattttttactttttagaagttcgaaccctttaaaaattagacttgtagtttcattttttataatttttaaaagtctcatcaaacgatgccactatgcccctctgcagcccgtccgccgcctactctttattgccattgtaattttaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggattttttttctttatactttctagaagtcccggcaaccgctttacttgtttgctttatggcctgcttgacgtccctccttttaatcgtcattaggattctatttggtgttttattaacaatttttatatgccgtatttgttagggttacgggttaggcttaccctttactgtcacgtcccaaaacgaccctaaaatacattctctaaattatgcctagaataattaaaatccgtgtgaaagcctccaaaaattaaaatgtgcaaagtaaaagtcaaataaggcttagaggatttttgtatatttcctaaaagcctaaaatatgtaaataaattttagtggaattttcatagcacaaataataattgttaagaaataaacaaagttaaaaaggttttataaaaaaaaaccctaaaaatcccccttccctctcttgggccggctcggcccacttccctccccctctctcctcttccctcgcggcccacacggcccctccccgcgtgcgctgctgacgggcgggtccgcctgccaccctcgctgacgggtggggcccacccgtcatctccttcctcccgccgctcccgccgcctcgcccgcgcctagcgccgccgccgccgcgaatcccgccgcctccggccgttcccgcgtgcaataaagtggggggaaatattccccgtgatcccctccccctttccccccatttttccctctctctctctcgcatacaaacgggcggatttgctcccgcaaatctcgccggcgccattgatggcggccggacctcccggccggtttccttcctctcccggccgccctctcccccttccaaccctatttaaaccctccccgcgcctccctcgcctgtttctgccccttgccgcaccgtctccctgccggaatcgagctcgcgccatcgccctctctctcctccgtcgcagacgacctccggccggccctctccgctcgccgggaccgtctcccgcctcggcgtcgccttctccggcttcgccgcaccgtcaccgtccccgtccaccccctcgtcaggctcgccgaccgccggagcgccgccgtccccgtcgacccaagccgcgccgccgccttcctccgctccggccgcctttttcgtcgtcgccgtcgacctagggtgagccggggaccgccgccttttttcccccttcccttcccctctctcggccgctgctccgccgtgcctatggccgccgccggcgaccataggggcgcaggtgccgcctcccgccgaccgcgccggcatggccgccttcgggcgcgccgagtggccgccgcgtggggcccggccgtcagccgcctacgccctcgggtgcggctgacgcgtggggcccacggcgcaggccggtgtgagcccgggagcgcccggtccaccgtggaccgtgaggctgccgcgtgggccccactcccatggacccggtccgcgcgccctctcccctcggctgacgcaataaaccatttttaaattaaaatttaaatgaagaaattcgcaaatattcacttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaagatccgctcttcgtgaaggttgaagccgacgtttgggaaagtgatcaaggcaagtcacatcatccttgaacatattgaatcccagtttataaaattattttgatttaaattaatgcattatcgctttatttaaattcccgcgttatcactgttttatttagccatgcctatttacctttgttatgacctaattattattgctattgttattattaccttgttcaccctagactaaacaaaacccccaactagtaggtaccctatgcatggtaccactagtatgaatttaggtagatgcttcgctgcttaattaagcaacattaggtggttttacaactctagactttgggaatgttcatatcacctagacactatggaatggttggattattgtggaattggattcacacctccccctctattcaaaatcctcaaaatggttttaggctgggctcggggtgcatggttttgattgtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcaggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataacctattcgaatagccgcgccctcggttataggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggtcttgggttaaggcaggttcgtgtgggttcacggccttgattaataatattgcatagctctaggatcgtatttacaaaatagctttgagcaactaagtgtcttttaatgctgtttactgcaaaccctaaccccctatgttataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttttcgtttgtcttcctgtgtgctgggccttcgccgcccatgtaataaattatctatttacacttccgcttgttaaactctgtattgtatcaacttttggtgtaccttgcctcctgggacaaggaataatacacgcacgtaaggaacgcccgttgggttatttccggtcgtgacatttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggccccccggggagggtttaggatcgaatctcagacccaacacaacctccacagcctacgaagccggagcttgcgaggagccaagtcatcgagagctagtcgaatcaactcgactacaatctcgccggatccgacaagttcccttgttctctttgtaacctgtgttttttaccatataatcccacatcaactggattagggctattacctgtcaaggggcctgaaccagtataattcttgtcttttgtttgcttgatgtcatactacgtagatccttgtatcaacgtaccccaataccctctatatccagtctacgggtatcacccgtcgacagtggcgcgctaggtagggggccttggtacttaaggttctactactatgtcatccagcttcgtcgacaacaacgtcagcaccagcctcagccaagtactccctgcttcaacaatgctggtatggactcaagtcggcgaaatcgtcttcccggtttacaccacgacaccgatctcaaccggtcctccaatgaccggagacgagaacgcagtggctacgaaccaaggcgattccatgtcaaaaaatcctctcgtcgagacggagaacggaatatcgacgacatccaagctcaagagggattctgatacggccaaaccttgtccttccgacatgaaccacgagccgacaaagatgacttccgaagccacaaggtcttggtgtcctatccacaaaaccaagaaacacaccttgcaagattgctgggttttcctcaacgtccgtgctgaaattcgcgcctgcaaagaacgtggaattcagcgtacttctccaactcgggatgtctattgtcctattcacaagacaaagaatcaggacctctcgagctgcaaagtctttctcggcgccatgaaagctcagtctcctaagtcatatgtccccatcagggataatgacaaggaacaaggagtgactccaacttcagatcgattcgttggagtaatcgatatcgatcctcacgaaccatcggtcttacatctcctcgaggactatgggtcatcgacaacgagcacgccgcgggaggtattggctatcgatgatgttggcacgtcagcgcacgccaacgcagaagcggggaaacaatcgactactcaagcccagcacatcaggcccgttcaagcgatactgagggaaactccttacgatcccgttctgaacgttgacctcgagcgttggatagaacgactatgggaatcggtgactaacctcagcaacgcgtttgaagaagccgctaccgcagcacaccaggagcagccaccaactggcgaggccaatagtgaagatccggaacggagggaatcacctcaacgagctaccccttcacctcgcggcactggcgatcttcgagatcaaatcaacggccgccgggaagcacgacgcacacgagacaacgtgaatcgctcttgacgtcatgtctcttcacggcgccatgataacggaaatcgaggagactgctcaaacgaggaccgggaccacgacaaccaccacgatcacaacgatcgcgaacgacgggtgccagacaatactggtcatggccgccaccgtatcgacgacgacgatggagatcggcgccgagacaacagtggaagacgacgacaggattctcgagatccaggccgtcatcctcgtaatcgtacgccggaaccaagtgacccatcgtcatcgtcatcatccgcgtcctcctcatcgtcagacagatatccacgaaggacacacgatcgccaacaacccaccgccccaacgctgggtgtagggctttcggtcgttccctacgtgatgtctgatggtctgagagattccgacccggagcaatagaaaagtatgatgggagcaccgacccagaggagttccttcaagtctactccacagtactctatgctgccggagcagacgacaacgcgatagcgaactatttaccaaccgcgttgaagggttctgcacgttcatggctgatgcatcttcctccctactcaatctctttgtgggcagacctgtggcaacaattcatcgccaatttccaaggaacatacaagcgccacgcgattgaagacgacctacacgcgttgacacagaactcgggtgaatcattgagggaatatgtttgacgtttcaatgagtgcagaaacacaattcctgaaatcaccgacgcttttgtaattcgcgccttcaaatccggtgtcagagatcgctacactacccaggagttggcgacaagacgcatcacaatcactcggagattattcgagatcgttgagcgatgtgcccacgctaatgttgtgctaagacgcaagaacgataggccgaagaccgggggagagaagaaaccagccacggacacatctgagtcaagcaagaagaaaaatcgcaaaaacgggaaaatgaaagctcaagcggaagtcctcgcagcagaatacgcaaaccctcccaaacacccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgttgagacgaacgaagagacggctcctcacgaaccggactcagcgtatctagactccaacctccacgtctcacacatcttcggcggttccacaacgtactcctctaagcgagaatacaagaaagtggaacgtgaagtctgctcgacatggcagggggctgcccccaagatgaagtggtctgagcagaagatagagttctcggaagaagaccaccccaagaccgccgttatcccaggatgatatccgatcatggtcgaacccactattcggaacatcaaggtagcgcgagttctcattgacggtggcagctcaatcaatcttctttttgccagcactttggacgcgatgggaattccgcaaaacgagttgacaccaactgatcaacccttccacggaattactccccaatcatcgtccagacctttgggcaagattacatttcccgtgactttcggccaagccaacaacttccgaacagaacagatcacctttgatgttgctgaattcgatacagcttacaacgccatcatcgggagaactgcacttgcgaagttcatggccgcatctcactacgcatatcaagtgcttaagatgccgggaccaaagggaacaatcactatttaggggaacgcaaagctggcggtgcaatgcgacaagcggagcctcgacatggtcgagcaaacgcccagcccacccgccacgactgagccacccaagaaagtgaccaagacaaataagacgccgaaaccagacggcgccatcaagattgttccactctccagttccaaccccgacaagaccgtcaagatcggggcaacactaaacgagaaatagaaactcgcgctcatcaccttcctccgcgacaatgccgacgtgttcgcttggcagccgtccgatatgccgggggtccccaggaaggtgattgagcacaaactcatggtgcgacccgatgccaagccagtaaagcaaagactgcggagatttgcaccagaccgaaaacaagccatacgagaagagctcgacaaacttctcaaagctggcattattagagaagtacttcatccagagtggctagccaatccagtcatggtgcggaaggccaacggaaaatggaggatgtgtgtcgacttcaccgacctcaacaaggcgtgccccaaggatcactttccacttcctcgaatagaccaactggtagattcaacagccggttgcgagttattgagcttcctcgacgcttactctggctaccaccaaatcagcatggcaaaagaggacgaagagaagacagcattcatcacgccgtttggggtattttgctatgttaagatgccattcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcaaaccccgagaagatcaaggcaatcgagaacatgaagtcgcctacaagactcaaggaggtacaaaaactaaccggatgcatggcagcactaagtagattcgtcgctaggatgggagaacgaggacaacctttcttcgctctgttgaagaaacaagacaaatttgtatggacataggaagccgaagaggcattcattgcactcaagtgctacctatcaaacccccctgtacttgttgctccccaacctaatgaagaattattcctctatattgccgccacgccacactccgttagcactgtcattgttgtcgagagagagaaagtacagcgactagtttattacgtcagtgaagctctccacgacgcaaagacaagatacccacagatccaaaagttgctttacgctgtcatcatgacatcaaggaagctacaccactattttcaagcccacagagtcacagttgtctcctctttccctcttggtgaagttgtgagaaacaaagacgttgtcggccgcattgcgaaatgggtagtcgagctgagccagtttgatgtccactttgtgccacgaacagccatcaagtcccaggtactcgccgacttcgttgccgattggactatgccagataacaaattagacaaccaaggcgacaatgaaacatggacaatggcgttcgatggcgcactcaacagccaaggagcaggggcatgatttatcttgacgtctccctccggagatcaattcaagcacgcaatccacctcaacttcagggcaaccaataacactgcagaatacgaaggactactcgccgggatacgagctgcagctacacttggggccaagcgactaatcgtcaaaggggactccgaactagtcgcgaaccaggtacacaaagattataaatgctctaactccgagttatccaagtatcacgcagaagtcaggaaactagagaaaaagttcgatgggatcgaggtccgacacgtctaccacaaggacaacgtcgagccagacgacctagcatgacgtgcgtccagacgagaatcgctcgagcccggcacttttctcgacatcctgacgaagccatcggtgaaagaggttagcggcaaagtcagcccgaacacccccgacattagctcggaggtcaccgaggcagaacgcgccattgccgacatcgaaaccacagacgactggcgcatcccactaatcaaattcatcagcagcgaggagttgcccgaggacgatacagaggccgagaaaataacccgtaaagcaaagatctactgtacggtcggcaatgatctatataagaaagcgccaaacggggtacttctcaaatgcgtctcgaccgacgacagcagacacctcctcctcgacatacatgaaggcatatgtgggtcacacgccgccggtcggacattggtcggcaaagcttttcgacaaggctttttttggccaaccgcccttaaagatgcatgcgacatggtccagcgatgtgaagcctgtcaattccacagtaaacacacaaagctacccgcgcaagcgctccagactatccctctgacttggccattctcgtgctgggggctagatatacttgggccattcccacgaggacagggcggctacagattcctattcgtggcgatcgacaaattcaccaaatggatcgaagcagtacccacgggggaaatcaaggccgacaacgccatcaaattcatcaaagggatattttgcagatacggacaaccacaccgcatcataactgacaacggctcctagttcatcagcgccgatttccaggactactgcatcgggttgggggtcaaaatatgcttcgcctcggtctctcaccctcaaagcaatggacaagtcgagagggcaaacggcatagtattacaaggaatgaaaacccgcgtctacgacaggctcatgtcacacgacaaaaggtgggttgaagaactcccatcagtactatgggccgtacgcaccacaccgacaacgtctaataaggaaacacccttcttcctcgtgtacggctctgagaccatgctcccaggcgagctacaacatcagagtacacgagtacagaagtactccgacaagaaccaggaggagtagagagatatcgatgtaaatcttctcgaggagcatcgggaacgagttgccgtccgagcagccagctatcaacagaccctccgccgttatcacaagaagcacatccgtgcacgcatactttcgatcggcgactatgtcctccgacgagttcaaagccaagcagggcgaaacaaactctcacctaaatgggaaggaccttacacgatcacacaagtcttgcagccaggcgcattcaaaatcgtagacggcgacggtcgtgaattagcaaattcttagaacattgaccaactacgtaaattctatgtatgagtcaataccatccatacctgtaagcacccttacagtattaataaaggctatttctaggcccatattacaatcaacgtgtttcccccgatgatccctcactctgatgacacctagtgttgaaacctgtccttatgtccctttacgccgtctcgacaaggcctctgaggaacctaagggatcttcggctggggacgcccagagccgataaggccttgtcagatcctgtagagacgaaagaccatataagatctggtcgtgtaagagttctcgccgtgcgtattaaccaagccgtgaaatcggaaattaactttccaacttcacggctgggggctaggatcaaagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcatagggtacgagtactaccaagaaggccaacgccagtccatagactagaagatcttctcggccaacgacgacattgaccttgccagatggtctatctccgccggagtccttcgagaacgagcaaaaccctcacgaagatattcgaggtccaggcgcgggcgatgatctcgtaggcaagccaacacgtgccccccagcatatcggctcgatcgatgacactcctgcttcaaggcctcgtcgatacgctttccgattccatcgagttgggcacaggccccattaagccacgagatgtacccggccgccgactcctcgggatctccgcggactactcgaagctccctgcatactctggccatggatgtgcagcaactcttcaagtacgagttaaaccacacctcacgacctcggagcgtttccacagtctgctctttcttcatggccagcatggttctctcgagctctgccacttcaaacttcgtcttccagtattggatacaacgatcttggctagcaaggacaccctcgagatctgctaaacgtgataaccactaagtcaagctatacatctctttcgggatatggctgacctagtcaggtgggcattaaggggtgaagggactactaacctgaggaagtcgtcgccgtccttccctctatatcaaggggttgatccacatggtcaggcgagacgtgtggttcaaactcgagtaccggaattactgccagtgactcgagctgcccgcgctgctggacatcctcgtgatcagtatctctacagaggacaaaagttcccgaggtcagcataccaaagtaagccgggatagtaatcgcacgcacgaaggcggtcagagttcgagttttacacattatctaggaaatacaagaagtcctactcttcaaaaagggggagaacagactcccccagatcaccgacttcttccatcacctccttacgcgtgtcgctggccgccccctggtccaagatctcacgcagatcgagttcaagacgcgacagccttacacacgcgaggacatgacacgccccggtgtagattccgtttgacgtctcctccgcaatcctagccgcatgcttggaggggatttcccccatcgccgtcaccaattctgcgagagaggaggtcagcgaaaactcatcgggattcaccgggatcgtggacgtgacgccgcattccccgacgagctggtgaaggctagtgtaggtgaccctcaacgagccccggatctcagataggttgttcccgagttccgacattcggtcctcgagccccttccgttgtcgctcgttgccggctgccaactccctcatcttcgtgaggtcttcacgggcttcaaccaactcgcacaccagtctgtcagcacgcgcgttcgccgtcgccgcttccgacctcgcctccgcaatctcgcggtcgatgccgcgagcaccggcttcgaggaggcgccccatctcgacttggagctcctcccaggtgaggactgcagctggcagatcacgacctaccgcggggtcgctgactgggccactaggcatcgcctcccggctctcggctacgggcacgacatccgttgaggccacgacgggcgacgcactggaagctcctctagacttggctcgtgcagcctttgtccgcgcctccctacaggacgaccatgagtcagacaataatcgaataagaagcgcggggattcaagaattcatctacttacttctcgccgatcgtcacaatgcgttgtcgtcgtggaggtgggggagacgcgtccgaggcctgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagacacctccttgacgaccttcacttttagagatgacgccacctgatggtccgcgagcggtccgatgacatcagtcaaaggaagagcctacgctcaatcaagtcataaagtgatttcgaaaggagaatgcaggatgtttatcgaatatacttacgttgatggctttatcacgttccgccgcccccttttcacaaaggggcacagggatgtcactcaccgtggtcgggccactgatcatcacttggccgacgcggcgctccacggttttgccgctcagacctgttaatcgagaaccaaccttcgataagtcaagaggaatgcaaacacaagtatgtcaagataaatgcgagaaagataccccgaggagaaacccgggtcgcgtcctctgacccggaatagttataagctggatgggcccgagcctgaagcggctggatccacctaccaacgaagtctgcaacgacttcatatcccgacaaaccccgtactcggagatcgtcgatgatgtcgataaacgactgaagagagggggtcaaggggggctttgcggtccaagacggaatcttatccggttgatcttcgggaaccacaaagacagggttcgagttcttgatctcaagataaaaccacctattcctccacttgctgcgagaagaaggcactggaagggaatgtaacgcgacttcaggccatcccgaagtcggaacccgacgcaaccagataccctgttggattccatccaacacagttcgtagtaaaagcgaaaaagatcaaggaaaggctctaccccaatgtaggcctcgcaaagatgcacaaagatgctgaggaaggcgatggaattggggttcaaatggagaagagaaagaccatagaaattcaaaaccaggagaagaaattcggaaggtggagggagaaaaccgcagagaacataatcttcgatcacaaccatgcgacccaagatgggctgaggattagtacctcatgcttccctctccatggttccacagccaggaagagtgccatcctcctggagtttcttcaacgttgcactggtggaagccgatttgccgaggtccattgctgatcgaaggtcgccggaaaacgagcctaggttgacgaactagggtttcttgcggcggctgagaaggcaaagagttcttggaggtggtgcgtgtataacaggtttggcggacttcaaaatggactcccaaaattcctttaaataggcgcactaccgacggtgcgaattccagggaacagagagagatgcccaccggaaatttctggtcccgttacgcgcggcggttttttggacttcagtttaaaattcgctcgtgaccgttgggcttcaaatggcgtgctcgactacggtctatctccacggtcctcgcaccgggaatgacaacagtctcgacacccgaagtcgcaaatggttgcacgagttcattttaagcagaagtcggggactactgtcagggttacgggttaggcataccctttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggctcccggggagggtttaggatcgaatcttagacccaacacaacctccacagcctacgaagccgaagcttgcaaggagccaagtcatcgagagctagtcgaatcaactcgactacaatctcgccggatccgacaagttcccttgttctctttgtaacctatgttttttaccatataatcccacatcaactggattagggctattacctgtcaaggggcctgaaccagtataattcttgtcttttgtttgcttgatgtcgtactacgtagatccttgtaccaacgtaccccaataccctctatatccggtctacgggtatcacccgtcgacagtattaaccgccaccaactctactactttataggcatgttacttaatttatctcgtcatgtgttttagatggtcttttctttcaatagtctttatttttatcacaaattttagttgtttataaattttattcctaattaaaatattttttttctaatttcagaatttatttttttctaaaaaaattagttaataacgtattgtgttcttttaatgtttttattttttattttgaattttagttgtttcaaagttgtattcctacttgaactctgttttaatttttctatttttggatattattataattttatttgaaattttaattaatctcgtgttgggttcttatatggtttttctttaaatattgcttctttttaattccgaatttcagctaattttaaattgtaatcctacttgaactcttctttattttcttttgctaatttcagatttatttttatttttattctgaattttaattaatctcgtattgggttcttatatggaatcttcttttaatattacttatttttaattccgaatttcagctatttttaaattgtattcctaattggactctcttttccttttctaattttagattttattttatttttatttcaaattttaattaatatcgtattgggttcttatatggaaacttcttccaatattgcttatttttaattctgaatttcagctatttttaaattgtatttctacttggactctcctttccttttctaattttagattttattttatttttatttcgaattttgattaatctcgtattgggttcttatatggaaacttctttcaatattgcttatttttaaatccgaatttcagctatttttagattgtgcttctacttggactcttcttttctttttttttctttttctccgattaatgtgggaatttctagcccccacagcgaatgtggtgactcctttcaaagctgttttaataatataatagatagatagattttttgctgtgaatctggacaactgtttatccagatttatagctaaaaatgcttatattttgggacagatgtagtaattatatatgtattacatattaaataaattgattataaatgatttagaggtatttcctgctatacttgctctaaagataacaactcagataatgatgagctagtggcaagcgcaaaatggaagttaggaggacgaaaatatggttccaaacagaaaagccaaaggctaggatttattctaatagcgctttaagatacgtgcaggccgcaacaccggatcgaccaaaatccgcaacatgatatcggaatccgcctttgcgaagcgcggcggcggtgaggtggtgtgggcacgccaccgtcggcaacgacgaggcgagtagccgaaacggggaggaggaggaggaaacggaggcggagggaggcgcgcaggcgtctgcgccgatcaggtcacggcgccgctctggaccctccggtacgtctcgtctcctctgtcctttgcttttaatctctccgatcagggaaggccaacgcgtccacgctacatactaaccctcgcgtaatcgaaatcagtccaaagaggcgtcaattcctaatccaattcaaacgggtggagaggttaaacctagatcctactccaaattccgcaagccacagccgcacaatccagatgcagtttactgttcagagctggtctctcaaagtctcaacccctttttctgatttttctccatgatccccatcctatccacgccagttcatcgagcagtagcatatttctatctacttctactgtgtcctattaacaatttggcggcagagctgactattcctttatgttcttcatttgggttgcttggagttggagaagagattaccccaccgtttgttccatgctgctgtattttccaaaaatcatgctctcattggcttcccaccatttctgcgcctgatcctctccaaagtgcttccgactgcgagattgaaagagttagttattgcaaaggtaagacatgatgccatcgttgacaactgattgattataatctaggttcttgggggatctcacctgaaccggatgcgcttgatgcacttcttcccaccgggggatgtaaccactgtcgcgtaaaccccgcgctcgatctgctcgatcacaccgttggaatcggtaggagcagtggtggcatctgttccctcggtgcatctggtgctgccgttggaagttcttctgcaattctgatgcgtaaccgagtaattcgccatggaagcaattgaaggttgtgtgcattccctatccacctgcctgctgttgtggtgatctctgttgctcttcgactgttgaaattcgctggtgaatacatttttgtcaggtgggtctggtaattctgcttttagtgattttgcactggcgatgtggctaggcatgattctggagttgtctaatttctcaccagccaaaaggttctttgataaaaaatcatgctgcacaattgggcaccccacacaacttatttagaaaaaaaagccggtaaatctgtcaaatggagataggtcatcggttttatacctgatcgatcaaaaccttaattatgtctttagcagctttgcacttcgcagcctcatccttggcaattaaccaagtctcctcgacttttcgtttgtacagctgaactttcaggctcctttggcggcactgttttgcaagagtagttacctgcttatataaaacataatttccatctttatcactaaattatacgttgcataccagaacaaacattcagtgaaaacaaataatttaaacagatccacgaaacatgtttattacagagaatatggtatgtcagttacctgctcttgaagctgtttcacttcttccaataatatattttccatcaagtctaattccgcttttgaatcattagcagatttgagcaaagagctggcaggtttaggtgccattgtctcattcattacccgtacaatagaaccagagactgtctgtttattcaatgttgaacaataaggaatgctctctctcacacatctgaattgactggggcactctactaggccccatcttaatgtcctcacatgatctggcacagccaaattctgacttctctgatgggggctttgtgctgatgccattttctccataattgcatttgcttccttgaatatgcgcgccaattttggcgtatatgatcttatttctattggacatacctcatccttttggatcttctgttgtggatctaattttctatgctcctcaactttctgcatttgactgaaacatgcatcacaaacacggtaccttttgctcctatctggtgcaagagctgctctggaaaccttgttattgctgcaggaattgcagaacatggaaccacagttgtaacagttgtgcttcttcctcgtaaagccaaatgttagctggcagttgctgcacacagattggtccttgcttgagagtggcctatgtaaacaaattgccatagtgaagttgaaaccacaagctatactatgcacctgcttgtcttccaaggcctcgaccagagtcgggtagctcctgtcaacatagtcacctaaaccaagttgcccttctgttcctttgccccatgtaaacacctttccattcattgtcaaaactgctatatgtgaagagcctgatgatatctctctgacaaactctgtcttaagtggcccctcaattaaacaaatagatgtgtcctcagacagagggttccctaatcgtccgtgttccttgcttccaatggtaaaaacaacaccggttattgtaagcacaatggtttgtgcttttgcacaggatacctgagcaaaatcaaaatcattgagtggctcaacacaagttggtacaagtttcatctttttgtcagcatgacccagcttccctctatccgcatcaccccatgtgaacagcttcccactaggagcattgctcttgacagtgcccattctttctacaatagcagctgtgtgccatggtccacacgcaatggccttggctcgtacccctttcagggactccacttgtttgggccgagcaacggtcagcgtgtcaccatgtccaagaacaccaaaggttccatctccatatgcgaagagctggccagcagaggatatgatagccgtgtgccaatgaccacatgcaatcttcaagattgagatgccatccaaaggaccaaacaatttatgtgggaaccattggcttctttgatactgatcaccccacaaacccaagcagtgagtcccttcaccccattcataaagttctcctgaaattgaaactgcacaggtgtgctttgctccaaatgcaatagccttcactcgtgtagaggcaagagactcgataattttaggatctgatacactgacactcactttgtgccccaatctcccaccattatccacaccccaggagaagacctctccctgcttagtaactatcgctgcgtgtttctctccacaagcaacgctct

SEQ ID NO: 18293 - DNA, 7315 bp, Oryza sativa
atgtccttttcaggtttgatgtcttctgttataagtgaaccccaaaaggatacagacaagaaaatgaaatgacattatattaagcgcatttggaactttgggcggccacagaagcaaatgtcatgctcactcaacatcttggaaaaaaaatgacgtgcatatagcttactatatcctgaaaatgaaataatggtgtctaatactttctcaataagaatgcagtgtttattggctccttgaagacaaacaagaagagcaaatccatccaacttagcaaagatgcattgttggaattgtaggagagcaaaagaagaatcattggcataagcatgaatataccacaatgctttaaaagaagatgcaaaagaaaaacgcttcatgttgcatacctgctcgactcctctagctgcagggctcctcccctcaaagctcccagccattgcagccaggaaagacgcagcaaaagaaacggagagcgatgccttgcccctgagctgagctcaagttcaaacctcctttgatcaacagtgggagaaagcaaaagatggcagcaaagtgacagaaagaaagaaccacgcaaggaaagaagcaaagcaagagagaggacggacggacgggggcagagcttgaggacggacggaggagggagaagaagcagcaccgtcactgaaggcgacctgcgcaattcaggggccccggaaaaggaaacggtggcaattttattaactgctgggtttaaagatgagagaggcaggcagtcagtcttcgttcgacacaacctgcagaggtaaatcctgttctcccttttgattctgcgcccctcgctttccgtatattttctcttgggtagtgctagtgcggcatctctctgtagtttgtgacttcgagtgtaccgaacagcagtggcatttagctttcctctgttagcgtgagtaggcgcttcagaaatcttggatttcatgtcaaatctcaggatttgccacaactgcatgccacaagccccggaaaacctggtcactgccttccttttccctagcatctcttcatcagtcggtacattaaactacctcagttttgctgaaaatcttgcataattggatcatccgatctctgattaccatgatcagcatttctcaaagaatgcatcgaataacagaattactccactaccgtaacaaccttacattgtttaaaattcacgggcatccgatctgtctagggtggccagttaaccatccttggctccttgcccagctgtggtccagaaacgtggtactagtatcgtgatcatgagtttggacgttttagatagtaatgaggttggatttgcagaggcaagcatccacgcactgctgttaggattttgggacagcacatgatggtccgaaagaagagacgatggaggggggtagtgatgcagcacgtgtgcagcgtaggcaggcgctgcccccgttctggcctgcacaactgtttggtcactcctgtctgcaaatgatgccgtctcggtcgcttttgctgacttgatcttgctggggtacgttttttctctccctttttctccaacgagcagcgatcgtgacgtcttcgtagctcataatttcgtattctacctttcgtctccccagtactgtatgtatcagtatcactgcctacaaatgtactatgtctaccggtgctacgtgcatttatgcgctcacctttgctcacgacatgtctattcattgcgcatttatcctattgcagtcgtactgtgatcagttgtactgctggtgctgctttggtcgtgtgcatccccaaggattttctgcggtgtccactgatcaggtaggagttgaattcgtcaccttgttctcgcaaaggttagtgttagtgtttttgcaagggtagattgcttattaacaccagtggtcatggagccatggagatgcttaaggtgacgatgttgttacagctggaagtgaaaagatggatggtggggaagaaaaggtagagaaggcaagtaggcatgtgaaagcaccaacgagacaagcatgacgggccaagggaaaagataaaacttgtcctgcctcctcaacagcagtaaatgtgttgatttgttccccttgcatttcccgtgtagcgtcatggcattggcagtaactcgtggacgatttctctagcgattgttacccgctgttcatgctcaaaatggcaccataatcttatacacagccctactcttgttctgcagctatttgcacttgttctgcacctacggtctcaaaaaaggcatatttgtatgcctcctacacgggtaaaaacaggtgcagcaaatagtaccagtaagtccaaattaacccttttattactgtggatgagacaaaatgtaggagctagctgtctgctggcatgtggagtgactggaaggcatggcatgtgaaacttgtgaagccatacagtacgaagtaggtgaaaaacatacacatcccctcactgggtataaagtttgatttggcctaaattgaggccggtggttgcgctactcgtaggcacgtactacatacatcgggcacggtcccgaataattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactaggatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttcagtttttaaaaccatgatatgtctcgcggttaccacacagttttcacggtaaccgcgcagttaccacggtacgtaaccaccttaccatgggggtgtgataaccgcgccaataacaataagggaaaccctggttgcatgcagagtacagtagtttgagcagcagcatgcatgggaaaggaggcaaacaatgaggtggaaaaggagggacacggatgatggccgcggtttcccgggcacgggcacggccacgcgtgccggacggggcgtgaacagaagccgcgcccgtggtgccgggaaggaacagcaacagcctggcccggcatcgcccgtaaatggagagtttgggtacttgggtgggtcaccggcggctggaccctcgcatgtgcatgtggtgaagaaaatggagtttgtttgtgtggtctctgtacttgcttgtatggttcgtgcgtgtacatgccgagcaccctggttgctcggtgaaagctttaattggatcacgcgataattctcactttacggattgatttgtatataactactccatccgatttcttaattcttgattgatatttatcatgttttagacctgggttaggaggagaggagaaaaggcatcgggtgcatgagaaggaggcggagttctgattgccgtgaaaaaaaagacatacgtattagggaatgacctaatatcaaataattagaaggagtgaggctttaaactcagatcgtatagcccaccaccttgtgaagctagccggaaaacccctgggcgtttctcatttagatcaccaggataccagccaccttcatccacctagcagaaatgaatgcctggtacgagttagggaatccgctgttgtcttcttcctgatgcttcgccttctcaattgaccttctctatgtatgttttggcacgcgctggtgatggtgcatgtgggtagtgggcggcggtggtatcgggagaggaagactgcgacacctgatcttgaacaagctgtcgcctatcactgttcatggcactggcatgcatatcctccaatcctcgacccgtggaaaggtggtgcacgaccagtgtggcacacaggctgtgcacatccaactgtcgtcccacccaatagaccctgacgtcagtctccgtggctccctttgcaccgagctcctgccgtcagtcgttttcattgtcccaccgctaggtcttgcatcaacttaccgctccatccccatggcgcaagaagacctccttatggcccctggtcacctacaccaccatcgcttgtgctattcctcggctcgttatcgaggaggagcgacggcggtgcgcacctcgtgcgagaagcacactactaggaaaaccattttcgcaaaacgagacccttccatttttctaggcgggtatcattttcggaactaaatgtcctcctgtgaaaacggcaacgggggatgggatgctcgtccgcctgtgaagatgcattttggtagacagacgaaaatgcatcttcgcaggcttttgcttacaggtggaccggacggccggtccacttaggaaaaccgttttcatccgctggaaaaaatagttttcctagtagtggcagatacaaggatgggatcccgtacttttgcatttcctataggctaacacctttatcatctctaatcctagcttatagcaacacaattagtagatatgggatggatagctaggtagagagtctccacacaaacaaattttggttgcttgtgggggtgttcccgaggcttagagggataaccgaagtagtggcgaccggcggtggtgatggtgaggccagtgacaactttgtagattgggagagggcaggggatgagtttggtggcaggagaaaagggcgccaaccagttagggctggacgtggtagatgatggcaacgctcgttgctggaggctcggagcgatgattaaccttcttaatcacttcggtcattaatcatccaatatatgtcagatggcgactacaatgcagtgtaacgtaggaagactaattcattaacaaatattgtgtgttcatgtatcaccttatctgacgtgtcttgagtgatcaatgactaaagcgattgacaaggttagtcgtcattcgctatatcagctgtggtgcgggggaaaatctggttgcccaaacaaagctcgtcagagggaggctgtggttggcatccgaaggtccaagaggaattttgattgaaaaaaaaaaaaagagaagtgcacaggtccgagtgaagtccgagtcagacacctcacagtagggcagacgaacgtgggctgttttagacgcatttgtgcgtgtggcccggacacgcgaacattcgtgcattagcccccaacccgtgcatcctgcctgcctgcctgtgcacgttctcactaaagccatgggaccggcaagcgtcgcatcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgag

SEQ ID NO: 18294 - DNA, 4111 bp, Oryza sativa
ccccttgccgccctccgcgagggcgattttgcactgtgcgggggcccgcctgcaaatgggcggcgagggggcatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttaggccatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtaagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctgacgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacacgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagtgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcctacctgcttctgactcatccatatcatt

SEQ ID NO: 18295 - DNA, 8096 bp, Oryza sativa
  unsure (1)..(8096): unsure at all n locations
cgacatcaccgggcagagcagcggcagggcttggcgcttgccggtgcaacaacggcaaggtcggcggcgcagtagtgggggactgcgggagctcggcggcgcgatagcagaggacgacgggagctcaacggcgtctgggcagcggggtggctcgagcacctcccctcttctttcgaccaccgcggatcaaggggtagcgcggccagcagtgagcggaggtcgtcgcggatcgaggggcggtgtggccgatgagctgcggcgggtgcagatcgaggggcggcgcgaccgacagcaagcggaggtcgtcgcggatcggggggcggcgtggccggcgagctccggcgggtgcagatcgaggggcggtgcggccggcagcaagcgcaggttatcgcggtcggggcagcgtggccgacaaactccagtgggcgcagatcgaggggtagccagcggaggccgtcgcaaaggcgggggccgcgatgagccccgcgacgctctcctctctccccgttggcggcgccgctcctctctctggtgaggtgagcgcgggaaaggggggttatttccctcgctgatgcgaagccacgcccgcgaggctccgccctccacaacgcggcagttcaccctttcttcgccctccgcaagtcgttcgacgaacgaagaacgagcatccatgtttggctacgagaacctcgtttggcttcgcgtaccgctgatgtggcgctgaatattcgtttttttctatggggctgaaggccacgtccttgcactttgaacgccctatgagccatccgatcatgccccaagcctgttcccttcatgctcagttcatgtcatgaatcataccgtcgcatccggtctactccctccgtcttaaaaaaaactcaacctaggagatttctcctaatacaaattcgttctactaggatctcctagcttaatttttttttgatagagggagtacttgcttgtgacaactaatcgttcaaaacacctttaatagcgatcagccgatcaacgcctagtcagtccctaacaattggcttctccaacaaaaatgttcaaaacgaccctgacagttttttttttcttacaatgatactgggggctcatgttcatgaaccacaggcacgccactgaccggatgtgcatgtgcctagatagctagacacggctggtcctagctaagaaaacaaaagaacagggcctaggacttgatgttttttccattttgtgcttttgtgtaacatcctgcatttccttctttatgaaccattcaatttgttgatgaagttcttacattttagtgttgcaaggttcagctccaaccttccacctgtcgaactcagtaacgctcaacaaaaatgagcttgcattccgatgccccccaccaccgtattcctacaaaaagagtcaaacgccaacaaatcaacagccttaaaatagatcattttcagatgctactttacagccttatagatttgatcggaggatgaagtaccttagagatagaagtagtgtcttcctcgttcaaacttctaagacttattttcagcatattgtcattattcaactcaggtactttgtacactacagcgccaatacttctggagaaggtaccattggttcgtgttagaacaacatagcgctttgaagaaacaatatggattgttcatcaacatggagaggttgaacagaaaacttgcctcagatttaaattacgactcttgtcagctagctgatttccaagttcgcttctcaaatttgaaattgcatcagcgttgacagcctaagggtcaataaaaatataattcagcagagcctgtaatgttggtaaaatgcaaacaaagagagtaaaaagtattacggatactgagacattaggctgtaggaatggttgcatgcctctgcatcagtaaagtattaagctataataagagaacctcaaattcgatggcggcgaaccataaagctaccataagtaagctatcttgaaattcaggtgggaatgattgcacaaataaaaaaaacatgcagaactaatggaaaaaagatacgtcctggttatgtaaggatagtggagttgcacaccagatggttccagaacctggaactggaaagctacgtgtaccaaaaaagaccacaggattttttcttgtaatatgtcaaattttaatccctggtcacgaaatatagctactgatccagtttactggaaatgtgctaatttggatcaaacatatagctcatggaccatcataaattgcaacaacagccccatcaaacaagtagtataacagaatttatagacgaatgtagggacgattcaccttcacataatagaatgttgacaaaacatgaatagaatattaatgaacatacaaaataatcaagagaaaaggaaaacctgcaggtatttaccagacaattaccgaacctgccacatcctaatgcaatttcataggatttctccagacattcatcaattaatttttgcttgtgtgacaatgttgcttgtccacgagaaatgacttcctcaggatccagttccagtaactgcaacaataccacttcacaggaagttattggaccaaaacaatacaagctttggatgaaaaagcattttggtatgatggctagctcggtgatttcaatgttttgtaacagctctcgtatagtaggacaacatcaataatcattctgtccaagtatagaaggcactaatgtattttaagatctagactttgtttttaaccaacaattaggctagcaatatataggtttagtgatgcaaaagtggtggtgctagatttgtaccatgaatttttaatgaggatatgctactgtagcagaacactagtaccaagttacttgcctgatcaaacaactttctgttgatattgacatcaaactcaatgtccaaatctttcaggccactgctgaaggccttgctattcggaatggtccatctccacagatccccatcctctataaacttgaaaagcttgtgtacggtttcaagcttgttatcaggtagatatttcaccccattaaaagaattgccacttctatgattccataaactactacctattgtcaagagtttgttgctaaagaaatcaaatgcgattgttgctccactgcgttgcatgtcaatcaccttattgacattttctccgagtgtggggttcccgcataaactttcaaaggcagttttatgatgatccaagattgtgacactgaacaagataaaaacattagaattgtcctagcattagggatagaatattctacaaaacaattcagaatgtatagaaatattgatgcataacttctacaatctacagttcagcaatattcagaacagttgatggccacaatgtgtttccccaaaatattttacagaatatactgaatctactcatgaagtgtacggaaatcgaatctgtatattaaatgaatgacagaatgaacataggctgaatcttatttctaagaatccaagattaacagcataatgcacatgaaactaacacacacagaacaaaacttaaagcaaatagcagtagataaatgcttacaaacctctcgacttttggggcaatatcagtgacaaaaccaggaggcccgacaaagtctaggagataaacatctttgatttcatcaaatggaagagcatcactcctacagagagggtaacagtaagaataatgctatagtaaagagaaacacttgagcatcactgtatctgctgtgcagaggctcatatcatgacaaaatcatcaaacagctttgttcaattttgacctcccattcatcattttcataattcatgaaatattgaaatccgggaaaaaaatgtatatttcacctaggcctgactataccaaacgtcactacagaatagaaaccccaaagcataatctttcccctccaaaaagggacttgtcagaatgccaactagatgcaattttctcccactaaaatacaaagggaaagcttaataagcgcaaagcaatgccaaagtgaacattgagcagctccacagatgttggtcggtctaaacgaactgaaactacagttagacattgtaaaggaagagttgtactcgcttgcagcttcctgccgatttcacatctcttcaaacgaacctatggaggagaagaacattggaagcagaaactagtagttcgaaggcccaaaggtcgatctcttaagttacagaagatttacctgatggggtcgtagacggtgttggggaagaagcagacggggagcgcggcggcggagaagtagaggtgcgcggcgagcgccgcgaacgcgccgtccgggcacgggtagtggtacagcacggccgagaccctccgcgcggacggcgcgaaagccatagcctatcgctatagcacccacctggagatggcgacggcgacggcgacgacggcggcggcggcgaaacgagaggcggcgggtttattcgccggacggtggtggtgggccggtgacttgacgctacgggcctcgtgactgatcaggagaccgagctaaaaccggcggcccggcccagcccacgttcctcgcctggccacagaaccattgccacgtcaccgatccgctccactcgcaacgacgagcttccccaccatccgattcaatccaacggcaatcctccccccacccacggatccatccccgcgcctcccaccacgtcatcaatccacggaaacacaccccaacccatcgcgcccgtccaccaccaatccaacgtcccaaacccacccaccaaaagcgcaaatctatccccaaaaattctcccgcccaaacacaaactcaaaatccccccaaaattctataaaaccacccccaaatccaaatccatctcaccaagagccacagcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggagggggggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtagagagacccggatgtgccacgggtgggtttttagtagtaggattagtagtatcccaactcctggttgtgatttgctcatttccatagatgtaatgacattacgatttcaatcgtagcaaaattatttgtttcctgcatttctgatcccgttgctgctgtgatttgagatgtgaatgctgatctgaatttgcaacaaggggtaagctgttgttgaagcacgtacagtagttgagagaatcatctaaaagcaacagaatagtggtagtatctctgtatacgaagttcgaactatgctgcagaaaaaaaacacaacaaagtttcgaattggcgattggttcttgaatgctaatgtgatttcgtgctgatttgtttgtgggaaatggcagtcaaaacgtacgtatttaccatgcttggttggtgttgctactgttagctgaaggcaaataaattgccacaagcccacacaatcttcagtttgatgcttagaaactcggtttattactccatgttgtcactcactcacttgtcagtcttgctcatttccgtagatgaaatgatgtgattctaatccttgcgaaaattaaatttgtctcctgtatttctcatttcgttgctggagtgattcggattttgaaatatgaacgttctttgttctgagatgttgagctgaatttgttgcaagcaatggtgggcttgtttcagcccagaactaggcttgccttttcagcctggcccgtatgtatgaaatgtgcagtacggcccaagcgcccaccctaaaaacagcttggctcgctgcaccatgcccgaaatccatccaaaatacacaaatcttcaaattggtgattgtttgtttctcgcggagactcaaattggtgattggtccgtgagtgctgcacagtttcatactacttcatttcgatttgttcccgcgcgttgggtgtcaaaatgttctctctatttttttcagtatactacagttgatcggcgttgattaccgtcaggcaaagggtaaataaattgtcatcgtcttctgatcgatgctttcgcttgcgaactcctcgagtttattttattacctaattaacccgtcatggtgtcgtcaatgttgccccccagaaatcagaatgatggcattcccgggtttgggcccgaagattacaaccctgtcgcaaaaaaaggacttgctttcgcctttcttatactacctcttgtgtgtgactaggagaacgaacgaatggattcgtacctttgttatcacaggcaagttcattagtagtgtagtactctgttgacttagcggcggataagacttaatcgattagcgcactaatcctgctttcctactttaattaatcacaagtagactctaccagtagtacatttttcccccttgccatagcggctctacttgttttagaatttccgactcctaatataaatcctcaagattttaagaatactatttatgtggggccaaatattgggtggtggtggtgagacagactcaccagcacaaccataagatacatttaaaggagtaaagatgtaattataaaattaagaaaatgaattagaagttagaagctactacctccgttttagtttataagactttctagcattgtccaccttcatatagatgttaataaatctagacacaaatatatgtctagatttattaatatatatatgaatgtgggtaatgttataaattcttataatatgaagcggagaaagtaaaaaacttagtgtattcacacctcacctccaaacaaaaccatggactcattatagagccaactttcattatcatatccatttcatacccaatgtaaccatcaccatatagcttataaattcaagtcgtaggaaaggataagtaccccatattgttgaaaggatatacaacgaagaccaaaagtgaagattggaccacgagttagtggtcaggggggcaattaccaggtcagctgagtcagctttgcacaatcggcatctcgtaatgaagcgcgataagtacacagagaatcatcctcatttaactcttttttttggagactatgtcaataatctcttcttaaattagagacagtctcatctcagctagctgcagctttctttgtgtttctttcactgtcaggagggtaacagtggtgcaaaggagtagcaagttgtttgttccacacttataatagtcgcagattaccggatctggcatattccatcatacaatgacaaatagcatgcatttttttaattatgttttgagaaaggttgcaaatgtacatttgttctttagcaaaaggggacatattttagacaaaaggaaatggatgccacatatggtctgtctttgtcctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18296 - DNA, 1691 bp, Oryza sativa
ccctagtgtaatgttcaatttgttcttttgttgcattttgtggcatctccttgaactgatctcgtaatttctctaagctgatggagtagttagaagatgtcatatttcccccgctttccaagtcaccgtccgcctttcgctttttttgcttcatcacttgttttcctggagtaactcctagtaatgtctcaatttcatcaacccatggccccgctaacttgcctataataggctcaccttgaattggtaagccccatagacaactcacatcttgtaggctaactgtcatctcttcaactggtaagtgaaatgtgttagtctcaggccgccatctctctactaatgctccaattagaaatctatcaacactcatcccaaccatctgggaaacttgatagaatccaagtctcttcagtagtggttcacataaataatggtatagaatgcccacgtggtgatacctgacactaacaccatcattagcctgcatacgtaggatacaaattagtccaatcattttttttggaaaggtatatgacagaagctagcaatagcttacattttcccaaacttttgagattttgtgctggcaatgaggcatccatagtaaggcactgatacgttctgaaacatttagttcagtttgctgaactaaagtttgatctccatccagtaagcctatctcctcatcacttattgtaactaaccgacctaacccatcttgattagtcctcatcttactagtttgtagcatacaaaaaattaaggaagcatgtcaaacaacgtacaactgatttctttttcaggaacttataaacaagcatcgtaagatgattgatcaaaagtaaaactaatttctagattatttcacacttttgtttccttatagtcgcattgttatgttgacagaactgggataagcagataaactagcttacaaagcttgttaggaagctaggatgcatgttgctatttgctaataactaatctgtcattgtcttataaagataagcacaaaaattaacaactaatgcttaatgcagcagcactataatgtatcactaaagaaagagaatgccgcacaacgatttagtctccaacgaaaaaaccaaaagagctcatcatgtgtaagacgactaacctgatggctgagagctagtcgcgtgggtgcgtacttagaactgacgacgacggcaagcttgataccttaaggctcgatcaagagaaataacgggatgggtaccgccgtcgccacgccgttaaggtttgtggccgctggtttactcgtgggttttcagattggggattttacggtgataggatgcagaagaacagggatactgttttcagagccctttggcccgtgggctatggacgcaatgagaacatcgcgtccgtgagaaggccggacgctctagatcggtggcgtccaattgttttaatgggacgctgcggaattacgttgtcctgcttacgaataaaaatccaatacctcagtgtttacataaaaaaatatattttttgttttgctcagattaccaaaaattgggaattttcacatcagtatccatctgttgtgatgtagtacgtagaagaaaaacagcatgttgtgattattccgagcatattgcaagcatgaaaccaactttttagtacctgaaataggtaaatgtacaaaacaaaaaccaagt

SEQ ID NO: 18297 - DNA, 3461 bp, Oryza sativa
ggaaattagatttagcacctttccaagtaatcagcctaggcattgcgggatagtcccacaaacaaagaaaaacaagcaacgacacatgtaagtaaaggtctgaagacatactgctcgtggatttttgtagacgatgtcaacagcttgttggtttgttaagtgctcccaaagaccatcggatgcaaaaataacaaattgatcttgcagagaaagaactcttgtgcagatagatggctctgctgttagaacaggtcggcgaagaggctcagaaaggcggaagcgagttatggatggatcaagagcaaattcacgcctctttaaatatgcatcacctatagtccttgaaacctggtaagtaatcacaaaatgtgacaatagttttacatcaagtacctagtttgcatatgcggaaaatcttgataatgtactgctcaacatgtttgggccatcattggggaatctaaatgacacggcagtatttcttgttctcttactaccaaaataaataacatgatcaccttcataatctcttgtaaactacaagaaacacaaaatccttctaaagcacaaactttaatttctatgatttgttgccctctacccctttacttggctcctctaatgggttgttgtgtaacaagtgaatatggtccaatcattaccaaattaatatacaatcacaaccatccttgaaaccatattatagttgtaatagttactcaataactgttgcttaccaacctggattatgccttttatgcgccaaacgccatgcttcagaacaacaatttgtgaatcatcgggatgacgagaaataagttcctgcctcacttcctccttacaagcattatgatcccttgtaatttgctcagcagtaatcttgtttgttctacccaaatagccaacaactgccctagaatcacctaaattagccacatatagtacccctctccatatgataccaacaagacaacaagatccaactgcagctatcataggctttaaaaactgcgttctccgaacaagtgtcaagaaaccttcttcggtagcagaaaatgcccctcgaacaacttcctccgatactgtttcactttctcgggcaagtcctagaaagataggaaaggttgagcagtcattttggtgcactgaacaatttcggttgagatatgcttgccatttattaacgacaaggataaggtcacatcatgcagtcagtggatacacttactcagtagcatctcacgtaaatcaagtcagtctgtaagtaaaagacaacattaagatgttgactcgacaagaaactacagtacctactagtaatctgttattgcaaaggaccaagaatattgatagcttgtccaatgatcagattcactcagtcactggtaagagcattgcgttgtccattgcactgctcatgaaacaacagcatactcgatgagtggaatgtataccaacaagaattgcatccagcaaagagcaatcaacaaaggtaactccaatgattcagaataattacagaaccaaaaaactaataaaggaaatgctactgctcagtgcatagccaacaggtgcatcatgaagcaactaaagagtaaaaccacacaaaattcattcatcaccacctacaagttgaaactaaactaagccatgaagagttgcgattaatgaactggagtggattctattgcaagaagaacagtataaggaagcgactacttacgtatcaggtgtgcgaagaggtgatcagatatgaagcgagcagcatcggcaccgccgtggccgtcgtagacgccgacgaaggtggcggcggagcccgtctcgacctggctatggtcttccaacgcctcgttggcctgcacgacggcaaaggagaactcacccgccgcgtgacgccccaggtcccgcgaccacagcaggccgtcggcgacgccgccgccattatcgccgccatcttcatccttcctcgtacgcgcgtacctccgggccgggcccaagcacgcggacgcaatcctcaacaaccacgagaacatccctcatttcccttctttccctcctctcgaaagaagtcgcctttggaaccccaaaggaccaagaacgcccaagaacaaacttgaacaccctaagtgacaaaaaggattaggtttctggaggactatcccaaatttaatttctagaaatcgaaaaatagaacgatttgtagttcaattatacctgtcgttgcacttgcacctcaccagaagaatcacagattgcaagtgaaattaaatctgggaattgggggggggttccggggttaatcaccaccacacatcccccgagaccagccgaaaacaaagagcagattgccccaatttagtgcaagaattgggcttattatggaatgactagccgaattatcggctaaattggtttttgacttttagatcgcgaagctcggtcagcgcggggaagacgaagagaaagcgggggacccgtactatagttttgagtgatacccctgtcgttgaggttatttacgaagatggcaaccgaagaaaagtgcaaaaaaggtcccaggaaaaggtccgtgagaccgtgaccacgaccgggatgtgttcttgcaaaagggttgggaaggaaccggaacaagcagcacaggattgttgcgttgcgcgtcggccaaacgctcgccgcgacaagctacacgtatacgccgcgacgcgatggcataataaacctcatccgtccacggccacgcgcgaccaaaaaagcgcggccgctgatgtccaccgaccaccgctcgcttcagcggcagcctctcgctgattacttcgcgttcgcgtgatacggaacggtgggtggtggagctagtggtgtgtcgggaggcggatgggatccgcgagccgagtcagatcgcactatcgcgcgacagcaagttcaataatacagccgactactaacttcaattcatctatagccaatctaatagcttattcatacaatagttatatactacactattaatatctggtcccacctgtcatatacacactgcgtcttagagtccgtgctacagctggctacaaatctgtagcccgctactcttctctctccttatttatctttttaaaatatgtttgtagctagcttatagcctgctattatacctgctcttaatctgaagcttatctgcaacggtgattactgtgagcttttagctcgtgcgagtcgtggaaaccacgggtgaacagtcacaggtcgatttccgagatcacttcgcactgtgctaggcgattggagtactcctttctgtgaacgtcgactcgacctcctctttgtgggacatggtttttgagtacttatctacgtttaccgcacgattgtgtttgaattaggaattaatccttctcgtgaacagacgaagtcgcgctaggactcatcgcatgatcacgtggttgcgcttcaagccaatgaatggg

SEQ ID NO: 18298 - DNA, 7367 bp, Oryza sativa
ataaccccgtgggatccatatttcagtttcacacacaataataataataataatggtgggacccacatgggccccagatgtcagtctaactcatcccctcctcttctgcttcatctctctccttctcccctctcttcatctctctcttgcgctgggtcattctgattctcctcttcctcatcttctctgtcttcatctctctcccctctcctctctctcttctcttcggttgacaggcggcggggagagggcggtggccggcggggagaaggggcgcgacgcggcggctggcgggagggaaactagcggggagaagggaaccagcccggcggcgccgccgcggccgtggctgcggacgacgtcgacgtcgacctcagcatcctcggcggcgggatgaacgtgtctcgccgaccggccgacacacgcgcgcatcctcggaggcggccgtccgcgcgggtgggtgagggggccacctcgccggcgggagaggggagaggcgaccagccgcgaagacgaccccagcgacgattacgaccgtgcagcgcgcggcggaggccgatcccgcgagcaggaagctcttcatccacggcctcggctggggcgccagagccgatgacctccgctccgcgttctcccgcttcgacttctttctcttccgctcctctcttccgtcggctcgcgctcggcaaatcccgcgtgtcgtcctcctcctcctcctcctccttagtccaaccctcgtcgtccaatctccggctcttctcctaacgacgtcgcggtggaggagggcacggtgctgtgcattccaccgaggatgctgcacggcgcgtccatggagttgcttagtttgcgttctgtttggtcttaattttgtttatgtgcctaatcatacaaaggtagaagcaatagcaactagtactagctgactggagtatattttgcttcgtcatcatcatttgcttgtggtacgacgggattgatgaatgaatgaatgatcattgttttgggcaagaaaacaccgttccggccggactgacgaggaacccatcgatccgctcgccgcggcccatggaaacccaacaggagatggcggcgttaccttcggccgccagcagctaacaacggtgggtaatgctcgagcacattgacgaactcgaggtcgacgatgaggactccaactacaactcctgctccgccgctgccgacgacaccgccaataccgtgagtctatgacgacctttttcacctccgacggccacgtcatcagcgtatacttccgcctcaaagcgccgcccggcgcgtcacgcctatgccccggcgcgctgctccctcctctcccgccggtgggaaggagctaggcgagctccctggcctaccggcgagcgcgcacaagagagagatggccggcggccactcttctccatttccgccgccgtcgtcgtcgccggccgcaagagagagatgaagagaggggagaaggagagagaggaagcagaagaggagggggtgagttagactgacatggcgggcccgcgttggtcccactattattgctattttttttgtgaaactgacatgtgggtcctatggggtttattattttctcagatcgaattgccacgtaagcgccacatcagtgccacgtcagattgagaccaagtcaaaattagccacgtaggccaaaaccaccatcgaaaccgccagggacctaatctgcaccggttttaatagttgagggacccgttgtatctggttttgcagttgaaggccgaaaatcgaattcgttgacaagttaagggaccttagatgaacttattccagatcctttcaaccggatgattcggtcctcatcacatgatttcgcgcacgaatagtcccgatttgcttttgtagtcgtaatgattgtgaatcagacgatatggcaccaatcctacccaaacgcattttcttcttcttttcattcatctcatccgattagatctcatccgattagagaaagtttaataatataggaccctaccagctccaaaatttaaaccatcatctaccgtcaatctaataactcactcatataatagttagctgtagaaatatattgtatcattaatgctccacccatctctctcaaatagtttattagagctcgtgctgtaactgactacaaatctgtagccggtttttttacaaatctgtaaccggtttttttatctctcttctcttgtctatcttccacacaagtacaaatttgataaggcagcttgtgtagccctcttttatccgactcagagcaggtacaatagcaagctattagccagctgtaaacatattttaatgagataaaggatgagagagaagagcagcgggctacaaatatgtagccagctgcagcacggactctaagacgtaatgtgtgtatgacaggtgggaccgagtattaatagtatagtaagcaactattgtatgaattaactattaaattggctagagatgaattggagctagtagtgggctatactattaaacttgctctcaactctacccgtgcagtcatctgcactccgctttgcgggtaggcacggctatctagctgtaacctgccgagaccttcgaacgattggttacagaaaagagaccgccttgggggaagggaagcatcaagcgtttctactgcaacttggggtgccaccacccacacgaacgcccctgatcccccgccgccgcacgttgcccgcggaccattcggtggtccctttctctccccttgcacgaacccgtcttgttctcaccgacgacgcgctggcatgtattttcaacgtcttcttctgtcgtgactcgtcagtgtaccagcttccatagacccttatctgatagagtacgtacgtacagtattcaggatgtgaatgttaatgtatgcaatgcacgcaggcagcaaaatactggagaactgtactactactaataaaactatcaagcattaaccaaacgaataatgaaggaaggaaaaggcaggatccgaagaatcagcaggaccatcccggttgctatagccagtgtgggggcagtggcagtggcaggagtaaatctatcggagtcctgccttcccagcaggagcagcagagtcgcggcgccagagcgacgctggctgcagcctgcatgtatgtcccgcgacggcagcagcggccttcccctcgctttccgcaaacgtggacgcgaacccgtcgtgaagcctcctcctcctcatccaatccacctcccccctctctttcccaatccccactgctgcttccgtccgcttccgattccaagtttccaactccctccattgctcgcctcgccgcgccgcgcgctacctaaaccccgcggcgaggctttagggtagatgcgagaggaggccgcgtggacggcggcgcgcatcatcagcgcgtgatggggaacacgtgcggcgtcacgcttagatccaagtacttcgccagcttccgcggcgcgtcgcagcggcatgatgaggcggggtacgcgcccgtcgccaccagcgccgccgccgccgccgccgccgatgagccggccgggaagaaggccccgcgcggttctgcggcggcggcggacgcgccgcacgccgcgtccatgaagcgcggggcgcccgcgcccgcggagctgacggccaacgtgctcgggcacccgaccccgagcctgagcgagcactacgcgctcgggcgcaagctcgggcaggggcagttcggcaccacctacctctgcaccgacctcgccaccggggtggactacgcctgcaagtccatagccaagcggaagctcatcaccaaggaggacgtcgaggacgtccgccgcgagatccagatcatgcaccacctcgcgggccaccggaacgtcgtcgccatcaagggcgcctacgaggacccgcagtacgttcacattgtgatggagctctgcgccgggggcgagctgttcgaccgcatcatcgagcgcgggcaattcagcgagcgcaaagcggccgagctcacgcgaatcatcgttggtgtcatcgaggcgtgccactcgctcggggttatccatagggatctcaagcccgagaacttcttgctggcgaataaagacgacgatttgtcgctcaaggccatcgatttcggcttgtctgtgttcttcaagcctggtgagtcacccctgctgttagaaactcaattatttatttctgtgactgttgcgcttgctccatcactttctgagcaatcgttgatggtaatagtccaatagatggaatggtttggttggtggaattaatgatacatagttgctttagctcatctgactagagaatgtatggaaattaagatttgagaatagagaataggaatatagtttagtcgtttaaaatcatttcattcattcattgggactcaacatatactgatccaatctgataattagatgttaacatttacgcatcagatggtgaaggctgctcttggtctggggttctctcttttttgggtacaattgttgttcgtaaatgagattgctagcaaaatatgggtttttgcattcatttaaaaagtttatgaatactaaagaaaaatagttaaacttacagtttttcaaaaaagataaattaattatgggacaaatatgtgaagatcgatttctgaattgtttcctgctgctggtggatgaataataaaaagaaaagaagaagaaattgattgtttggtgctttgctgtacagactacagcaataggaacaatcaaaatcgaacctgtctttgtacacttatttgaatctaaatatatgttattcaccgatatactgatttgaccacttctaaaagggctaaaactaactgtttcattgcaactaatagaagctactttacatatagctaaaagtaccatctatcgcgaaatccacttcctatgaatctctcttctataaatctatttaccatttatgtgcatcttatgcagcatttactgtattaatttttcagtgtaattagttatcttataaagaaattccgtttgttgtttactattcttaggtcaagtttttactgatgttgttggaagcccatactacgtggccccagaagtgttgcgtaaatgctacggaccagaagctgatgtttggacagctggtgtgattctttacatactattaagtggtgtaccgccattttgggcaggtatatatttactcctttattatcataaattgacttggaaattcaaaccttgtgttttcactcgtctaagctgacctgtactatatttaatgcagagacgcagcaagggatatttgatgcagtgttaaaaggtgtaattgattttgattccgatccctggcctgtgatttctgatagtgcaaaggatcttataagaagaatgttgaatcctcgccccaaggagcgcctaacagctcatgaagttttatgttagttattttcaccattactctagttcttttcttcaataactcagtatgttttggtgtgtgtattgttctgaaatgtgccctctatggtgcaaatatttagttttgtaacagtatatggtaactacttatgcacagctgttggacaaagatgttaaagaattattttcatacctgaccaggtcatccgtggatttgtgaccatggagtcgctcctgatcgacctcttgatcctgctgtactttctcgcattaagcagttttcagcaatgaataagttaaagaagatggctttgcgagtgagtacattcttttccttttggcaattctaaagttactgtggtagctatcatagtacttcacctttcacaagcaatttgaagtcatcctccattgttgtttgctggctagagtgtccgttaccttgtcttgttccttttgattgttttttttttcagaattgcttcctgtctttattatctgaattttcttttgtgggctagtttttatactctattacatgaccagtacttatgggggcacatttgctaagttttatgctgactgacggtttgtcctgccaggtaattgctgaaagcctttcagaggaggagattgcaggattgaaggaaatgttcaaggcaatggacacagataatagtggtgcaattacatatgatgaactcaaagaaggcatgagaaaatatggctcaacactaaaggatactgagattcgtgatcttatggaggcggtaagttggtgaaatctattaaaattaacatttatgattgctagcttaaggatccttcctgcatgtttttagatattttatgatccagattgcttctttctgaacagaaagagcactgaaagtctgccacctggttccttgcactgttgcacatgtacacaaaagccaagttttatgatcagtgacccatgctttttcttcattgaattaaaacatcattgattgcagaaactgaatgccatggatgtgtctccttagtgtctagtatatggtttgcatcttaggcagaactgttgtctgtgtgaccgtgtgagtgaaattagacaaactatctctattaaactaatctactgtatttcaccgattatttgaagttgagtcatatttttgtcttctatgattgccatgtgatttcatttccaaaccacaagaaaacatttttttttaggctttcttcagctagaacttattttcaatttttgtgaatactcaaaaggtttacatatctgtactgtgcattaagaagaagtaaacaaggtttacaaagaaagctttcactcaactaactaggggcgaacaaaaacaggacaaacacagaaaggttatttttatttcagtgagcatatgcttatgtggcagtaaatgcttataacttcatctcggttttttatttttgtgtgcccctgttgttttaatttacagtctcccttatgtaacgggtgtatgttttatggtgtagagtttattattccttggaaaactgaactgtgggcttacatatttatttttgtttgaataactttaggcggatgtggacaacagtggaaccattgattatatagaattcattgctgctactctgcatctcaataaactagagcgagaggaacatctagtggcagccttttcttatttcgacaaagatggcagtggttatattacggtggatgagcttcagcaagcttgcaaagagcataacatgccagatgcttttctcgatgacgtcattaaagaagctgatcaggataatgtaagcatgttgccccattagtttgttatagctaacacatgcaggaaggatatacaaatatttattaatgagtaaagtgcacgggcggccttaaacttgcaggggtgtgtcatctaggtccctaaactctcaaaatacatacaagtcca

SEQ ID NO: 18299 - DNA, 2351 bp, Oryza sativa
ttgcacttatttcactccttttcatcaggatggtcgcattgactacggggaattcgttgccatgatgacaaagggcaatatgggtgttgggaggagaacaatgagaaacagcttgaatataagcatgagatgagacgcacctggtgcactatgaagtctgaacgtccacagtgcagctttgaaacttcttcaatctccatgctctatacggacactgcctgcaatttttgtacgctgtcagttgtagccttgtaggtgtgggtatgtgtttcaggttcaggggattctaattgttcatctaattcaacagtcggtatgtgtttcaggttcagggaattctaattgttcatctaattcaactgctcctgttatttctacgaaatgcacggggtgggaaagtgcccatgccatgcgcaaactaggctacaatgttcatatacgttgccacagggcctaatttctgcagttcgtcacacctgagtttcctctgtgtttttcttattacatgaagaacacctgagtttcctcttctttcctacacgataaaacgcacaacacggcacatgtacacatgttatgggccgagaggcccagaccaaggcagcctggcatgacatcggcccgagaggcagtaccggtcgaaggaacggtggcctcacggtacgtaaggaaggatcgtatcagaaagtgagtgtcgctttaactaatcaggatccttatctatgcgagttcaagttttaaacttaacatgggtattcgtatttatgactaatttttttagtgataggtaacatactcatcaacaacgaaatgcttgtggtgtggtgtatgaattagacatgtaacatctatacattaattacgcctacgactgtgagcattagcaaaagttccttaaaaatattttttagatttaagattcagtggaatcgttggtaatgctctaaggctgtgtttagactcaaagtttggatccaaacttcagtactttttcatcacatcaacatgtcatacacacacaacttttcagtcacatcatcttcaatttcaaccaaaatctaaactttgtgttgaactaaacacagcctaaacccttaaataaacgtttagggcccctttgaatcgtaggaatgaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattactcattccataggaattttaaaggattggataggattcaatcctttgtctcaaaggccttcataggatttttttccataggattgaaatcctccaaaattcctacatttttcctacaaatcaaaggggcccttaagagacgaaaactcgggatcccggagggacttgctgttgccctgttgctgagttgttgctgtgcacgatgccggcctgcgtgctttcagaattcagattgctccacgcaggcccatcgaagcttctttaattagcgtgcaacggctcgacttgaggaagagatgagaaagaagggattaccggattacgacgtggtggtcagtcggccggccggccgaggcagatgagagatggatcagtgcacggtgatgtactaccaatatgtaccgcacgcgcgccgccgctgtcccccaatctcgtcgacgtcgagacgtggggatgctggagctagctatcaacgccaacggacgcgtgcctgaatgccttgatgcggtagcctgagtaagctcgccggctcgccccgtagtggacgggctggcttgcggctgcaacttgcaaatcatggcatggccacaggggtcaagggcccaacgcacagtcgtctcgtccgcccccgggtttctggctcatatatgccacaatctgtggacaaaccgaacaaactccaccaatgcatcatcccctctcgtttcagcgtcgtcgccaacgaacacccaccggtaatgcgccctcctcagcagtcgcgccaaccgccacgaacgccgcgagcgtccctctctctctctcccactgctccacacgcgcgcggcgcgcccacgcatccatccatccactgcacacaacatacacgcaaatggcgcccgcggcgtacgttgaccccggctgcgtccaccgtccaacttggccatcggaccccgtcgccactcgtgtgcactttggttgaaaaatacgcggtgcagctcaacacgcccctatcagcggatcgcccccccccc

SEQ ID NO: 18300 - DNA, 11331 bp, Oryza sativa
cccccccccccccccccccccccccggttgactccactccacatgcagcgcagcttatagttaaccggggccagcgcggcaacatctgcacttgtctccctccgtgacctcaataatacgcgcgttccatctccatcaggatcagggagggagatatgagatatcgttaacaaatttctcgatcggtagtgctcacgtcaaagccttcagtcgctcagtcggttgagtgagtggttcagggcttgctacttgcttcctagtgtagctagcttgacttgatgcgccacagcactaagccggaggaagaatcccagcaagcatttgcacgaatcatctctgacagtgaagcttccattccgatttccggtgtcatcttcttgaaagtaaattttccacgtgtgatcttacctttgctttcgttttccacctgtccatttcgatcgttatcaggatgtactttaccccttgtgcgaggaagcatccgaccgtattgggggaggcaacaagatttcattcttaatgccatcagacagagactagaattctctgagatgtattttatggttatactatcagataagaggtcggctggaaaaagcgccaagaacagcgtgcaatgaagagacgatcaaacaaagagatttcaactattttattgcaaaggaaagagcttgatttgtgagcttgtggttggccatggtgccagggaagcccacctcacctgcagcctaaccaacgccactaattcgtgaacgggaaatctatccaatccataatacagaaggtgcacattctcatcttatcttttgcattaaacaatattactgatttgacttacgatcaggagaaggtgctcagatattggttgaccaaactactgctgcaagtgcttgagtttgtgtcattgtgtggctattttgtattttgcttgctgggacactttgctctttcagcgactaaactactgacatgtgcattaggaaatcaaggtatttgcaattcattttacatgcgtttgtttcgccgggccgcttcaaccaatcatgaatcttggaggggatgtggaattgtgagtgcgccagtgaccggctctttcggatccaagagctgatagagcctcagagcgggactcatcctctgcatcagtttccactttggcatagtcttaggacctgtttagatgggactaactatcacatcggatgtttggacactaattataaatattaaacgtagactattaataaaacccatccataatcttggactaattcgcgagacaaatctattgagcctaattaatccatgattagcatatgtgatgctacagtaaacattctctaattatggattaattaggcttaaaaaatttgtctcgcgaaatagctttcatttatgtaattagttttgtaagtagtctatatttaatactctaaattagtgtctaaataaagggactaaagttaagtccttggatccaaacaccaccttactccctacatttgatgttaaacacagttacaagttactctctccatactcataaatgaagtcattttggacagcgacacgatctccaaaacataactttgacttcttgtttctataaaaatatttattaaaaagtgatatatgtatacttttccttgagtccatcctctctgagggccacctttggtctttagctggtatagctatttttggggttctcctgggaaggtagtggctctgtccccttccagctatttggagttgtgtgtaaccgtcacagtagtttttcgtctcttctttattttagtcttttttcctcctttcttggcataagtcggtctgactgattgcgtcgtgtgacaaacattctattcttctaatatattgacgtgcaatccttttgcgcgttcgagaaaaaaatatatgtatacttttatgaaaatatattttaagacaaatatattcatataatttttacattttcaaactcaacaacttgagagttattcatgatttatattcccaaggtttgacttaaacattgtcctaaacgacttcctttatgagtacgaagagagtattaattaatcattccatgtcaaggcatatgcttatccttaagatcctccaaaaggtggtaaacaacagtgcaagagtcgaaacatggctcttcaagtcttcattgtctctgcctctccgaaaatgcttttttgcttattgcccttaaaaagtgtattattttgtttactcgttattatgcaatcttttttttttcaattcgatcctacaagaatggccaggtatcctagtgggccataacaacactcacgattctggatttttttaaaacctttctaaatttaatttttaaaaataaacccatcgaaagctcatttctagatctgaacctatttacaacaccaatttaattagcatggcaagaaaacattatcatctcggtgaaaaatcatggactggcaaatatttctccatgctactcgcgatggcatgacactactgttgtcaatgttgccttgcaacgctacctctagtagtgtggtcaaaaagcttgttttttttaaaaaaaaagttttggaactttaaatttaaaaatattcaaaaaaaactgtgattctgtaatcctgctataataattggacaaattttatgaagatcaactaagaaagcacatagtaattattttctttccgtagcacttctcaacgtaattttaacacacaactaatttcgaacaaacacacactcggctacttgagcaaccgaaataactagggatcttcacaaaggctttttctaaaagtgaaaagcacagatcttacaaataactgctaaattgtctcatggtcccatgtgctcattgttatggacatttttcgaaatgaaaattgcacatgaagtcatgaagcattgcaggccaaaacaaaagtgttaccagcagtaccaaatttggattcaacatcgcagttaaagataactgcgtataaaattccaatatatgtgcaaataagttacagcaatttttcacacatttccccccaacaaatcggtgcttacatacatcctggtagctgatgctaccaaatgctcaccattgctagctagtcacactactcactggtactcacaggcaaaacctaaaaaagaatggaatctacaaggctaaatgaaaaccaagaaaagggaagaaagaaaagaaatcaatagagattaaccaatgaggttgcacactggttaatgtctgtctaatgatgtcttctttttttcccatcttggttaaagaccagacagacgcagagttagtgcgcatgccactacgccaactctggcccctcggcgtcgcaggccggcgccttccagtaattcaagagcagcgcgccgatgccgcggccgccggagcgcgcgccgcagcggccgcaccgctcgccggggggcatctcggcggcgacgagcacgcggcggcacgacgggcacgacgagtgcgcgcgcagccacgtgtcgatgcaggcggcgtggaagcggtggtcgcactgcggcagcacgcgcacggcctgcccgtcctcgaactccacgaggcagatggcgcactcctccgcctcgccgccgccgccgtcggagacgtacgtcacggtcgggagcgaccgcagcacctccttcttgacgcccttgttcgccgcggcggcgccaccgccgccgccgccagccgctgtcccgccgccggcggcccgcgcccagcggcgcgtgcacgcgcaccgggcgacgaggccgaggccgaggacgcagatgagcgcgcagagcagcccggcgaggatgacgacgaggtccgagttgagtgagtcctccaccgagccggaggcggccgcctcaaggagcattctcgccatggctggcacaccaggagatcgatcgaatcgaagaaaatggcgtgatcaagcgagccgcgagctagctaagctgccgagcagtgtgggagattgagcagcgcgagaggcgtgtgaggtagtgtaggatggggttggtttgcttgctttatatagagctcccgcgggcagttgcttggcgacttttggtctttgaaaaaatggatggaattccggggaaaaaaaacaaaggcataagtcacttgagacttgagaaaatgagagtagtaggacctctgctttgggctcccacactttggcggaagagggttttaagtgggactgataatgctctctttcgatagtactactgtatatctcaagtcacaaacaaattaagcggaaataccttctgtccgaataaaccaaacgacatatttacgaacggaaagtaatttgtaaataaaatttttttagcgatctaaaagtaaaggctaaaaaaataaactttaatgaaaaaaccctaaaatcagctttaaatttaagtttaaaaatttaaattttggctgataattataagcataaacgaaaagatgaagctattctactcttgctgcaccataaatacaattttctttttagaaataagcacaagggtagaactaagagaaagttctacatttcagatacaatacaattagcaccggtgcaattgcgcagggaactactatagtataattgtgttttgctataggcaatagtaaaatagcagcatacatcgacttctccaatgtgctaggtcaaacaaattaaggaaaagcccattttacaacttgaaattccacgaagtttgaaatcgagccttaactttgaagccatatactcctatttaatttcaagcgtttagaccatccaatttcagcctatcgagatcaaaactagttttgaatttaaaattgtataaaaaaaaaccagtttcataagacagatctgcaacctacatcacttggtgcaagactgcaagcggaccacgtagccacgttagtgacgtatcattcaaagccactctaaaataggtacaaggttgaaatgaacagcctcttagaacattaaaagtttttttttcgcgaacgcgtaaaaggattgcacgttaatatattagaagaaaaatagttttatttatacgacacagtcagccagaccaacttatgctagggggagggagaaaaagcaaatgaaaaaagttgaagcttagagaaactacgacggctagaaacagaccccgagtagcgggaatgggccaaaccacgctacactcccaacaaatccctaaaagtgacgacgccagctaaaaatcacacatggcccttctaatggatgaacttcagaaccactgagatggttaaaagctgatagtacacggttttaaatctcagaatcgagatttagactaacattgatttatggttgttaaaaagaaacttcctcatagaggaatgccacgaactaaagccttgattagacacaaaaatacattctaaatatttcacttgtctcgtgagtgagcagcataatagcatacacccaactctcaagggttccagggaaagatttatgcgattggcactataatccttagtagtagcacccacaacacaacccagagagtggaacacttttttttggtagcaaaaggttgcgagcaagggacagatgtccgagccaggagccacacgaaacaatcctggtacagatactttcggcgtttctctcgctacatctacatgtgtcacgctgccacagcctacatgttctctcatgcgtgcaggcaaccagcttttcccgtttatgctagtggtggtcacgcttgggcatttcccttccctcaccaccgttctttttttctcttttacatggcgtgtgtgcaaaactgtgcatggccgccgcgacccgagacgggaaacacgcccagaggacgcacattctccccctcacagaaagcgcgcagaaacgcttgccgggttgccgctccaaatttgcgacgtggggctcgttcgatatggcttgagcctagccgaacaatttcggcttcatcttatttgcgacgtgttgtaccggtgcgagatgcggaaaggaacaccggtgactactggtgatgagccgtgagatattcgaaagacgatgcgatcttgctctcgccgaggacggcttgccgagagaatttctcgcctttcagtagcctccatgctgcggaagtacgtatagtcccttttttgttgtagtggtgcgagagcccaaaagcagccacttcgcacatggcagcggcgcctttccgcagcacatatcactatatcacatggggggcgaaccaagcgtaactgaacggtaggttacacgagatgtacgaatacgacccagcggtaagcagctatgcacgcacggctgcagctcgacgtgcaggtttgcatgttgtatcttgtatatgctatgttgctatgcacgatgggagtgtgtttcatgtttgatcgatgtgtcgaggtaatagcgaatcggtgatttgggggtggatgccacttttcaagcctaagctaggcactgagccacacacgatgtgtagccgccttagggtgggctttttggagtgtgatcaaaagctagcacagcgccacctttctctcggatcagcgtgacggttgttgtggacgagaaacagagagccacgaaactacacaggtgcgacacaacagaaagatttttcacctgaagcaccaaattacacttttagaccgagtaaaactgggcacttccttttagtaaggtaagccgaattgtataatagcatatagaaatacaattaggaaataaccgaaagtcagaattaaaaataagaaatattagaagtagagtatagagtctatatagaaatacaattaagaaaaaaatagaaatttggaattaaaaaataaggaatattagaagtagagtagagttcatattgaaatttaaaaccaactaaaattcggaataaaaaggagcctccacgttcgctctcatggcttagaaattctcacattaatcagagaaaaagaaaagagcagagtccatatagaaatacaatttagaaatagctgaaattcagaattaaaaaataaggaatattagaagaggagactagagtagttattacacattagtagttttgaaaagtcattgcaaaatttaaaattatgtcgtcattgtaatatattttaataatataatgagaaaacatatatgctattatataagagaaaatataatgatgctagccgcgcaatctgcgcggaccaccatgctagttgttagtaacgtactaagataaaaagctatgctgatcgaatcatctgaaaaataaatggtcgcatatgaaggagataatatcttcaccttaaactattgtcaacagtgaaatttgaattatcacatcgccaatagtcggattcttgctatattcggttaaggaaattaatctattaaacaaagcttatcaaggaggatacggcatgacaagttatctattaattaataatagtttattagtttccttttatctctaggaaaatatgtttagtgtcctataaggactttatgtattccttttatctttaggaaagtttctttcttgtactacaaggactgtatctccccatgggtataaatatgtacacccggggtcattgtaagatctctctcacgatcaatacaattcggcgcatcgccaccttttgtcttttctactttattttatcgtccgacaggacttagcacctgacgctgggctgcatcggttttgatctccggcgaaggggtaaatccaatattccaccggcccaggcaatcgtatctacgtcggtgttgttcaaggctacatcagtacattcgacctcttggattactctggtttggttgatatatttgcctggttatttatcatatgtcttagttaatctagtcttagtatctcaatttagctatatcggttgtctctcgctttaggcggaactctatcagttgtctctcgctttagggtttccgtcggtatcggctaaattgttttactagattagattagctaaggcatctatcaccctgaaaattagtcaagggctcgattgtctagatattatgtttcttttcataattagtgatgcatcagttaagtttgatctaccaagttgtgcttagaaccataatctctagcctgcttgttgactgccaataagggtttcctcggggtttcagccgatgaattatctggacgttgcattggcttacaaggattgcatataagttggatttagccgataataacaaaggctttactgtttaatctaatctcgtggattttatggcatcggacctccagctgatgtatgctttaaccttcggatcagtgctcattctatcatattattgctagccaactggtttctactggatattattattgttatattatatcattatcagtcgatcgcctttatttatatcaagtgtcagattctacatcaaacacataaccgatagctcaaaaccctatcgctatcggctaatatcgacatcggctagaactactctatcggcttgtcagccgatcgacaatttgatctactattttcataccttgtcagttgcaggatcaaactgactagcacgcctgcacctcaccaagatttggacctgcactagagctaagcagatctcccaagccagcgtatgtttttcacgtcaacaactatacaaaggaaaaatatgcaattttcaaacttgaactgttgaactcatggttaacctttaattataaactttcacgtgatgcatatttgcccctagagaccaaaaccacctttgttttcacctcaaaacctcctcagggcaacaacaatgtatatagcaaaagtagtccatatagatgggacccacatatatagactttaactattgtaacattcccaatgtatacagatagcaaatagtattaggaggagagaagaaatagagacaaataatatattttatgctctatgggcagcccatatgcttatggttagcttttgttatttctttgctatggactagttccacaatgttactagctagttgaatgaaatattatattgcatatgaatgaccacttttgaactctattgtggatgcccttacatcctccaatagcggacaaactaactctaaactaagtggcgcatatttttttttcttttcctatgattaataatgataattcacgtagaattagatttaatatacaaccctgaaaatttatttctattagcaaaatacccatgtgttgctatgggtaaaagaaaatacattataatatgtcatagagatttttttttatcaaatatgttagtaccacttattacttatttaaatatatggtgtttacttgtttgaaacacacactggactattccatgatataaaacttatacaagttataggagtggtggagtggcaatggcagattcactgctgccaccactagtgttttttaaaggagtatatataggtaccattacatgtagaagtatatttagattttgtatacaactcttaacttctatttatataggtttagttctcatatataactcttaacttatagaaatctatttctatagttataattgtattttgtatgccgttacaattcaaacccatcatgatataacagttaagatcttttttctccgattaatgtgagaatttctaacctttatagctaacatggtgtctcatttcaaagttgtcttgataatataataaatagattactaggtcttcaaaaaagcggagaaaaatgacaatatgccactccattcggtgggtctcgacaaaatgccaccaactacaatacaaagaataaaatgccacttaataggttactttcaggacgttttgtcactttggaggattttaagaccaaaatacccttggatgtggataaagaggaagagggaggagcggggaaggttgagcccgacggagctcatgcttccccgcagcgagcgcggggcgttagctgcgacgacggacggggggaggaagacaacgacgctgatgggaggaggaagacaacgacgctgatgggagagacgacggcgatgatgggtggcgaaggacggcgactgggggatgagggcggcgccgatgggagggaggaggaggcgacgacggcacagagggctctccagcgctgcccacccacgcgcttgtagcttgccgcctccgacaccgcccgcgcgcgtgctccatgcttgctgcttctggcgccacctgcgcacgcgctcactgctcgcctccttcggcaccgcccgctgctcgcggcaccaccgtcctcctccccatcgtcgtccgtccgcacgccctcaccacccatcgctaacgagcacagacgccgccgtctcgatgttccctggtgctccccctcccttctctcttcctctcttcccagggtattttggtcttaaaatcttccaaaggggccaaatatcccgaaaataactcagtgagtggtatttcatcctttacattctagtgggtggcatttcgtcgaaatccaccgaatggagtggcatattatcctttttctccttcaaagcgaaggtggtctcatttttagctatacttagagtaaattttattttgcgcgaccttttattacccgatatttcattttggaccaccctttaacataggttttcactttggaccaggtaatcttccctttgttccactttagaccaccccaaccctcttttccatcatataaacaattccgagtacaccggcttcctactcgtcaatgaatacccacggttacatctagactattgctttgacatatgacaagttgatgcatatagataaaatagttgagggtagtccaaagtgccataaatgtaaattttcccggttcaaaatgaaatatttgtttggtttgaagtgaaacaatgttaataaaaggtgacccaaaataaaatttagtcctatattataaatactagtgagcgagcacgtggaagacacattgatagatataattgagaaaaaatacggttattgttgcttatttactgatacattattaaagaatcatagtaggaactaagtaaaaaataatattattgtaagcaatacattgttaattcatgaaataaaccttaattgtttattttgttacatgacaaccaaatgcaaaaaagaaaatggaatatttatttgtcatcatcgatttcacgctcactttaagatcagtccctcttaggagatgaggtagtgtcagtgtcgctcggttgtagattgattgccctgcatcttagggcaatcttcacctgattgtggaggaagatatcgtttattaggtcttctcgaacatctggatgcacatgtatataat

SEQ ID NO: 18301 - DNA, 5434 bp, Oryza sativa
catctatacgcgattttcagaaagtctggtccgtacgaccaatacaaccattaccgttgcgctatggccagacagtgggatgtacggtcctcttctaggtacataacgtatttcatttctgctgcttcaatgtatgaactaacataatacttaatgcatcatattatacacatgtgcatccaaatgttcgagaagacataataaacgatatcttactccacgatcaggtgaagtttgccttaagatgcagagcaatcaatctacaaccgagcgacactgacactacctcatctcctgagagagactgatatgaaaatgaacgtgaaatcgatgatgacaaataaatattctatttttcggcatttggttgttatgtaataaataaacaattaatgtttatttcataaattaccaatgtattgcttacaataatgttattttttatttggttcctactatgattatttaataatgtatcagtaaatgctcaacaataaccgtattttttttctcaattctatctatcaacgtgcattgcacatgcacgctcactagtaattatagcttaagacagttttcttatggcaaaatttactaaaggacacttcaaaattgtgtaattagctgtgggacatccgaaagatgtaaatttgtccgaggacactctaaaagtgtggtaatttgctgcaggacattgggcatattaaaatataatatccactgaattgatgagagagaaaccacgtaaaatgattgttttgccccttctcttcttccccttcgtcttccccaacactagctgcctagcgccattgccgatttccgcttcctcggtgagccccgcatcgattccttgcacctatagcctccctaggatctctttaactcgttgggcatacatgcatggcagtccattgaaggaatcaagccgtcgccgttcaccatgctcagcgtcctcgtcatcgcccacaccgccgcccatgtcgctgcaagagacgacatcgaggtcgtcgctcccggaccggctcatctcgttctccactgccacgccctcctcctccccgccgctcggctgctggtgcggtggtgactgattgggtggttgtggggtgcaggcgatacgggcaaaggatctgaacgagatgttcccggtggccaacgcggaggtggcgccgatgttgaacccgcgagggttcgcgaacctgctgtggaagcagctcaaccacctcggtaacaccgggttcgacctggcgctgttccgcgtcaacgcctacagcaacatgctctacctccatgccgactccacctcgcctctcacgtaagacatcgaccactggttcccctgtgcccgtaagaaacacagaaattgaacgaactcatcccaagatccgcttcgagatcattcattcgtagatagggctgagggcaattttgtcgttttgaaatttctctcccatctttttatcagaaataataaaatattgtctcgggtgtcctacagcaaattacatgaattttgtggtatccatcagcaacgacacaattttacagtgtctcacaaccaattacacaatttttgggtgtcccagggcaaattttgccttttcttatatgtcgtctccataaaccccatctttgaattgctgcatgaatcatacgcatttggagctaaaaacgagttgaacacaaatagtaaaatgttttttttcaaagaactttaacaaaagacatatttctcacgccaaaaccgttataagtcttttcttttggcatgctctcttattacctgcatcgtcataaatcttatataatcaaaggatatatatagctgatgccatgtaatttcagatggctggaactgcaaccgtctggcatggcctctactctcttcgaacaccttgcggttcaccttgggtacgtactaatgtactatagtgatctttccactccttgatagttggattacgtttccggctgctaattaaagtcgtgcattcagtcgtgcataccgcacacaaattgttacatcaagattcaagacccaccaagatttatgcgacgggacctatcacggtatcacctttcacattgtaggctggatacgctgatttcaggtcagattccgcttgataggcacatcacaggatggcacacaccagccgccagaaaaaaaagctttgcacgagcttaaagcgccaacatggaaacgtggttgctctcaggacacaaacagttaaagtgtttcctgatcccaagtaaaaagacggccgagaagataccatttcacgtggttgctcttaggacacaaatagttactgaagctaagtaaattgatcgactcctatttcacgttcgagacccaaaagaacaagaaaaatattggagtatgagtgaaatacagacttaagcttttggtgaaatggtttgtgcgctatctcacaaattgcactggctggtttaatcatggatggaggaccaaatctgaaggaacacttgaagcatgggacgaccctgccttttcagggtgcagatagaatcgaaacatgtgcaaaacgagcttttggaaaagaagatgctaataagcgcatcgaatcgaaggtgattatgactttaaaaaagggcgccagaatcaaacatgacgaagtatctaggataaagaccctggttttctgataagataagatccgtctaatacagtactaagtgactggtactgatggcaatttttgtttggttctctccaaattggagttactactacctaaagaagagaacgcaccagtaaaaactaaaaagacagtcgagcagaaggctctttgcatctgtaataccaccctccttaagaggatacaactcggtaccgatctgcgataaactgccttctctttccatggggcaaacggcagagtgctgataaaggagtatgcatatgagggctaggccattctttacataaacaaggagaaaagtgatagggctattggttcaagtatctcaggcttcctttgaatagaggtttttgcaggcatttcgagggtgtatctaaaaatctgtcgcaagtttattgcgtaaaatttttcaaatgtaagtatagtacaattttagtgtaattacattgcaactatactaaagttacagtgtaatacatgtaactaatgaaaagcatgcatatctcagctgttaaggagtgcttggtgcgaagcagggaccctgagttcgatccaccggacccacagcgcgccttcacgaatctccgtgcacatcagatggccagaaaatcagaagttgccccaaaataaaactgttggaagtttttttagcgaaaccgttccaaaaggacagggagagactttagacaaaggcatgcacaagtgtacaacgccaaccaacaaataagacggctcatcgcaccttttagtaatgtgaatgacagaatgagagaagaaaggtagataagagagacgaggagaaggagactggccctatagatggacaggttcaggcaaccaagcattagagcattgggggaatccccccgtatctattaacaaataatttcagtctgctaaaatgagagaaaaacgggcacctaaacattatgctgtactgtgtttttgcaaacttgcaacagctgggatacgtaccaatgttcagatgccaagtattcttgccatggtcatgcagctgtgtttcttgcagtgcttttcgcgcagatgaaacttctaccagtttatgcaatttaaaatcgcatatttgcatggctgcagttccagatcaacaaacatgttagaactaaaacaaaaaggagataagaactatgaataatcaaagggataccagaaagcagcctgcacctttcccaatgttatgttccgaaagatacacaatattactgaaggtaggggtgctaatgggtggaaatccaatccattactgccccaacccacttctgtaacaagcatccttccaattcaacccagaccacttctccttcttcaagccccaaaccaatccaacccataaaaagttttgaaccaaacgagtccaacccattctagttaagtgggttcaaccaattctaaatccatggactgaaaccgcagtgtccaatccttggttcaactctcttcacgcacgtacatacatatacatgcatgcgcatatacatgcgtgtatactaccaatatacacatgttccatgcatggatgcatatatccactttagtatcacagaaactttagtatcacagaagctgtggttgcagcgcccagccgaccaccggcgccgccacagagaactccggccacatgggagcacctcctccggccagtggcggagccagaaattatacaagactaggcctaaggtagggctcgactaatggagtattagttttatgaaaaaattacatggtgaatcaacaaaatttaagcaagtttttggaggcaggccgccctaggcctgcctccgcccctacctccggccgccagcttccatgtctccacatttttgctgctgtctccacagagcagaggtgacgacgtcgtcatcgttagtgccaatgatccgctgccccatctggggctaaggccatggaggccgacagctaccagccacctcgtctgcagcgccgctggtgacatggtggcccagaccaggcaggccaaggttgaggttgaaacccatgccaacgcacccctccagcagcggtgccgcaccgagcacgaacagcgagtcagagcagctggcccacatgctgggcagaggtcgccggcggcggcggcaggatgatgatgatgagccggtggtgatctcgccgccatgctcctgccagcggttgcaacgagtagtgacacagaagggtgtgggaggcagagaggaaggtggcaagccaccggcggcgtcaagcgaagtggtggtggtgccgtggctgtcaatgtcataggaagacgaatgtgatttggggacaatccagtggaagcccatgggctgaatccactttctacccaaactttcctaaccaaaaccaatccaatccaaaccgttttacatctccatccaacccaccccagcccattagctgcatcaatccatttcaacccatccaaagccaacccacactgaaatccaatccattaaatccattaggatccaatccatgagcaggcctaactgaaggcatcaaagttggcaaagttgatgatgtagtagcccctttttccctgaaacataacagaaatgcatgtaacttcactattacaatgccattattccagtgggtgacagtgtctcatcaattcagactagctatctagtttagtttgctacttgcaaaagagctcctgagtatgacttttttttgagagagagagaagctcccgagtatgactttactcacactggtgttcgggcacgagctccagttaggcagtg

SEQ ID NO: 18302 - DNA, 5119 bp, Oryza sativa
tgaaagactgcataagaaaccaaattatcagacacatcatcaggattcaggagaaagaaaaatcaggacatgaataccagttgtacttctcgcacaacattttgggggaaaagaagcatgtgaaactcaaattccaaggtagcatcaaacctgcaattttgtggtaccccccatgacaatgccccaaatctttttaagcttggtggcatagacatataattcctccagtcttccattatgactcttagatcatgaagtttgctctgtaatccaatgcaacagtttgcatgcatagtgcaaaccttgtttaaatctctgctgggttcacaaatgccaccaaagtatgtagtgcttaggaacttaattttcagtccaatatctgtaatgtaaggatcatgctttataaaattaaatacatcctgatcatgatagccaggatatctcagtcgcgaagaataccaaaacttgtagaattctatactttgattgtttgacctcacatagttaaatcccccgtttgctatgttccccaaatcagttgcattgcctacatagtgatcacatgcaatctgaaaatctccatcaggatagaaatgaggaaaaggattgcggaaccacgtgatgtctgcatcctgaaatgcagataaaaaatatgtcaggtgtgactaataagaaactctatttcagcttcacatctgctaatttttcaggaaaatatacagccctatgtgcgtataaaagctgattttcaatatagataggacacactcaaaatgcaattgactttaccgagaaaatgaagctgtaacctttttcaagaactagccgcaagaaatccagccttttccacatcatgtccagataaccagcagtcagaaacctcttctcttgagaaaaatccacattctcggttgcaagagcaaagcagtatgcgtggatcttcatacaccttttgtaagccttccaatcaaatgttattatcacaagatgtctcaaaagtgagctagtcctaacaccacggcgaaaactgtcgataaaaagatcaatgaccgagcctgaagaagcccatgcagcattcagtgttgtcaatataatggtcttattatccatggaggcctcctgcagaacttgctcaagtttgaggtcgtcactgtcctaaaagaaaatgcaataagccaataatcaaaatgcaggtctattagctctacttgatctgatgatctctcgaattcaatgacatatcagacagcagtgaaattggaagaaattgcatccgcaaaggaaagcagcaatatactatggcttattgttcacgaatctattagttttcagattttaatgggagaacaaattattggatgctatgtatgataagcattcattgcagaattgatatgacgaacagcatgaaattttgacccgtgaaacaaatataaggaatcttgacccgtaaatcacaatgacggtcatttgattattgttcattactgcaatgcgtatctgtaagtcatagtcgattgaatcagttaatggagtgtcaaacaggatcgatgactaaaaataacctcaaaagcgaaatgagtagaagtgaggtataaaccacgcgattcactaacaacggcacgcagaaaacctatatatatatatatgctaagcacagcaattcgcacctcagataactagaaccgctacagaaaaactcagggggacaaaattaaacagcagaaacgacggggaggaggaggtggaagcaaagcgcaccagatcgtcggccgcagcgggatcgacgtcgccgtcctcctcggggaccacaacagcagggggcggctggccccgctcccaccacggcccgcgatcccatcccacctgcaccggttggaccgcgtccaacaccgcggcgcggtacagcacggcacagggcagcgccacggccgccgcgagcaggagcgccgccgcggctttccggagagccggcgcggacagcggcagcgacggcttcgagtgcccagggaagtgacggagggaggtggcggacgtccgtgccacggtctggttcggcaacggcctcgccattgcgagagcggcggcggcggcggcggcggatgaccacgacaccgacgcggacacgcggcgcggcgggggacggggaggggaaagtgcaaagcggcagcgtaacggtcggtgaaggcgtaaactcgtggtttccgtaacgcagcgttaaagcggataccgcctacgggagagagagagaggggatagccgctcgcacgtgaggcggccgcacacgcgggctgccagatgggccaccgcatgcgaggtgtcactcgcgcggtgcaccgctgcaccatcaccgccttccagtctccatgaccgatcgggcccactcttggtcgctctacctggccccacatgtcatccactcgtgctacgcagcagttgagcaatcggtgattaaaaaaaaattccacacccaaaccctagccccgcaccgatccctctccctctcccgccgccaccgcctccgcctccgcctcccctcgcgccgtcgccgtcgccaagagccgccacttccgcttccgcctctgcctcgtccaagtccaagccaactacctaaacctaaaccctattcttcttctttcgcctccgccgcgatgtcgtcggagcctccacccgatgccgccgccgccgccgcctcctccgcgggggatctcgcggccgatctctcctccgccaccatcagcaagaagcagctcaagaaggatgcgaggaaggcggagaaggccgagaaggcgtcgcagcgccagcagcagcagcagccgcaggccgacgccgacgaccccttcgcggccaactacggcgacgtccccgtcgaggagatccagtccaagaccatctccggccgcgtgtggaccgagatcggcggcctcgacgaggccgccgccggccgctccgtcctcatccgcggcgccgcgcaggcgatccggcccgtcagcaagaagatggccttcgttgtgctgcgcgagagcatgagcaccgtccagtgcgtgctcgtcgccagcgccgacgcaggggtcagcacccagatggtgcgcttcgccacctccctcagcaaggaatcaatcgtcgacgtcgagggcgtcgtctccctccccaaggagcccctcaaggccaccacgcagcaggtctgctctctccaccattatgttgggtcaatatgatcatcaattgcatttgcatcaacccttggccgcagttgattagaatatgcattcggatagccctcttgtgatagctctagaatgctgaatatttcatgttagatgatggttctgcaatcgattggaattcacattgtgatagtcctcttatgatacctcttggaggctgaatattcatgtatggtggtttttgttggactttttgtatccatcttaatttaccgtcacaattagctcgatttaatcccgcaacataacttattatacggtgtgcacatttaaaactgtgctttgtttcagttagtactagctaatgaagtgtcttttgtttttgctggcaggtggagattcaggtgaggaagatctattgcatcaatagggcgatccccacccttccaatcaaccttgaggatgcctcacggagtgaggctgaaattgaaaaggctgaacaagtatgtatatgtgcaacttgcttgtacatccacaatgtatatttacaggatgcctataaatattataatcattgtgagacttaagaaattaaccactgctgccgtttcaggctggagagaagctagttcgtgtgggccaagatactcgcttgaactatagagctattgatctccggacacctgcaaatcaagcaatattcagaattcaatgtcaagttgagaacgtgagtatttatttatttatttttactgttatcatttttgtattagtggattgtattgtgccaacgatgctatgtgatctatagctcagttaacacattaaattttccattgaataaaaactactctggcaaatgttcatgctttcagcttagtcaatcttgcagtaataaacatttgcctcttgggaactaagctcaaactttgcacaagttattgctgtttggagatatactgatttggtgaccccaagatgttcccaataatctgtgccttgcaacttatctaattgcacttgtcaagggttagattcaatatgtttgtcttgagtgaaggccatgcgtgtagtatatattcatgtccaagccttatgtaggctaattcttaattcagtggaggttaaacaacgagcttctattatgttttctatcgcgtatgagcgtgttatattcattatggaaattaaatcgttgtcatgtattttgcagaaattcagggaatattttctgtcgaaaaattttgttgggattcacagcccaaagctaattgctggatccagcgaaggtggtgcagctgtattcaagctacagtacaatggacagccagcatgtttagcacagtctcctcagttgtataagcagatggctatttgtggtgggtttgaacgtgtatttgaggttggacctgtttttagagctgagaattcaaacactcacaggcatctgtgtgagtttgttggccttgatgctgagatggagattaaggaacattattttgaggtaaggaaaattggatgaaagatgctttgtattagtataagcaaagtgatgctgactaagtgctgatttctcaacacaggtttgcgacataatagatggtttgtttgtagcaatatttaaacacttgaatgaaaattgcaagaaagaactagagacaataaacaggcaatatccatttgaacctctgaaggtgaacaagttcttgcctctttttgttccccttttataatattatctaactcatattttgatactatattagctaactcatattatgctaattcatacagtatttagagaaaactttgaagctcacgtatgaagaaggaattcaaatgctgaaggtaaatatcttgtttcagtcatcatctctatgttacctcttatttggtatgggtgaatttctgaacatatgtctgatctattgaatgaaccagggctgcaggaa

SEQ ID NO: 18303 - DNA, 731 bp, Oryza sativa
ttgacattttcagtcatagaatcttaccaaatagatagatttgttggacattttgacagatgttcatggactaagcctagtaagctacctacaatggataccaaagaatcttgtctggtaatttggtttgttaacattgaccaattcatgacattaaacggaaattatttttcaaaaaaaaaaaaagaacagtgatgaatcttgatcaatcaaatctaaagaatgggactggggagagattcaaccccacagtatttttttttagtacgagggaggaagtgagcacaccaaccgtgttcgcagctcactcaaatttgatataatgaaatcctgtttttgctaaatatctagtatgttagaaacatgttattggcaactttgaagtagaacaggtgtacaacttacagatatactgggttatctgggtcgtcttttttagtaaaaccagatttaattgttgaactaattttttgcttaggtgttggcctaaaatgctttcacagaattatatccatagcgattaacatcgtggtttgtcctggcaggaagctggaacagaaatcgaacccatgggtgacctcaacactgaagctgagaaaaaactaggccggcttgttaaggagaagtatgcaaattcagcctgtagttacttattcgcttcttttcaaaagaaaatgtggtttgacaacttgctacattgtctgtaggtatggaacagaatttttcatcct

SEQ ID NO: 18304 - DNA, 7234 bp, Oryza sativa
  unsure (1)..(7234): unsure at all n locations
tttggaatagggctcaacgttggcgttgtgatttcgttgatgattccgctattcgtaacaatggcgaatccagagcagaaatgaccctatgtcagaaacatatcacatactcgtatgcctatatttccaaaagataagggattatggaaggatgacatattcaagtcccaaaatacaaggtgtggtttgactcgtggtcttcaacatccaacttttgattgtcattttctgtcatggtaccaccttcatcctaatttgacattctctaagtagaaggcaccaataccaagaaaagtgtgaatgacttatattttaaatattggatgtcattgcaccattagaaattaatcttgttggttgcatgtaacacattcaatgatgcacattactcacattactctttgtacaaataaacaaaatgacacttgtttaatgatgatcattttggaaagaccccagaaaccttatgggatgatcaaagtgggatggagggatcatattattatccatattgaaaccaacttcacatgtaaaagaacatcaaaatatgaatccaacaagaccgtatttatatcagtaaacctacacattatatattattagactagtggttagaaaaatttataaaattcaaatcttatacgtgcgtaccttacagttcgagatgtcgaggtggagggagtaactatcttaggtcattattacacaagatgtaatgaagtcacttgtttatattgattcctagataatcatcataatctataccacttttttttcaaaaaaaaaaaagtaatggtggtagcagtgaccaccacgccatcaataacatgtgatttctcatatatacatcttaaagttttctaaaccattttaaaagaaggtaataatgaaaccatcttaaaagaaggtaataatggtgacagtaaatctgttatcaccgtcccatcaataacatgtgataacatgtggtttctcatatgtactccttgaagttaaataaagaaatgagtaataggagtaggttttgttttaactagagagagaagtgggtagctacatcaaaatttgaacggtaggatttgattttaggatgaatttaaggttttttttcaatctcttttcataattattaagataagtaaaagaattcataattttattattaaaaatcaaagaacaaaattattgtatatcgactaatatataatgatgtagccatatttattttctccacgtgaacatgtaatgccatatgattctcttttaatcccgtaacagtgtaaaagcattctgctaggcaagttttaatatagctaatgtataatatttaatcattgtcacaaatgtagcaacctacgacatgtaaaatataaccgaaactgtctaaactgtcactattattatttgatctattattatctgatgagtctacaaacaatctatcccgagaagataaataaatcttcatccttacccttaatttccttaaatctcaagtgcatgtgctacctacgtatcaaaatatatgatgttatatgagatgtacaaagtatgtatgtgcttttttttttagataatgatgtatgtgcttctttaaaaggaagtaatagtaataataagtgatgaatctacaaccactcctaccaccaactccctacctttttagaaagtaaaatgacacgtaggtctagacgatccacgtgttaaccagccccaccatcattttctacatacataatctcttatttttttatacatttgttattgacatgtaggcagtagcatgtggcctgtatgaggcgggggaggggggnggngangnggacgggnnnnnnngnnnacatgccgcncngngngacccnggggcctacatgtcaataataaatgtataaaagaataagagattatgtgtgtagaaaatgatggtaataacggcttaatgattatttatttaattaatgggataagtacattttactctccttaactcttcgttttgtctaaaatgcaccctcgatcttcaaaatcgggtatttaacacacttaaacttttaataccgttcacttcaccccccccccctcatacagggccacatgtcactgcctacacctcttcttctacctccatctcctctcccctttctcttctctctctatatatatccttcttcttgacagccaaacctccatgcgctagctgctgctgcgcctctctctctatatccttcttcttggacggccaaacctccatgcgctagtagcgcctctcctcagtcaccaccgacctcggtcactggttattcctcgccgacccccactactatagctcgtcggtgaccaccctgagctcgccctgtgtgttgcagctcacttcccagatatcgacgaggagagcggcgtcgcggtagacgcactgtagtggtagcccccttgagctcgacgaggagagcggcaacggcagcctccccgagttcactgaactggactaagagagcatagggcaactcaggctctccagcggcatcggcgagctcaccccaagtccccatgcacgtggatctggcaagctctggccctcttgcgtggttgatgcctcaggaccccaaatccacctcaaggaggcaagtcgatttgtcgtcgcccggatctacgtggatctaccgtcactccatcgtccttgtcagtggcgagagagcggagggagaaaggagaggggtgatgcgacgacaaatggggacggggacagatcgagcagctcactagtaaatcggtttccccatcaagttagttcgtcaccgactaccgcggcgtcgccaaccgtcaagtagatctcaagctctgtctccctctccgacgatctctaccccatccattattgagcggcaccacaaaggtcgtcgaggtggtggtgcccgatggatgagagaagaagtagaaaggagagggtggaagatgggtgtcccctacatgcccaaccttttttttatgtgtcaattggaccaccacgttagttgcatataggcaaagccagcatggtttgaaaaaaaaggttatttattggtattgatagttaggaggtgtaatatacccagttttatagtttgggggtgtgatttaaacaaagacaagagttgaggagggtgtgatttatcggcagtgtcatgttttttcggtgtcctctaaccaattacacaggttttgatgtactgtagtaaattttgtctttaaacaaatatatgagttgagaagggtaaaatggacttatcctttaattaaaatttgagtaaatttcacaaaacaacaggtattctgatcaaactatcgcaaaactatatatttaaggcgttatatcacaactacagatttaataccatatttatcacaaaactacatatttaaggttaagtatcacaaaactgtatatttaaatctttttttacggggaactgcatatttaaaattgaagttatcacaaaactatatcttttagagtttaaacccctagcaccattattatgctagagctataaacattattgttttatgaccaaattggttctaaacatatagttttgtgataatttagttaccaaacatacagttttgtgacaattcatcttaaacgtattctgcgataaatttagtgttaaatctgtagttttgtaatagtttagtatagtacatgtagctcttaaaattttgttgcaatcgcacgtgcagtaggctagtaccagcaaagcaatacggtgcgcatcacagcacagcacagggcaagggaccgcagaggcgcaaaccgtttgcttctaactaccgcggggccaacgaacttttcctctccttcccgcatcctctccacctctcgtcctccccctcccctccgctcatcgtgccctgctccgctgagcacgccgcagctccggatctgtggagccggggatcaggcaggcggaagcgaggtcgtgtcttggcacttctgtggctggttctttcgtagctctagagaattttggtggatagagcgcctcgatcggagaattcgggggggacgagatggatggtctgcctgcggagctgtgcatcaagatcttccacctcctggatcaccaatctctcgcctctgctccccaaggtgccctttttttgtctgctctttttactgccttgtttctcacgattcttagtgcatcattcttgccactgtcgcattcagacgtaagcgctagcaaattgcatcatggtgcctcttcttatcttatgctaatggttcgcagtttaacttaaatcatggccttaacaagtgctgttgcaaaattcagtgtgcaggaagtggaacacgttgacctccgacgacgagctgtggcgcaggctgttcaaggacaggtggggagcggatgctgcagcgttctacgcgccagagggctccaggtcatggaaggacgtcttcattgtgcaggatcgatgcgaccgatatgggctgtaagttgccatcgaattcactcgcctatcatcccgctcgagctgtacttcttatcttggcatgcctactgtcacggtgtcccctgatattcagacgtggcacacattctgtagtacactgcaacaatgtcactctgaagtactcctatatgaactctgaatactgtaagttacgcctcattgatctttccaggggtgtcaggattatcagagaaggaagcgattactacctgatttaccagggtgagatccagaggtacttggggtcgagacagcatgtgagctgcgatagcaaggacgctcctgcgcagagtagcgaggacgagcagcggcagatatccgatcggatcttgttcttccttggagacctggaggctgcatgcgcagatgccaaacgtgtgaaggtgcgacgaccgtgatatccaggaacagcgctgtatgacattgtagttgttatttttgcacatatttcgtgcacatatgttgtatgtaaaatcttcaatccattatccgtagcgtttcacattcatcttatgtatttcctcattttaaaagtaaaaagtttgtaaatctgcgctaatcgccttttacttttaggcttttagcaaagcacgtgtagcatcatctggtaatttttccgccgtaagtaaatgtaatagtcatttagctgcaaatgcatatatgcttaccacgacaaatggatatgtcccatcatcttttctaatctttataaaatgtaatcataaactcgtcgttcgagattaaaaaggcaactggcctctcctgtcagctaaggatgttttacgcaaggaacatgagtactcaaatgtcaattacgagtcaataataacatgaagttcaactggttaactgtgttactgcagctcatgggtgacagtgcgttactgattgaagcctccgtcgaacgttgagtcaacacttgatagcagctcttgccatttccaacgctccctcatacgtcttattgccgccaatgaagccgctcatatgaacaaagacacatcctggaatgccaatatcgtttgacagttcatcatctctcaagcccctccacttttccggcagaggctttcggctctcaaatctatccggagcaacgccaacagcttgtactctccaacttttgctcctctcatcctgcaattacgttatccaaatcagcatacgcagacatcaatacttttagcatgctactggccaacgctagaaagagagtttattctatgatcagaagttcagaactacaattttaagtgcataaacaagggcccttttccttctttcttagattgaataaaacggtgtttgacgagagtaagacaaaacaaggtggaaatcagcaagaccaccctaagggttaatgacaaaatggaggaaacatggcatagtataaatgattgcacttaaagtaaaatttactttcaaggctgtgaaacgtaaatccaaaagaaaactgagtctctgctagagcttcaagctacatgctacttctcgatttcagcttatgcaactagaactacatcaagatattcatatcataggctgagaaaggcaacactttcacctggtacaacacatacttcgtgaggggatcaatcttcagctcctcttcaagctcaaacagatgaagtttccactgcaatgataataagagattctcaaattacatgcttggaatgattcaatatgttagtcaattcagcagggtattcctgaaaaaagatcttactgggcagaatctatccaaaaccataatttcttcacttggatcaacctttcctcttgacaacaaacactccaagacaatagatctcgcaggtaaccatgacttaacatgaaagcgaacactctggaagtgaaggtgcaaaatattatcatatacaaagagatgaatggcgacacactaaaaacaaagttctcatgcagtaaactaacgtatcacatacagagactattatacctccataaattcacttccagcaagcatcattgcctgttgaaatgcagcattttccttctcaggtgactggtctggatcggtccagtctggattaagacgcccaacgcgtgaagacaagtgtgtgttgttcacatactttgggggttggtctgtgtcatattgattgattccgttgtcgactgcatcaagcgcctgtcacatgacaaaagttattgtttctctgggatcatgcagaaatattggggtagatgcataaacacataaattaataacagtgtataaaagatgtcttaagaaaaaatgatgtgaattgatgctttatagattgaagctttctactccttagtataacggttaaacttaaacaaaaaaaattacttgcattcaagtatatctgatgcctctacacccttctctgctaactttataattggcaccaaacgcagactggatagtaatcatattttgccacatacagtgcatgcagcctatcaagctaattcaaaagtagatcgtgaaaagcccatcaaggtaatgcaaaagtacggatgaaacattgaagcattaaccttgtagtaggcagtcgctaagctatgatatttgttagttggttccatgctcctaagataaaacaaaggatctaatatgtgcctagcaaatatttcttgctgtatgtctgctagtggatgtataatggagctgcaatttatcaactattctattccccttaagggcttgttcggataatcccaccaattaacccacgaacaaggggat

SEQ ID NO: 18305 - DNA, 13583 bp, Oryza sativa
tcaatccccttgttggtggcattaaccgaacaagccatcatggggattaaacgaacaaggcctaaagggtgctcactactgctattcaaataatgccgatgcacagatttatatcaccaagacattaacacagtaagcatactcaagtactcaatggtgatatctggcacgtcaacacttcttaggtcaaaaaaagacagagtgatgcagacgtccaaataaatcaggcgatttcagtgtatagttatagactgaacacaacaaagcacacccacaaggcaaacatttacctaaattccagccaacctttgattctctccaaaaaaagagttggcaaaagtggcaaaacaaacagaaatggaagtttaaaagaagagatcttactcaagattcaacataatcatttagtgtatcaaaagcacgacagtaaacattcaaaggttgattatctgtgcagcttcatacctcaacaaagcttttatatattgcaagatacaaccgatgaacatcttcatggtcttcactaacttcaagctcctttgcaattatctccttaccaaagtgctgtaacatcaagtcaagaatcagtggtaaacatctgaactatagtcatggtcctcaaatggcaacttgtaaatttcaatggtctaatacatcatgctggacaaccaaggaggaacttggtgtcaaataattaagaagaatccatgagcacatcaaggatcgaacgcaggaggatcacaaaaggactgcaatataccacactagcaagtgcatctcggtctaatacatcacaaaaggacatcatgatcttaaatccactaataaatggcccatcaatctgtctagcgtggtaatgcagttaaagcctcttatgtagcagtttcaaggttctacctaacaatgtagagaactttgttcatcgtcgtgtttgctaacaagttgtcaggaaaaaagctcaggtttcagaatgtgaattatccatgggaagtaccttgtaaacaagcccggcactgctaagttttgtgttaaagccatgtccaaagacctcattaaagcccttctggtgatgatcgtagcgatgccggctgggatcatagacaccaccaacatcaagcacagcatccagagtatcgaggatctacaatgatgcccaacaagaaaaagggaaatacaggtaagttaaagatctaagaatctaagagcacattacaccaaatgagaaggtttatgattattgtatcatatacaactacaagcagcgatttttacataaattacacaacaatctgtactgtactaattgttgcacagacgctagtacaatgggaatcattctgtcatggataagagtaaaatcatcagcacctaactaagacacacatctagcacagatgcaagcgggacatttaactatttgctacttttaagatgtggtgtgtaacaatttgccactcataatctatgatatatgggccatcatgtgtctatgacatgtgtgtccagtggcaaattgttaaatgccacatctaaaagcagcatgtacaattcaggacaccagattatacgtaattaggagaaaaacacaactcagttaagtttaacagagagttgcattattagtatatacagaatctaattgaaacacaacatgtctacaaattgtaggaactgccgcgtacagacccgcaacgcaacccctagagacagacaaacttcacagaaccaaagtcattttacaaccccccccccccccaaccaccccccacccaaaaaaaacagaaaaaaaacaaaaaaaaaaccaaaaaaatgtaaggcaatggtaggttaatcgagccagtgagaaggcaagagacctgggggtcgcgggtgcggacgacgtcggcgccggcgaactgggaggtgaggcggatgaggtagcacccgagcgcctcgtcgcagtggaagctgccgttgtgggtccccacgcgcttgccgctccccgcgccgttcgcggagcggccgtcgcccgagacggacgagtagaccctcaagcgcttgggcgaggcggcggcggccatggggagagggtttagggtttgggatcgcacgcggggaatgaacgtgacggctcgctgcgacagcctccaggcggcgagcatactacaagtcgcgtgcggtgcgggcgatgggggatgaggtggtgactttcgctagatgttgggtttttgaggtggggtttggttggccgttcaaggccgccgaactgcaggaacaaggcccgatgcttgcgtgagaggtttgagttgttgccttgttgggctccctcttcgcatccaagggccgggacgggatttgtccccaacttacgggcatataaatatgtatggttggccggccatataaatgatcacttccaataaataatttgttctctttctaagtcatgtaaaatgagtgtatgttcgtgtcttttgtccataaatactcttactttgagttagattaaacgtgtatgtttaagttgggaaattggaggcaaacaaaatagatatagaaatcaattcccactcctttccatacaatggttaaaaactcctatcttattccgtccagcaaatggcgtacgtttagtcccatcacccctccggctgcttatcatcttccacttccaagatttcaaacaaaaaaatttccatccgggctaggataccacatgggcgattgacacatctgccaccttctcccgtcgaatcaagagccctttagtcccatcacccctccagctgctcatcatcttccactttcaagatttcaaaccaaaaagttctccatccgagccgggagactagctggtcaagggccgggagaccagctgggcgcttcaattgcagtgagaaggagagccatccccatccatccctctgcgcgcggattcccatccatccatctgctcgtgcggatctagaatttccgagaggaagaggcatggtgagtttgcaggccgccgagcggcgtgcggtcccgttcgtggtcttcacgccactcgccaagcccctgactgccgcgctgagcagcaagaggggtgatgggatctcagatgaacttattgcatgcatatatcatatgaccaccactttttacactttttagactgcaccttcgtaatgcatgattatgtatggttggctggccggccacatgaatgatcaataattcattttcttttcaagtcatgcaaaatgcgtgtgtgttcgtgtctttttcataaatactcatattttgagttagattaaacgtgcattaagatattagaggtaaacaaaatagaaatcaattcacatcactttccatcaacacgttgcggggttgtatgagggattggaggcaaacaaaataagtataaaatcaattaattcccatgtttaagttgagtgattggaggcaaacaaaataccacagttttctataggatggttagacacaaccttggcattaaactcgttgcggttgccatagttaaattaaggaaaaagcgtggacatatactctagccgcaatagccgtctatttttaaaaaaaaaaaattatggaagaagtgtgaacatatactctggcgagagcaaaacattttctacaactcttgactaattttgtataatctgcaaaaatgttgtagtttttttttctctaattggtatagtttgccagtgtacacatattttcatcttagaattacttatgtaaactttttaacttaaatcatatgaaacatttatcttaaactacaaaatgaaacatttatcttaaactacaaaaatacaactaagagatttagtttgagtgtttgagggaaggaaaaagaactcatatttagaaaatacacaaaacgaaacgagatgagttattagtgtatgattaattaaacattaattatttttaaacttaaaattttggttaatttgtgttttctaacattttttttaaaaaaatacatcgtttaatagtttgggaagcgtgcgtgcgaagaagaagaaaaatcttctctctttatcaatttatcaaacgcagtatatgttgggaaagcaacggcattaaatagcaattccggatgaacgtatggagcacacaattttgcgagcaaagagccaacgtatttcataatcatctataacggtctataaggaataagtccacttcatatcccccatctttccatcgagtttaactcgtatccttaaaccgcaatactggaatcttaaccctcaaacttacaaagtcaggttaaattagatcatatggtagtatgtgtggccggttttgccgacataataacatcttaataagaaaaagaaaactgaaaataccattaggcccatatgtaagtggttaccttacattcttcctgtgattctcctctcatcttttctcttcccctcctctcctccatgtcggggagcttctcctgtcggtggtgagctttgcgacggtcagggtacttatcctggtggttgcggagggtgccgggtgtgaggtgtctagagaaagaaggagatcgtcatcgtgggtgccggcgtggcgggcctggacacggcggtcgccctgcaccgcctcggcgtggacgtgaccgtgctagagcaggcgcctgcgcccagattacggtcaaacccgttcagagcagtctgtccccaaaatcaagctaatcatggcagccacccacacaaacgccatcctctccacttcccctctcagagcaaggataataacatagccaactgctagctctatactaataccatgtcatttatggcaatcactaatataataggttggctgttaggttagctgtttgtttacatctattgaagatttagatatttaatattaaacatttagatatttaatattcgcatgtgcacctgatctcctcgtatctggttggaagaaagcattttttcctttgtgtgttgcgcttcagccgagtgatagatgaaatgcccgctccatctttttcttcccttctcactcctccacgtcggattttgctgacgggtaacatgctagcgccggctgattaggatctattaaacctgctctcaagtgctgccgcctcccgagtcccgaggtgttccacgtcgccgtcctgctcgtgtttgatctgctgacgacggtcgcgtcccatgtggtttcttctccggattcaatcgtgtccaggagtctaatttggtatttctctcttggtggttttcaattctcctgatacattcaatctatgtgttaggtgcagtagttatctcgttgattgctcaatgtttttctccctatcgtcctagcaattagcagattgatcttggttcctataattcgtcgcttggaggagaggagaagaaaagagaggagaggggaagcagaggaggaaggtgagaggaaaccacttatatgtgggcctcactattttaaaccgaccacacatactgctataagagtattatacctaatttaacccggttttgtaagcttggggttaagatttccgatattgcgctttaaactcgacgggaagatgagcgacgtaaagtagacttattttggtctatattttcacgggcccaagcatcccaggaagtgcctccttgtaaatgggcctggacctgttgaaaagacaagcgggccacgtggactggtacatgtaccttgtgcggccgtttccgagttgaaacaatgtccgccgctacaaccgggttcacttttttatttttcattcgaacgtgcacatcacggagatttgtctattgctccgatattgccgaccatgcaaaagcacaaactaacatgatgaatgatgggtgacccagcgtgaccgaccgctgtgatctcggttgctactaccatccaggctccagcacaccaccttcttttctttagggcccgtttgatacaactacaactctagcttcacctctcctagagttgaagctcatccaaacagtttcagctccaccaaaattaggagtggagctgggtagagctctctcacaaaatgaactactccagacccaactcctagagctaaatttaggagttggagctgtatcaaacaggcccgtagtagagtagctgtagctccggagcagctagtgcgctaccgcgctagctccaatcaccggcctaattaagtgccctcgtcatcaagtttctagtagcatgttcttggcaggtttcacgtcaagtttcgtcctttgtcgtttgatttgtgcttgacgacgttccaagatcacggaaacatcaaacatgcaggcagaggtagttcccatggtcactacgcggcgcctttgattgttttctgatgcctactactaccttgaaaaagcgacgaatttacgtgaactactccgtatatataccgattttacttgaaggttgaagcacgcatcgtagcgtaccgcgtacgttctctcgcatacataaaaaactgtactatttgctcgcgatgcacgtactaagttatgtgaattaaattaaagaggtataccatggtcagaattaactgtgccgtccagccagacgcatcggtactacagcagcaacggacgggtcaatttctggggacgtatgctcggccacctgtcgagcgccatcaaatggcaccaggacaatgcaacaatcgcatcaccggttaattaagctgttcagcacggtacagattgcaacatttcatactccacaagcatagaaaagcaaccagttaacaggacaatcacgagtatcactttaattaaccttgaaaattaaactatagctagaccaacatgcttttcaacgatctgtttaccaacctggggagatttttattatctctaaattcctctcctatctttacacacgggattgatacagcatcaaacacactaacacgccaccaaacaatccaaagggtttaacaaaaacacaaacccgtttttacgtaaaaaagcgactatatttggtggggttttatgaaagaaaaaggtgagagatcttataggcaaatttagcttctacattggcggcgacatcatagggctaggatggacccggcccggacgctgttgccccgctcctgtgggccctccacctccctgcgtgaggagggggccccacgtgtcagcttcccggcgcggcgggctttctccgtcctctccgccgccgcgtccgcctccatctgctcccgcctgcactcctcgctgcagaacggcgtgtcccctctgctcgatcggcacacgaccgcgtgagatgagatcccatggcgtttggcgaagaagaagaagaaacggagagggtgaaaagtagaggggagagatagagtgggcggcacctgtacatgaagatgtcgcggttgccggcgagccgcttccggcagaggaagcacgcgtcaaggaaatgcgtgtgccctcccctccccatctcctcgatcgatcggatcgccgcgcgcagccacaccacaccagcttctccgccgccgccgccgcgcgtcgacctgactactccggcgcgagatccggtggtgccgtagaataggccgtgcggccggctgactcctccggcgagatccggtgcggattcccctcgcttgcggcggaatcgcccgtggtttccctggattctctgatgcgtttctgcgtgttctcagcgtccaaaattcgtgatgcttggtggggaggcaagcgaaggatgcgcgggctattatatagtgggaggggtagagaggtgtcagtaagtgggaccggagtggagatcctgcgggtcccacctgtctgtgggctctggcaggattccgcgtggagaccgacgcgctggtgttgtggcacgggaggtgggccccacggtcgccgacccgctcgtccatctgccgccttccagcttgccccggcagtgctgtggagtgggccctctccggttggtggaaccaacaagtcagtggtagtaggagtagctaggaatggggtttcaggctttgcttctggatgaatcttctgacgatcaccgccggatcaaaacagccttgcagttcagtctaaacaaaataaagaatgcccgctccttgcagcacatgtacacaataaacacggagattttatataaactacagtttctctatttatttttcatgattcttaacaggatcggcaattattaagcccctgtcagatactcagatcttcaagatcttgcggccctggcagctctggaaaaatcttgagaaagtcacacggtacctttggttctttgaacaagaagaagaagggctgtagtttcgccggcgaccagtggtccgcaagtttcagcctggagaggcatgcatgatgcacgggtgtttagcccctctctctcaaacaccccccctattagttgggctactcacatcaacgacctggagcactgcaaggcctgcctcgtggcctggatcctccatgaaatgctgacagaagagctgagtcgtctcgtcccgtaatactggaccagtggaccatcgcatggcgggcgtttcttctgcagaaatcttctgaactttagaattaaggttgccatttctatcttacgggctcgcttattaattaagcgcacgtagtaccggttgcggtgtggctgacgccttacggcgggcaacaactgcacaagccgtttaacttcatcccaaaggaatccatcaagtgtggttggtcatcaggctgagtttgcagtttacaggtggcagtcaaaagaaagcgtaagagcacaaagattgactccgaatattggctgcccttatggattccgtcaaagttcgagccatgcctcagcgcattttcgttacggtaagtcggtaattaacatggttaattagtagcttctcacttgggaaactccttttatcccttaacagaatacctcctcgtttttatatattatttaaataatcataaaaaaatttaacatgataatcaatataacatatactcccaagtaaataagcaaattcacatttaacagtcgcaagtaaaaaaacaaatttcagcacgactagcgtgtcctactcgcactaaaatttattatttttttatttgtacaagatacatttgaatttgtatgttagtggagtaatatatcatatattgatctatcttgttaaaaattttaaaattttttgatgatttttcggatgacatgcataaaacgaaattatatccttgagaggtataaaagagtgatattgtggagagtaaaaatctaattacatcgcacttacttacatgttagagtcgagcaatgacatcttagctaaaagagtgatcttgtggagacgtgtgtgtcttagagcaggtacaatagcaggctattagccaactataaacatattttaatgagataaatgatgagagagaagagcagcgggctacagatctgtagccataagtaactattgtatgaattggctattagattagctatagatgaattggagctagtagtgggctgtactattagacttgctcttaggaaaccttggggagtcttggcttaaaaaataagctgatgtggagctatcacctaggaagttgcattatgtgagttgtgtcgttgttgtggtgtggttatttttggcgtctttgatgattatatatacactctcgagaaaccacgccacgagaccacttaacattggttttcccttccctctttcagcgcatgctgccaaaacgatgtcgggtgtaaagttgtgatgcctactgccaataggatgcttgtgtaaactaatttgctcatcatctaatatattcacacacaaccattttgcgtgctcgaaaaaaataccactttacaatgtaaatgcccttatgaaaggataaattaaaccgaacggtttgattccacaatccaaaactcttctaaaacacgaatattagggaaaaacctaatatcaaataattagaaggggcaaagtttcgaacccagatcggttaacccaccacattgtggagctagccggaagacccttggacgtctctcaaatccaaagctcttctctgttcgctttggataagttccgttatttttagcttaattatatctccatattatcatcaacctgattatatattcatgccaaacttataataataggatttattgaaaacaaattcttcaacattacttagataacttttttacaagctaattgttagttacaatacataacatctaatttatacctataaacaagtatttatatcaccaaccaacttttatccgcatttcaacttaaaaagagcatgccttaagacatgtaacaggttccaaaggtaatataaatatgcttagttgggtactattgtgcaactagacagccaacagatcgaacatcaacaaaggaaaatgaagacgagatggaatagagagggcgttacaatatacattagaaaagagctcataggcttcttttgacagcccggtctgaaccagtacgaagtaaatagaccaaacacgagagcaggacgcctggacgagcatgctgttctaaccaaacctgtatatatatatatgctcatcagcaagcataatgcacaaaaaaaactcttctataattacttcaccgttttccctaccacaaacgtgggaactcggggtcgtggtggtggttcctctcgatcgatccatggactcttcgaaatgtctagtacacacctgtacttgtatatgtagtatcaccccagttgaacgcgtgtgtgcatgcatgcgtaacatgcatgcgcgcgtgagtctccaatccggcaaagggcgcgcggcttggtgtggtgccgagctgagctctctcttgatctctacctctgcggctgcagctgacgctggggcgcgcgctctgatcggtggtggtgcgccgccgcctgcgccgtgggagagtactgctgcttcttcctgcggtgcctgttcctgtccatctcgatctgctccctcctgcactcctcgctgcagaacggcgtgtcccctctggcgaacgaacgacatggtttagctcgatttcatggtgtgtgtgcagccaggcggtggtatggttgagggatcatcacctgtacatgaagatgtcgccggcgaggcccttgcgacacagggtgcactcgtcgaggaagtggtgcgcctcctccacctccgcgtcctggacgcagaacacggacggggcgccctgcctcgccgcgccgcccctgccaacgttcaccgccttcgcgccgccgctgctgctggtggtggtgcccggccggatggcctgcgcgctgccgccgccggagaagaccgcggcgaagtcggggttgccgaaggcgtggaagtaggacgaggtgaagtccatcgatcgggtcgtcgatcggcgccgccgcgcgcacgtctcgccgcggcacacctacgcagtccggcctgccggatccggatcaggcaggcgagcgagcgaccgagcgacgacggcgatcgacctcggactctcggaggaggggcagaggtcgggcggaggtgagaggccgttgggaggcaggcttaatacttgcagggcaaagagcttaactggctaactgttttaccagctaatctctagcttaattttcttcgtctccaggggaaccactcgataaatgcgtgatgtctaatttggaaaagggaaaatggttacaaaacacagcaaaaaggtgacctgtgttgattccgttgcatgcatgcacctaaagataggttatcactaccgtgtggcacctatttttactgcatccatgaccctggtgacctggccaattaattcgccagagacgacgcatgagtaattgtctgcttgacaggcagcatttctacgatgtatattactccgtacgagattgcatcacgatttggccggtcgatcgccatgcaagtcgaggctacggccaatggaagttcgacatcacaaccattcgtgattccaaggtaccttacagatactctaggattaattaaatagacattcccgtcacgtcgacaagcgctccaagacaacacacaaaattgcccttcatttgtttcgttgtgacgaggttcatgataagctggaagcacgcaaaaacatttttatacggccatgatggcgagcgaggacaggaaaacggtggaatttctctgctgccgcgcgctaaaaaccaattgagccgcgcacctgatggtttcgtgcacgcagcttcctgaaatcaacgtacaacaactacgcagtgccctttcgttctacaggaggtatatatgcatgcgatgctcaccgtgtacacctgaaggctctcacatggtttggcacttcggttttgagtttggacgtggactgcgttgtcgcgagctagcagaggggacagcggccgtaacatggccagccagcacagcacagcacagcactgcactgcaccgcacagcagctagcgcaccacggcgatcgagttggtgccaaccgtgtgcgacgcgacacgtacgtgcgaacgcgcgcgtgctcgtgctgagctcggtctcggtctcgacggatcggtcgatctcacgtgtgcgccctgaacaaccagcagccgcagcctgcataccctgccttgcctttgcgcccaagtgggttcgtgctgggcttcaggcacaggggcgcgggcaataatttggcgtgcttagatgtcgtaacgtgtcaagaatctcagctcgcacgggaagagggctatcaagtgcacccttgcgttattgaatttggcctaggttgcctaaaaacgattcttttctctcttggagcgtgcactgtgagcacatgcatggttgcaacttgcatataccaaggcccagcaatgaaagattatctctctattatatactaaaagtccataaaacttcctacaaacattctcaagccgccacgtgggagtcctataaacaatcttaaaacgtcacgtgtcactttaataaacaactggacccactatttttaattagtattagaaaattgttttttcacctccctctcctatccccacgggctcacatccaagcagcccccgcacgtccatacgaacgtacaaacgtacgtaacgaaactacctacacactactcattggaaaaacaaataaaaaactattcattgaaaaaaaaaatgaaaaagaacatatatatgtatgcacatctgcacccacgcgcggttggaaaaggagcgatcaatccttacccctttattttcttcggttgttcactatctaaaattttataaaatatgtgatgtatcttatctataaaaaatattgcatccatattacctatatattttaattacaaaaagttatcatgtggacatatagtcttaataactatatatgtgtgttttaataactgacaactaagtaatctcctaagccgccaagtacattgttgaccaattaaatatggttgatcaattattttatactattcatttatcttagcaataaattatttatgtatgtgcatacgtattgtttttattttagataccttgatgatcataattataggccattaaacttcctataaatgcttctagacttctagcccgttacgtggcaccctataaacactttcgagt

SEQ ID NO: 18306 - DNA, 8980 bp, Oryza sativa
  unsure (1)..(8980): unsure at all n locations
tgcacaaacacacggctttatataaaagtccattaaacttcttgcaaacacttctaatccatcacgtggcatcctatatatactcctaagccatcatatgacgctctaataaattaaaaaatcatataattttgataaaaggaaacacatctcatcattgattttcacttgaattgttgatatgttattttaggctattggatttatctcatcaaaagagaacaacaggacctcccccgttaggttagattgatctaattacccagagcctcaaaattaaagaaaaaaaattctatgatgcacctcctgcggttgcaggagatcgccatcaccgtgtcaagtttctctgatgagctacaactttatatcgtatacaacacaacttcaactttataaacatggatccgtcccattcatattttcatgtgctaaattgttcacctagacaaaccaacaattgatatatactggagcatagtcgtaaaacatgccatagacatataataccacatataagcaacaaacaactaggggtgaattagttttccggcaagttcaagtaaaaccgaatttacgtgtggcgcgatgcatacaaacagaggtttaattaggaggtaaaaatatgtagtataaaccacatatattgcaaacctaaaaactatcacatgatataaaaataaaagtttgagatttatccacatcatcatgagtaaaacttttatttccaatatacctccacaaatgcttgtaggtcatcttacagcaatgcacataataaactaccatgattgtttaaattcctaagtctttccaacaaagaagataaaatagggtagatattgtgggcttcgcattgaatattatgcacaagttgcgtgaacacaccgtgtaaaccaactgacacacacacacacacacacatattatattgggagtaagaaaaagacatttatactcttaagaccgtcagaatttttgttacggataaaatataatgaatttaagggtaacactttacacataagtgtaataaaaaatgcctaatgtacattagctaaaaaaagttataaagagtgattgtctggagtatataaattcctaatgtttaattataaattttagagtaaaaatatttaaatcatgacgacactgatgaaaagtcgacactgcaataataatcacatatgcggagttatttttagctatgaaataatattcgtaggctatgtgaaatctcaggcactcttccccttaattttttttctcccctaaaagaataatctcacgcactctacacaaaacaatgagttgtttcccacaatccaaaatcaatttggactacaatagacttttttgtttggaatatatatatatatattcatatacactaaggcacccattaaaaatgcagcatatagaaaaaaaataccaggtgcatcttagcaacgagatacaataataagttgtaaaatatctagcaaattttactacataccagaaagacctatcaagttctatcaattgttggcaaacaataatatgggcacaagtaccattattttcacatagggattttcaactttttaattgtatgaatagttattttcatcacaactacgcaaatgatttttgtgagcattcttttcacatttggctcaaatgtgcagccttctatgtggtgagtctcttgcctcaaactcatgagtcatctttgaaaatattttttgcaatccttttacacaaaacaattttagtggagtgcttaaaccgcaatgtagcgttgaagcttttacacataaaactattagtggagcgcttaacccgtaagatagtattgaatcgatctactccnttttgttatagaanaacatagctcaatttacatcataatgaattttattctttcaaaatttttatatttctcgtcatacaagtcatatactcatattaaacacaccaagaggtgaagataatgataaatcaattcagtaaattctatcctatcctttaaagtacctccatgggtttctccacaatctgcatgtataagcggctttaaggtggcaatacaaaatcaatacctttcttataataatatgattaaaagttattttttttctaataaattattattttaagattcaggttgactaggtcttttcttcaaaataccgtagggtttcacatattaaaaagaagcgctatacaagatatgtatatttgatcaattaaaaagaggggatagcaggatggttaaaaaaaaacttacgagcaataaaagtttctcgagacttctcaaggaaaaagtaaacaataaaaattcaattaaaatgaaaaatgctttactttaatttcaacttattttgttagaactatttccaaaacaaaataatatacatgcccgcgcgaatgcgcgggctaccttgctagttggtagtaaagcatgatggtttgttttattaactaactccaaagtccgctttagcgcattacctttggcccttttgctctactaaaactaggcggtaaagaaaagaataatcttttgctatatgccaggattccaatgggttgcactccgtacaaatggaaccggaggatcgaatttgttcgatgttactgttcgtgatatatgacctggaaccatatatttttggatgaatgtagtactaatttttagagaagtataaacccatttacattcgtagaatcaaagacttcgtaggttgatgtctcctgaaatgcaggaacaatgaacagggttgttatatatttggttgctactatattttaggctaagatttggcatgccaattttttgttggccacaattttaacaagatctgacaaaaaattgtgcctatgacatatgaacaccaggtaaagttttttcaagccaaatgtgtaatagcaacctaacaatacagtaagctggtcaaacttccttatcaaagatatagcaaaatgtggctactactaaccaaacatccccggaagtgacaaatgtgccaattaagtagattacatgaactagctgctaaccaatatgttacgcggttatttgttatttatattttaaaataaaaaatatttatgttttaatgattttgaaattcgtaattaataacaatcgagttatactcggcctataattttagttgtaacagttctatatttgacaagtctagctaatatttagaataaataaaactagtagattgtattcatattggagtctcaattttcataacatgcatatatatgggtttttacgggatccatgatatttaatgcaaacctaccatgatctatataatcaagtactactagattttttttagttgatataagagtttttatggcgttcacgaaaaaaagtaagagtttttatgatgtgttcgattaatttaggtgtagtagatggatgtattatttggtatcagaataattttatagtggacatgaaggtgggggctacgggtatacggtcttcagtcgaagtgatactgtacgatctactgtatcctaattcttacaggtaactgaaaacttcttggcaacattagagcaccactgattacgttgatgagcacggtactgcagctcagttgcaaatgcaaattctttatgtcaaatactacaacttctcttatttcttccagatcaagaaaaaaaagagttaagcaaaggccgtatatatacagcacagcatacaaatgaatacctacaaacacataccagttgcacacacacgctgctgcagtgtgggcaacggaaaaacaaagcctgtagtaattcacaggcacacgagctagctagagctagcgctcgagccgatcttcaataatctccaggacggctgggtagacgcgcagggctgttcgccgccgtcgatcgagctgaacacctatggattatattacgtgtgtacagcaaacaagccgatgccggagacgacatatttttttagataatagaaatggattacatctccggcttctgtcatacacatagccatagccggagacgacacatgccgcgataatatttctaccgggcccagaccgggatgccgtgcgggctctgccgccgctgcggctgctgctctcccctcgcggcggcgggctgcatcttcgccctcttcttcatcatctccgacgcgtcgtcggcgtcgatctggcgctgcctgcactcctcgctgcagaacggggtgtcgcctctgcacgcgcgcacaaagcagaaaaccaccggtcacaaaccagaacgcgcgtgcggcaagctacaacgtacactacaaactccatgcggcgctcacctgtacatgaagatatccttgttcccggcaagcatccgcccgcaaaggaagcaggcgtcgaggtagtggtggtggcgcccgcggagctcgccggcgacgtcgacgtcgcgggacgtcgtgcgccgggggctcggcgacggtgagactgactcgaggttgccaacgggctccaactccaaggtggcggagaagtagaagtaatcctccatggctcggatcggtggcctcttcttaacttgctgctgcttcttaattggttgcaaggggggagacagagacagttgagatctctgggctgaagaggactgtggttatatagaggagaggagtgaccggagtttcagtttgcctcctctgagtctgttctcatctagttttgttagtgtgttctaaaattttggcggacgatgaattacggatgaaatcaattatttaatgacacagatgaaaaaattaaatactagaaaattgagagatatgtttaaaaataatctaaaaagtgctgaagatatatatttttttaaaaaggtgacattcaataggtcgagaagtgcacccacaataatccataacccctgttctgaatggcttatggacaacggattattgccggtatgttttctaagcttttaaacggtaagatcttctttttttttaaaaaaaatcatcagtttcttagtaaacgtttttaatcaacttatcaacttaattaatttacaatatatacagctcattagttttttcttttagataattgttataaactcggtttcattcaccatccatcagactatcactatttttgaaaaaacccttggactaacaatagattgctcttgtcgatcatctctccagcagtttttatatcattgatgctcttcttagctgaacttgttttaaatacatttgatccgtgaacgtgtatcattaccagagtgacgataaaattaaagatagtacagaagaatgataaaaagacaaattattaattacgtccgcggagactttgcattaacgtagaaatggtaaaaatcaatcctgaggtcatgcataacgcatagctgaacattttattatcatattaaaaacaaccacgttcgtatgcatgtggcgttactatgatcttcccttgccaaaagtgaaaattatattgctgcaggaaaacgacaagctaatcgtaaactcattgtcccaattgaagtctttgttaaaagcatggggagtaagatgtaagaatacatccatcctccaacgaaaggttggatcctccaaattaaagaaagcaagacagaaaaaaaattgtggttattaccaggttaggcatctagctggccaagtggcaacaaatctaaagctggctcctttgagtgctatgtggcgaatcaggtggccgagcaagagcaaaaccagggcgcagggtggcaattggcatggtcttctgatgatattataaggagcagctacacctcgtgggctcacgacccctatattctatgcgttcgcccctttccatttctcggcccctttactttgtagcacacggcccgtccaatttgatggatagaatagttttgtttctagaagtcatcacttgctcctggtttttgggtggttttgtgtgttgagcagtgcagcatgcttgcttggaacaccactaacatagttgaattagtatgcaaattacatgtttaacttttgttgcaagtgaaataaactaagatattttagtcaaacagataggtggtcagccatggcgtaattctgtattggaggtcaaaaaatcctacaccctccgtccaagttcatttctagcatctctcatttatctcaaaataagtttactttttataatcattgaatcagaatatataaaagtagaggataattatattaagagaaaattcatgaaatgccattgacaaacactctaattccagaaatgccattgacaagcgcaacttcctcaaaatgccatcgtacaagcgcttttctccccgaaatgccatcacaaccatagtgctgttaactcctatccgttaagttgtatgaaaagacaatcttacccttgggcaacctttttgctaaaacaacatcattttgtattgtttgctcacagaacattattttgaattgatgcatatttaaattcacagacgtgtattattttgctaccaatcaaattatttcaaaattaaattcacaaattttggcatcaaaattatttcagaaattttgctatcaattatcagggttgtgatatgagcaaaaataggggcatcaattatcagggcaatacacacagaaagtaccaatcatgatcaacatgaattttcacaaaataaagggttcacagtacttagcatcacaacccaatataaagagtacttagcatcacaacccaatataaatggttcacagtacttagcatcacaacccaatacaagagtactttgcatgcttaatacatcttagttcagacaatacatgtgacagtaagaaactcaatcaattattctcctcttgcttctagtccccattgctggactactcttcttgcttctagttctcattgctagactgtcatgtggtacttcattattcttcctccttttggcaggtagagtagtaggttgtactgttggggatggttttctcttgattttcttgtctttgtcctccttcttccccttccccttccccttctccttccccttccccttggcaacaggtgcagcaacatgttgtagtggcacaatggtcatagagctgaaaaaaaaagttatttagcaatcgatttaagttggcattaatcaagtgcaatgggtacagtaaaaaacaaaaatggctaccttgtgaagggatgngcanaaggggctcatnnntattagagctagcaagtccagaaatnncactaattgtcgccactcaacggcactttaaaatcatatattacacattattaagttgctgcagcctaggagcaataaaaggttaacaaagtggaaagtggaagatagaaatttcaccttgataggctagccaagatttgccttgacatagcagtaggatcaatgttttcagtggcaacagtggcagcagaagtagattttggttttgatttccttttcagttntctacaagaaaatgaaaataagcgaagtttgttggcaaaggaaatcaacatgaagatatggatatagaaatcacctttgttttgccactaaagcataggcctctttggcttctggatctgcttctttgcaacttgtccatctatggccataatttttgtagataggacacttttgctgacatttggtacctgcttttatcttgcccttcttattcccctcaaccccacctttgtgccttaaagttttgggcctccctgcagaactcttcaatattggaggataaagaaagaaatcacgtgtattctttggccaatgggaaatgtcagttagagctggaatgcgggctgcatatgtggctttaaatctggccacactatagcattcatcaacataatcatgcacctgcacccccctaatagatgtgatgaagcacaaggcatgagcacaagctttccagacacttgccactctctacatgtacatgtcttctcttcaagatcaactacatgcctcttaccaccttttgtgaaaatgcaataataagattatgtccatcaacattaataatgggaattgcaagtataaaaattcaatacgacatacaacataacattacctgggtctttatcagtaacctcggcaatgaaatcatcacttctatctaggtcaaagtttagtcctctacttttctcaagaagctccttcatgacacaaggtagaatgatattaccttccaatttggctaccaccttcttcctcacacgaaatttatccatcaccttttttctaatcttatcaaccaattcgtatggcataagacctttatgctttctgatccaattgttgaaccactccgctaaattgttggtgatgtaatcaaccttagagtgcgtggagaactcgcttcgcatccataacctacaaaataagcaaagacaaaatattacattcaacttcagttcacgtactgaaaaaacaagtattcgactaaaaaaagataccttttgtggtgggttttcaagtatgctatagcttcaggctttacttcacctattgaagccatgtgttcatcgaagtctataggagtccatgcatatgctgctggccataaatgttcctcaaaaactttgccatggaacttgagcttgaaattggacacaaggtgtcgcatgcattccctatgctctgcataaccaaatacctctttaatagcatagtcaatgccttttcatgcatcgaacaaattgatagtctagctggttcaccaatagctcatgcagtttctccatgaaccaaagccatgtctcactagtctccgagtcaataataccataggccactgggtacagccaattgtgtccatcaatagcacatgcagttgctagctgacctctatactttcctgtcaagtgtgtactgtcaattgctaagtatggcctacaacctcctaaaaaaccttgaatgcaagcgtgcagtgccacaaatagccttgtgaatctcttcttgtccttgaatgtcatatggtcaatgg

SEQ ID NO: 18307 - DNA, 99 bp, Oryza sativa
tgaagaggcatggagagtgtgcacgccgccaagcggtgtgcggtccctatcgggctttgactccactcgcccaacccatgactgccgctctgaacacca

SEQ ID NO: 18308 - DNA, 19959 bp, Oryza sativa
  unsure (1)..(19959): unsure at all n locations
ccgcattcgccaatcgaggttgccacactgtgtgaaaggggccaacgggtgcggctctctttgtatattaacacaagctgccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatttgagaagctgcatcttgaacttgcagttgtctctattgacccatttgctgtgtgctaataataagtcgttttttttccgcagatggagaaagacaaaactgaagataaaaaacgattagccgagaaagatgtagtattgttggtgaaggacaaggaagaagatgtaactagattaacaaaggataaagaagccatgggaaaattgttgaaggacaaggaagatataattagattgatgaaggagaaggaagaaatggtttggatgatgagggagaaggaaaacatggttagtttaaataatggcagggttgaagataaacatcaactgacagataaagatgtagctaattcagctaagtacaggaatgaaatcattaagttgatgaaggagaaagaagatagtaatgatacaattatgaaattaaatatagaactggaagctatgaaatcctcatatgaaggaacccgcattctgttagattctaagaagaaagaggtacttcagcttttgatggacaaggagagcattgaatatatagtatcacaacttaagcaagagcttgcaatagaaagaagctcacatcagacacatattcaagaattggagactagggcttttcaggcaaataataatttagacaaaggnataaagnaaatgagcttcatgctagaagactctaaacaagaagtaagagatcttgaggaattgttagaatcaagaagccaaatttggagcaaaaggaaatcaggctgaaccaatttattggtctacaaatacagaatattcaggtattgattggccatatcactttttcccactatatttcttttaagagtttgtgaagtcatcaatttaagcttaaaattgtcccttaccaggatttgaggttgtcttctgtttccatcaggcatgaaatcctacactgccagaaaagatggtctgaagaaatttgtgacctcggtgagaataaatgaaataagttattttagtccacatggaatagacatactgtagttatcattttataactttcatatcatttacaactctgcaggacaaagccttaaggtattgacaaatgctgctgaaaattatcatgctactcttgaagaaaacagaaaattattcaatgaggttcaggagctaaaaggttgcaaagcaaacagtattgctcatttatatgctgatatccttaactatcaacttcttatattatatgcttatttatcaggaaatatcagagtccattgccggataaggccttttcttcctggagaggatcagacatctactacaattgaatatgttggtgataatggtgaactaattttagcaaatcctgcaaaacgaggaaaggaaggacataagttgttcaaattcaacaaagttcttggcccctctgctagtcaaggtaagaataaaagcgacacttaagtgaaatttgttgtgctttagtgttgattatactaattgtccagagaaagtaccgaaattttgcagtgctaacatacagtttatgttcatttgtatattcattttctggctagatgaggtattcaaggaaattcaaccactaattagatcagttcttgatggctataatgtttgtatttttgcgtatggtcaaactggatcagggaaaacatacacaatggtatgatgctctcagcataagaatattgatctaatttatgtcattgagaagtactattgacattattaatgttcttgccatgccatttttacaaatatcttagactggacctgaaaatgcaaccgagaaggaatggggtgtcaactacagagctctgaatgacctattccatatctcacggagtagaagagacaccgtgatgtataaagtagtgttcagatgattgaaatatacaatgaacaaattcatgatcttcttggcaacagtggttcagagaagaaatatccttttggatcacaggctttaaagtgataaataatattatttattgacaattttgcacaagtagtttgtgaattcactggaaagttttatgcacatgaatttccagggcaacacatttccatttcatgcaactgagtttcatacattgtctgcaatacatcactattgtctcggtgacaatgaatgacgtgttgtagatatggatgaaacagaggcaaagtgtagatttatccttaatttctctgttgatgtagtcaacatcaaatcaccaggttttttgatttggttaacaaccccagcacaactgtatccactgcctagctatggactgtcagttgattcagttcgtagaaacgtgaaacatagttggtcaccattttaccacaattaaataaaatctagatatatgtccatcttgtaatgagacacctttaaacctccacaagaaagtgattccttatttttctttaacttgcgcacacttgggattttgaatgccagccaacccaatgggcttgctgttcctgatgcaacaatgcatcctgtcaactcaagttcagatgttattgaactaatgagaacaggacttgagaacagatctgtaggcgcgacagcattgaatgaaagaagcagcaggtctcacaggtaatttttttcgtttcatgtttctgataccatttcttttctgcttctaatcaaatataaatatataagcttattttgagtaatctttcagtgtagttactatgcacattcaaggtgtagatctaaaaaccggagttactttgcgtggtgcgctacatcttgttgatcttgctggaagtgagagggttgatcgctctgctgctacaggagatagactaaaggaagcacaacacatcaacaaatctttgtctgctctcggagatgtcatattttctttgtcacaaaagaatgctcatgtaccgtaccggaacagcaagcttacacaagtcctgcaaaattctttgggtgcttacctttgctaatcgattgtataacattgttttacatatttaagcttacacgagtactgcacaattcatggcgtacttacctttgccaatcaattgtataacattgttttacatattttgtttaacctaaacgttttcatgtgtaggtggcaatgcaaagacgctgatgttcgtgcaggtcaatccagatgtctcatcttatgcagagactttaagtactttgaagtttgctgacagagtgtctggagtggaactaggtgctgcaaaagcaaataaagagggaaaagatatcaaagaattcaaggagcaggtgacaatttgcatttgccttttgctgacagtgttattactctcgtttgaggatggcactaaataaggatttacctgcctctgatatttatatatgttttatacttgttctcatacctgaggtgcagtttacccttattttgtgcaaagagatatggtttacgcaaaattttacatcagcatgagatgaaataacagttattctcatcagatgctattctgagtgttaataaaaggaaaagcaattgcttactctaataaattttcaacctgcagctctcactgctgaaagataaaattgcaaagaaggatgaagaaatcagccgactacaactacagagtcataatactccaagggcgacagctaaacgtgccgattcattgttaaaacattcgtcatcctccccaggcatatcatcactaggaagcaaaatccagcaccgaagaacagcatctggtggaaggataaagatcgttggcagtagagcagggtcggatgttgacaacttctctgacatcagtgacagacattctgaagctggttccatgcaatctgtcgatgatatccagcagtcaagggagattatgggtctctctaagctctccatgagtgagatgggacataattctgttgaccctgagcttccttgctttggctatgatgattcagaggggaggctaagcgacatatcggacagcggtctttccatgggtgcagaaactgattgttctatgagcagtgtggttgagcttacctccttgccagatcaggatagagtctctggcactcagaaagagcaacacatggcaccaagcactccaaaagatcggttgtaagtactttttgttctgcagtaaattgataacaactaactgatgagaagtaatctaccaatcaaactatgtcgggtcaaggggatgaaagtatgtgagaaatctgtatgatcctaaaagaattaatgggagttagatatgttacttatatgacacttaatcttgcctatttcttgtacacttttatgtttctggcactgtagcatcgatattaacatatgtaagcacatgttcttttccaaacaggcataaggtggccactcgagcatcgaggacaactacaccaaaaacaccacaatcgcctaccttgtggcctaaactaagagatccacctcctcctagatctccaagtaagttcacttagcaagccttactttctttctaactgtgaatttcttgaaaagcatgtgccctccagggaaaaaaaagctgcacacataacttaaagcatgttatactgatatactcaagaagagaaatgtaattttaacggatcccactgacaagtaaatttgctgcgaagaataatcataagcagggtttacattatcgatagaaagaatttgaagtacttatcctaacttctaatattcctaccatcaattatttctcaaatgcttagttttgaatcaacaaaaatggtagttgtagattaaacttattaggttttatagacattataatgtaaaattgatggtcgcaatttaaaaagtttaatcaaattgtgtcctaagtttcaaatatttatgactggaggaagtatctaagaaagtctcttaatgggccaaaagccctgtgaagctagggctcaacaagcccaattatgtaatgcatgtgaaagattcctccgtggttaatccccaactccacagcatgcacttacctcctgagctcgaccaagcacttttcctcacctcttcattttttttctcaattttctaataatttttgctatattttcccccatttatagaaccaaaattaagtccaacactaatacctgtagcttttcgctaaatccgacgatttttgttttctaacatgtggttatcgcagcctcgaaatttcaaccatttcactcggtttttggtggatgtttaacggaaccccagaattcaaattcaaattttggtttcaaattttgtccaaaatttatcggtttcccagagtgtccatcagaaatgtaaactctgatcataagcattctaatgatttattagctatacagatgaccaaagtagccagggcccaaaaactagctgctattttgtgagagaaaatgtatggactagcagtacttcaagtgttaattttgcttgataaaatgatcatgtctgatagtacttcaagttcaactagtacagtaagggataataagttcaaaaagttccaagggaattaccacaaatgtaagtgctattgcaaactgttcactaattttctttttgcagtatctacaagcacaggaaaggtcagagtaacacaggcaacatcttcatcaagaaattccagtactcagaaaaggtggacgtaaaagctgtgcatccttgacgaacatcttgcaacattggtataacctttttgtacattacatctagaaaagcatttgttttgttatttaatagatactactcattgattctgcactctggttttctttcacaattgaagaactgcaaaaccagttggaatagattgttccctgtaaatgctcttgtacatatgctatgttcacaatacgataaacatttgatgtgtttattataagcaatgaaaagacggtgagcttaagacatgaggaacttagtatacgaaatactcaaattttttcttgcataaaacttcatgttgattttcccaaagattagtgacatgcccatgcattgcagcgggtcagacccaaatgattggggatgggctgggagggtggataagtcaactactgtagtagaagaatcactccaaatgaaaaaaacaaagaaaaatgaccaactatgtaatttacggcaaaacagatcttctgaacccctaacattagaatttgcaagcaaggaacatacatattaggcctaatttagaatgtgggaagtttttcccatctttgtggtattgagttcattcctgtgaagaacatgcaaagtttctatgaaattcttgcattcgaaaggagaacaggaacttgcagcattttcacatggaaaattcctgcatttgaaacaggaccttataatcatttataagaccctgtggtcactacacttgatttctattgagaatttgttgtgacaaaagtaatccaatggaagaataggccacgaacaaaatttctgacaacaatgctcttataaagtttacatttccaaagctaaaaggtcatatgaaacctcgccacatttggcgatgtatggaatacagaaaacctaccagcatatttacatggcatatatagaccacaaaaatgtgaggataaaagaagatattatctgtggggaaaggacaaaagaagatttggttcaaaaccaaaaaaaagtttccaaccagattttgcctgttgtttcaatgcccctatcgatgttggaagttcaacttcttgatgcaaatggcatacatgaacgcgaaaaacacagcgaagagcacgagcaccggcgcaacaactggcataaatttcctgtgatatccaaaatgatgagtaacatagtagctgattgtctggttggattggccagggactgagatgatttgttctaggtctccatactgtgtcactatgagcccatacactgtccatgccaatgggcaaagccagtagtaccagatccaccatttgggaatcctctgaaataaaacatgaataacaccattactttgatcttccaagaagaataaaaagttcaaagaaacggtttgatccaagaaaactcactggtctcggaatgaagaatcctgagaataggttgaacaaggaatagaacgccgcggcaaagatggctgcaacctcatggtttggtgagattgccaccgtcatcataccatagtaggtgaagtagagaaatgagaagtaggagacgaagaagaaccagaagaacttggctgctgtccactggaagctcatcatggcataaacaatgagggtataatatgcagtttggacgaacacatagggtatctccatgacaacctacaacaaattatcaagagttgagcaactcctggaaacaaattataccttaactgccttagctaccaccataagttacctgagcaatggcatagggcatagcagagtacatcccagcagccctctctcggtagaaaactgttctctcaatcgacacgattggctgcacagtcgcacaattgttgataccgataaacatcactgctgtatacattgctccaatgaccattctaagagaattggcatttcccctgatcataagacaccaaaaacgtcagatactggaacattaagattaaggagtcaaagatgaaaaagagaggaagtatttacatcttggtgccgatcttccaaaagatggtgccgagtagcaaggctgtgaacagagtgaaggaaaatctaacaagattgtaatctgggctgcgccaataggtcagccattgcttccagaggcaggccctaaattgccctatggtggattgagagtattttgtaggaaaatgcagatctgatgttcctggctctggttgacttagctgattcaccaataccttgttttgcctgaaaacacggcccatctattccatgagaattgacacacaacaactaaaaactttaagaagaaagataagagtttaaaagtagaagaaaaaaaaatgtttcgcttacttgtacaggtctgatgtcttatagtactcagcaaagtccatatttaagcgtacttccgcagcaactgaactgacctcaagcatccatgtagctggattgtacttatctttgattttaggcacaccaggaattgcctggtaatattaaatagcagattggttagaaaagtaaatttattctagttattcataacacaccttccacttagcaaaagttaaccaccatctgaaactatctgtacctcgaaatattcaatcattttctgggaattacgacccaattgcccagagtatatcacctgccctcctcttttcagtagtagcagctgcacgagagttcaagctcgagttactatttagttactaaaaggtggaattactatgtaagtaaactattcatagtcacctcatcaaaagcctcaaatatgtcaatgcttggctggtgaattgtgcaaaccactgtccgtccagtgtcaactgtgttcctcactgttctcataacaatggctgctgctcttgcatcaagacctgaagtcggttcatccatgaagatgatcgagggatttgcaacaagctccactgctattgtcaatctcttcctttgctctgttgaaagccctgtgattccaggcaggccaactaacgcatccttcagattgtcgagctccactagttccataacttcatcaacaaattgctggaaacaattgaacttgtgagtttgacaaattgtgacgacaaatcctagtaatcagaaattaaccacccaatattcacaaaaaattaaaacacctgattgacaataatgttttgtgttagcaacaaacaaaagtaaatgacttataatacaccctgatgatgaaaaaagatgcagtgttttgacaaggaaaaagacatgacttacaatcttgatatcatcagtgatttcttgatctcctattttttctggaaggcgcaggaaagcagagtatatcaaagactccctaactgtgacctgaggtgaatggatatcgttttgctcacagtagccagaaattcttgcaaatgtttcttggttcttaggataaccagaaattctcatatctccttcaatgtaaccaccagtctttcttcctgccaaaacatccataagagttgtctttccggctccactgactcccatgagtgctgtcagcactgcaggcctaaatgatccagtaacgtcacgtaacaattggagcctatcatccaccactccttgctgcttcatttcctatgtataaaacattaatctcaatcaaatattacaaattttcgattgaggatacgacagggaacaggacaagatgccaagagaagttaagcataggtaaactcactgcaggcatgtcgacatagtagttcacatcatcaaaagacatggatagaggagtaaatggaagaaccattcctcttcttggaccagcttcattgctaccaatggacatcagtcgtgaaactccattcgatgaactattgctcagacgagcactcaatctcatctccctcatttcttctgaaataattgccttattattcctcagttttaaaaacttccaattttttcagatttaattatgacttgaagagtttcttactgtgatttccaccatttgattttgtgctgccatttcttactgtatgtcttgcatccccattgccttccgcttccttcgcagtttcttcagatatgacagcttgtggtttgcccagagctaacaatcaaagaaccagcaaatcacgtattggtccaataactataatcacataagcatttagattttaattcagatacttacgattcagataaacgagtgacagagtgaaaagcacattgaaaaacatggtgaaacccaggagccctgctgctccaatccagaaccaatttttgtcagtgaagatgttggcaccttccatcagagctattcctagtcttttaggaacgccattgttatcctgtcaagatgcatgcaaacattgtcagaaaacatatttgcaagggattttaaggttcttgaggcggtactacaaggtaagccttttctgttgtaccttgtgatacttcctcaaggactgtaaagaacctctatacgcaaacaagtgaaaaggcagtgctataatgagcttaccagtacaaacttgttcatccaccgaggagagtagaattcattgactgctagagcattatacccgtacatcagtggtgaaacccagtaaccccagatccaccattttgggatgaatgctgttaacagtcaagggcaaagtaatattcaatagagctgcaacatttatgtgcagaaaaaacgtggagtgaaaataattagataagtaaaaaaaaccttttggcagaagaaatcctccaagaacgaaaaatatgagaagggccagggctcctccagtttgagcaatgatcatggatctgcacagaccagcagttgctctgaaaaggccacctgccatctgctggatcaagaacactagcagcaactgcttgaaaaatctgtgcagaaagatgataggtaagtggacagaaaccttgctttcctgaattcatgtttaattctttttctgctttttgtgtacctgtcagcctctggggcaaatcctatagtgtagtatgtaacaatcacccagactatagattcgatgatggaaaatgggattctcagaataacattcggtagagtgaagatccaagcagggtagaagaggaggtcccggtgcttgaagaacactggcaaccttgtgatggtcaaagagagctcagcgaaaccattgaacatgttcacaatcagactgaaaagtagtgctccaatgtacacaaagccatcatctaaattccttgtgtgcatctgggtcctaagaaacactgtcgacgcgacaagggctacaatgatgagcttcaaagttcaccggcagaaggtgtcagtcgattgcattgtgtattttgagaagtggcaagactgaacaggaaactttgctcacctgtatggtcttgaagatgtacacaaatgagttgcgcttaatgaggagccactccttggcaaaggatgccttgaggagctctgttgttgacaccgattgcttcgagaagacaagagcagcctgatggctacgagttttatcaaatgggactgagagatgattctcaagttggagcccaacatggaaccttttaaatctctgtgcaaattctgagactgaaatgtatctgtatggcctatgcttgtcggcccaatactgctcctgatccttctttgatgtcacctgaaaaattggcaaaataaagctgttcaggtaaattcacatattgaagctttcagaaacatagattctaataattagacaactgcatgatgttacctcctgaagaaagtctgcagtacccttacgctctgggcagcggaatccgcatgactcaaagaactcaaggacgtattcgcggggtccctgataaacaatctggccttctgacagtaggataatgtcatcgaatagctcaaaagtctcaggggctggttgtaggagtgacatgaggatggttgcctcgcccaagtgcacgatttgctgaaggcatttgacaatctggaatgtggtggagctgtccaatccagttgatatctcatccatgaatagaacctttgttggaccgacaatcatctcacctgcattccaaatgagcaaatttgttcattgttagcatccttacaattttcggggaaaaaaagggtcaataccttcaatactttatagttcatactgatcatttgttgaattgctagtttttgtgcttttcacttcttaacatatttttacaagaaaaataattgcattctagattttagccatataatgtaattatgcaaaagaaattgtacaccttttcttccagaatatatgacattttggaagggtttggtctctaaaatccatctttgaccgatatcttttgtgtgaaacacttatgagaaatagaaaataataatatagtatgaaaatatttttatgtatagtcatgttaaaagaaggcaatggtggggatgggggtgaatctgcctaggggaatatcgggagtggaaacgtgccggtgccaatccagaactgataatttagattgcaagcaccaaacataacacaatatcttcatgcattagacttgttacacgtctagaagctaatactataattggaaccatgtaaagaatttcaagtgtttcttgttgcaaaaatgttcttttttagggcagcaacagaactgttcttaagtgaatgtatttaatggaaaagaaaagcacagtaatctgttttgaacatgtatgattcatttttatccgtagtatttagcacttagcaatagcttttccaaccaaaatcggtatgacaacaggatccagcaaaacttgaaccctcctataatgcaatagtcccaaaagtaagtactactcggtcatatctctctgcccccatgcacttttggttcattctaatagctatcagtatcacactgaacccaataacctacaatgcggtactgtctacagtataggatgcggaatgaacaagctacagctcttcctcacactctcagaggataagagtggtcactggacaagtgaccatccaacaactatgcagtgcattaaccataagatgcctgtacaatacagcatgcaccccagtcaagtggtcatgcacttcttcatgtgtggacctcagaggcacacatatatctcatgatcaccacacctttttccagtaggaaccacaagatgtagacaccggaattgcattgtctcctacacatcatagtcttctagaaagacttaaaaaaaaaatttgcaagttcctttcaggcccttctaagtttaaatttagtttaattcgtacatctgtgccttctaccccctaaaccagaaaggaacaaaggcacagagcagcagctcctttcatgggctgaaatgagcatgacacaatgctgacggaagcagcttaccggtggtgacgcgtttcttctgaccaccggagatccccctctgcatctggtcgccgacgatcgtgtccgcgcatatatccaatcccagtatctgctcccaagaaaattcagtcaaaaagaaataattttcaccagctccagttgctacttgcaaccgtcgggatcaagacagtttaaattaacatgactaattcctgctaaccccatgtcaagcatgggcttaatgcccctgaaagctactgtcacctgccccccccccccatccccaaaaaaaaaaaaaaaacacacatttcaaactttacctaccatccatcctgcccaatgtaattatgttactacgtggccagtgctcggaaactcgcagtaaagctgataagaagcagaagctttggctgggcatatcaacaaacatgtggtgggcatcatcaccacgggtgcgcgccatttccaccaggccaagtgggtgcaccaaccccccaatccccccttccaaagctacaaggatgccccaccaagaactcaattcgagctccatctcccaattagcagtaggtgaggaggagggaggaagaaaaagagggaagaaagaaccatcctttgtggtcaagacacaagagagtcagcaaacaaacccactccctcctgcctgctgctgctgctgctactaatcagtaggagaagtatgtgcccaagaatcatagtagtggacttggtggttgattggatccttgaaaaaaaaaagaaaaaaaaattccccttttcccatttggtgtgcagtgttcaccaacctgggtcatggttagtactagttgtttgcttgtggacaaatgtgcaaccaagtcctatatgatttgcccatgattgattggaattgggatggtttgtcccttgtgttttccaatgtcaagactgaatctttctttctttttttttttgccggtttgatgacataatggtgaggaaatcttgcgctaatcgcttgttaatccatgtgtgaatgatgttgctatcagcttaattttgtagtgtttctcccttgtgctttctctatcaaggctgaaccaatttttttttattggagaacataatgatgaggaaatcttgtgctaaattgtttgttgttaaatcatattatgtcaatgatgttactatcagcttaatttggagtattatggaagcgaaaaataataatagcaaattcaacaaagtcgtgaaaagctcattactctgagggtgtaatctgtctgaaggctgctctcgactccttccatcgaagtagcctgcaaggaggaattaatcattcgtcacgtaaacaaatcaaaattaattatcttcgaaacaaagcatagtttttcctctttttttttcgattgaaacaaagcataatcagcaactactatcaccactattaacaccccatgtggtacacgtacgtctaaccgattgtgagatgtcgttttcgcaaagatcgtgtttgtcattaaccctgctcgaatctcattttcataatttcatgtcctttacgaaggtacaaattgcacggaaaatatatagttagattcctgtggaaatttccagtgaccactgtatataataatacaaggaccatctgatttagaccctgcaaactaaagtgagtgtacttgtaccatgtgcggctttaattaagctgctaatcgaaatagtagtaattaatcactcattatcaacaaaaaaaataatcactccagttaattaattaattaccttcatgaagaggtcgacctcgggctccggccggatgccggcctccttctccctccttgccagctctgtcagaagatctgcacggtccatttcccatccaaccgtcaggattgatcgatcgaattaatcttgaaaaattaattaattatgggacaattgtcaggtataaatatagtattaattataatttggttacattatagctacaatacaatttatatataacttccaataaaaatcccgcagtgacacgctattttcgtgaaacggaggtcgtgagactgaatctcctcacccatgtgcgcgttattttttttcccctttctaacttgcatgaatcttaagataaatccaacggtttaaaattatttaaaaattaaattattgttaaatgtaagttataatataattacactcaacaataaaaaattatcgataaacgtacaacaaaattattaatagatcgttcatcatcatcatcatgatgagggtgcgagtaattgcacgtaccgtacttggtgccgacgccctggcacctggccgagaagtcgagcgtctccttgacggtcatctcgccgacgtgcacgtccgtctggctgatgtacgccgccgtcttctgcgccacgaactcctccagctcgaacccgttgtacgtcacctcgccgccgcgccggagcgacgggtccagcttcccggcgagggccaggaggagggtcgtcttccccgacgacggcgggcccagcagcagcgtcatccgggagggccggacggcgccggagacccccctgaggatggtcagcgtcgcctgccgccccggccggacgccgacgagccccagcgccgcctccgcgatgttgcgcgccgtgttcagcagcgtcggcagcgcgcggctgcccacgtggcacctcgcctgcaccatcagctcctcgaaccgcacctccaccgtcggcagctcgatgcccaccctgcacgcaccaatttttttctcacatttttcttaacaataagggaatgtttttttttttaaaaaaaacactcatgagttagttgaagtttggcatttcaccctataaagtcaatttgttgtaaatgcttactcctacttaattttcgttaaaaaaaatcaccttaacgtgcacgtgcttaattgagttaccatgtttttataaattatgaaccatcaatatagtctttaccaaaactaaatactttaagatcattatagtcacttttttttcaaaatgaaaaaaaaaactagagctgaaatattgccgggttaggttcctccgtatccatgaaaaatttaatgaaatataaaatcaatttgttgtaaatgcttactcctacttaatttctgttaaaaaatcaccataatatgcacgtgcttaattgagttaacatgtttttataaattatgggccgttaatatgttttttttttaccaaaactaagagtatagctagtcactttcctcaccatcgtacttctatacgttaaaaaaaaaaccacactagccaaagacaagtgtttttagtaaaaaaatggacccactaaaaaatgggatatatagaaaaactcaaccctataaaaccattcatccgtttttctccaaatcctattacagcacataggcatgataaatctctaacgttgctatagtctctggaagggtatccacgtatatatgtattaaataactgtttttcatattttagtatatttaccaccgaagtttagtccaaatcattgtgtcctctacctaaaaagtagtttaggtcaagaaaataatatttttatctgattggtcaacggagatatgtcactggctaaacggaaatggttggtgtgtgttacggttgatgctaccatgattggcattgactcattccatttggagcacgcaaggggatcagttgcaatgttagtttgggtgtcaactttagtttcagcaaacctactgccagggaccagcgacaggaagattgtgttcatttggaagtgcataaaaaggaggatcatacacatatgtgaaagctagttgctctcctaccccacataaaatggcacttttggtcaagaaattaaaattatattactcaatctaactgcttgtatagtgccatcgtatctgtaactgataaactaaagaatgtgtgctaaaactgaaattaatacatactttctccgttgcacaatttaagacttttagcattgtccacatttatatagatgttcattagcatatatatgaatataaatatgtgtaatgctagaaagtattacattgtgaaacggaggaagtatgtgtaaccagtaaatattaaaaggcatgtaataactaattaactaccagtgatactaatatgcacacacatcaccgggctatctatttgtcaactgactgatttttttctctcctcatgatctattgaattcctttttcaactactgaattaatatccaacaaataacatgaatatgcctttttttttctttcctcgtggaagtaaaagtgtaaagcaagcaatttcaaacttcaacctaaaaatttgtactttgatatgcacggttgccaatatgaaagtcaaaagtatactaaagttagccacaaattgtatataggttcattaatttgggaaataataatcaaatcaaagttacaatgagttcatattaagtttgcagctttcttaattgtgcaagaaaaatcaggcgaataataatagcaaaagtaaaataaaaaatcaatttgatttaagtgaacctactagtgttccaaaaggagccatgcacccatcatgttggaggccgaaaacagtcacaaaaaagggaattggcaaaggaaaaagagggcacacactggtgctgatatcatgcacacgtcagctgacttcattaaccataatatccagcacatgctgtttttcttcttcatcatataatttctcatcttttcatgattttgttttgcaggcagaaacagaaaccaaacatgttgattattaagaaagacatgaaaattaataattgaaaaaggtagtaggatcatcatctgctgctgcccagctgctcctgcgcccttcattccatcaaatcaatcaatcgctctctgcttcttggtgtattgccttctaaattagcttattcctactcctagtagcaactctctcaagtcccaaccacaattatgtatgcatttattcctaatacgatgtaattagaccgtttaatggagctatcccaactaaccctcccagcatctgtgagtcgcaaagtgcaagaaaaagcagtagtctgaattgaagattatattcgtcttgctgcatcagaaaaattaaagataaaacaaaaggaggcgccggccggccggctagttgtctggctgaaattgaatatgttctttttcttcgagattttgggtgttcaaatgtatctttccaaacgcatgcctatatatcttggcttgcaatatggtgaagatatggttggctcaatttcggccatagaaaaagggtgcaaagcttttgtgtggaagaaaagccaactacctgtataaatcatgcaacaacccatgtgtactcgtatagctacgtatcataactttatacctacatgcgtatttgtcctaaaaatatacgtttaattggtacttcctcttatgtagattgtagaagatggattaattaatttttctattattaaaaagtaaaccctttttgtcccctcgagctgagctgccttggactcggaccatcattgtttgactagtagtcaagaaaaattcacttcaaagctgcacaagctgtactcctatgtaatagaggattacctctgttttttaatatagacgttgttgattacatatattttttaaataaaatgaactgccaaacgtattttaaaagataaacggcgtcatatattaaaaaaaagagtaatttctttttcatatttcaaagatttttctttttacaaaatcgattaagtagctagcttaattaggtttgagattgtacccctccgtactataaaaagctaacataatatactgcatgtgatatattttaatacgttatactaaaatgtgtcatatctagtcatagattcgtttttcgtgaaacgggagagtaccttacagcagcatgcatgatgcatgtatggatgatatgagattatcagattaattaatccgttggagatgattaattaattactacatatgcgttaataataattagcgtacctgtcgatccggttgcgtagcttctgaaggaatcgctggttgtcctcctcggcgacgcggaaaacgcgctcgatgaactcttgcctctcgccgacgccgagccgccggacgtccacctccttgtactgctgcttgcctgctccggcggcggcggcggcggcctcttcttcggcgaagaagagaatgncggtgcgcatgcggctgtaggtggggaggcgctcgatggcggcccaccggagcgcctcctcgtcgtcgtcggcggtgccgccgcggccgctcctcctcctccccctgctgcccccgccgccgccggagttctgcggcatgaaggcctcgtcgacgccccacgcctccatccccatccccctcccgatgctccggctcatccgcctccccgactcccacaccttctccatcgcgctctccatatctctctctctctctctcagtttcgccgccgcgtcgcgccgcgccggcgagctgatgacgagaagctgtagctaggtgagagtgagacgaagcgcgcgtgtcatgtggtagtgatggcgccggcgagcggcggcggcggcggcggccggggcggcgcgggggtgggagtggtggagagagtggaagaggcgaggcgaggcgcgcgctttttatcaactcgcgcgcgggcgcgggtggttttctctacgtgggggttgtttttttctttttcttttttggggtttataaatagaagaagcggggtaggtgtatagctgttcaagaggntgtcatctaggcccg

SEQ ID NO: 18309 - DNA, 25061 bp, Oryza sativa
  unsure (1)..(25061): unsure at all n locations
agagagtggcccacggccccccccacgaggtagagaaaagggacaagcacgcccgccatccgaactaatattgtcaccacccccaccgcaagaaatatagaggaataaagccagcggagcagacaaagaccaatttccccaccaccctcccaggggacgggtcaaaataaccacaaagacgcccaaccttatccatggcgcctacaaaaaagaaagaatccctataaactgacccgaggagtcagccgcgcccgtgacttaataaggaataccgtagagagtaagagtaaaatgaagagacggcccctggtggagaaaatgacccggcaagccgcggccgacatcgtcgaaatgtgccacctcgccggcggaaatgttgtagacaggccaaagccagaaaaagggacgcacgcaagccaactgcgctgggccgcggaagatgtaaaaaactgacagccctcgcctgtgtaccagtaaggggggcattaaatgagaacaacagtagggttcagctgcctatcgagacgacggtagatgataaggcggcagacgcgtacgtgcnccatgggtgggggactaggaagaggtgaaaaaacgtcggaatcgatagggaacggtttgtttgaatttgtgcgaaaaatgtccgaaatcataggaaatcgcgtttgactctgcacgaaggatgtgggaatttaaattagatggacgaattttcttcttaaaagtttgacgtatgtgattataatataatcgtgatataattacactataactaaaactaacatgtaattataatataacatgtataaactttcaaaattgctctgtatcatactattttcgtgaaatataggtcgtgggatcgaatcctctcgattacatatgcgtgcactgtgatttttttccttcccacttatacgaatcttgaaacaaatataacatttcaaaattatataaaatttacatataagttacattatagttatatgcaggttacaatataattacactataattatatttgtcaatttttagaagaaagattgtctataaatatatagcaaaattgcagattaaattgtctcacttgctttgtaaactattactttttttccttgaaacagggcagacagaaacggtatacctcaaaacaattatgatatcggaatgttgcaaaaagacatattattaagaggggaaacacggcaatttcgaatgttgaaaaaataaataagaaacatagcaatattgactagaagtagtaaatcatgtcatgtgtgaaaacttgaaacacggcaaagtgttagaagttgataaaatataattatgatatgaaaatgatgatagaaacgatattttatcctgagccccgaaacacaaatatcccggctagattaagaactggtactaaaaatactttaatacatgttctaaaagtccaagtctttagaaatatcttcaatcctggttgatattagtaaccggtacttaaaaattggtaacatcaatcaaaactcatgatctttactcctagttggagatgcatttttagtaccggttggtaacaccgacgacccatactaaagatatttttaagtactggttgatgttatcaaccattattaaagatgcctttaggattagttaaaaagaaagcatttctattcaagtcagatatgtttagtatgtgagatggacagatggtaaagcgcgtgagagctgagatgagagatcttaagtatgaatctcatatcccacatattttttagacttagtatacatcttttgactttagtaccagttaagatcgagatctttagtcttgatttactaaagagaggttttgaccggtattcgtttcttccctagtggacttatgtcgagccttcagatacttcgctgcttatagcccctaccatcaaaccgctcgtcacatagcgactctattttttgtttcatactagtaatcgtgcacgtgcaatgcacgttatgttaaaattattggtccaattctattaataattgaaaaacaataaatttattctaaaccactgatgttaacacgaaacttaagtgacaaataagtaagagccatatgtggtcccttttgttatccactgccatttcaaacaaaataaataaaaatactaaagtttcacttctcactacatttataacaaagttttacatgtgccatcacaagttaaacttttgcaactaatttggtctaaaataagcaactataggaccatactctcaccgtaacaatatgcaacctggagattaaaaacaataatccaattaagttgatcaacatgtcagactgtcacttatgtccagggatgaatacctcaatactatacaatcaatcaccccccgttttgcatctgatataaggataagcaaaacattatggccttgatcggcagcgatggctgctgccgcagctgccctataaggtgtaaataccatgtgaaagaagacatgcgtagcactctcatgtcacttggccatataaagttttcaactccacaattatataccctcctctcctcaacatacctgagcactgcagaggtgcacatgaatccatttagattatatatagagaaacaaaccctcttctaatcaagcgattttgaagagaaaatgtataatatatgcatacattccttcaatgtccaaactgaaaattaagaatcaacggtatcagccatagtgtcagccatggaaaagaactgagttagatcacaatatcttactgacgaaactaaatatattgaagccaattttctatcaaccactgagtgcatgcacaattgaattgtttatatattcatataatacaaaattgtaaagtgccagcccgaagaagtacatctcgacgtgtcagacacctatgtttaactgcatgtccatgcatgaaagtcaagaaactgcagtagaaagtgatgtttctaccctcacggagtgacagtaaaatcaaatgcaaatgttacaagtataataccaaaataaatactgatctgttcattttgaaagcaacaaactattagactgaagcacatgtattcacggtaagaaaaaaactaatgactaagaggtcaacttggttcacaggagaaaaaaatatgcttagagctctgactgagacacgaaggagtacctaaaaaatatgcatcatgagcttaggacttagagcctcctttgcttctttggttcgtcctaactactgaagccaacacatggatgtcagtcatgtcactgcattcacattgccatctaccaactcccaagaaactttcttcattctcatccaccaaggaatcaacctataggagcagaacctcttatgtcacctgaaaagaaaaatggaacgttcaagagtcaattattcaagctactactgatcaagggatcgcaaccggcgagcatgtatatccatctgaaccatgttgcagtgtttttgttatacataatgtaactgcagaacacatgcaagaatatgaccccaatgatccataattgtatcttcttggctgttccactgaacaatactgaattcatccataattatatcttcttggctgttccactgaacaatactgaattcattatatggaagtcctgaaaaaaagaaggaaacatgatgattggatctcttgagaaaatgacagtatgatttatgctcataacaggcatcatctatgaaaaatatataatttagcatagtcgtgacacaacgcagcatgaattctaattgcgccggacctcattcttagtaacatataaattaagcagaaaatcactggacaatgggccataccttatcaccagaagtcatacctcggtaaaacaaatatcattatgttgagacttgagacgatcatcacccaaggaattaacatttatcattttgcacagctgtaaactaaatcctagcaatatcttagcaggcattctgatataggaggctcaacaggacttgggccaaacctctgtcgccaatgttgttgtccatgcagccatccccaccctctcccctcctcaactgctcccctctccggtgtcatcatcgaggccaagactggcggtggtgctggtggctagatctggaccctccgcctttgcatggcttggtccgatgcctcagattcagtgctgccgtggccggttagggaggaagaagagagctcacatcaaaggcacataagggaggaggaggagaggatatatcagcaccagcagcagcaggaggatgtgatggatctgcgatgcgggtgaggaggcctcgatgtgagatgcgggtgaggagacctcgatgtgcgatgcgggcgaggaagcgattgaggggagcgatctcgcccccgcccctcgatgtgcgatgcgggtgaggaggcaattgagggatggctcccgttgatgtgagctgcacatcaattgcagggagagaaacaggcgtggatagcgcagcggatatcgtaggacatggatggcgcacgacggcggagtcgatgaaggcgcgtgttaggttggtggggatgggggatgggagggacacagctgtccacttttatctttagccgttggatgaatcttagatttaacctatggatttcacccgttggatttgatttggcctgttggattgtaaggagtgaactcctcctttttatattagtatagatgttggattttctttcactctgcgtatctctttcctaaccaacgtccagaccaattccaatggatctcttcccatgttctgtcttctagcaccccatgcctccaatagtacaatgccacctctctgcaccaccacaaactgagcagtaatagcacactaaacattgagatgttgtgtgttactccttagcagcatatagctaaaaattcatccgaccatctattaacatcctgacatctgttaacatcctgatcaagagggtccctacttaaatcgtgcaacttttttaagcaactttcgtatagaaactttttgcaaaaaatgcaccgtttagtagtttaaaaagcgtgcgcgcagaaaatgagcgaatgaggttgggaaccaggatgttatgccttgtctaatgtggtgcaccaactgttgcgtttgtccatcgcatttattatatattctcgttgcattaatgtgacaaaatagcctataactaaaggtcttgtttttttcattatcatggtgaaaacattgagtccctataggtgggcccagtgtgtagtcccataaaaaggctatatcggcaaacaaaccggcttggagctcgaagggtagacgatgaactaatgattgtaaacagtactttatatctcctggtcagtaaaccctaaagaaaaaaatgatttatcgggaaagaattttcaaatcaagacaaacatcagtaaaccctaaagaaaaaactttgatatcattccaaatcccttgaatccagtattcaaattttgtagtaacatttaaaacatgtctccatcattgatgaattttcataaattttagaaaactagctaattaatgaaaattgagtttgcaacagttgtgtcctctgcacatgatatgcctcctaacaaatagtaaaacaaatattatgagcattcaaatctctaaatgggaaaatgagtcagcttagctccttttgtgaataacaagcctctgccatatgcccagccatgatgtggtccgtacacttgcattcggcagtgcgcaaagagagaaaaactaactcgttttagtgttttacatacgcacgtttcccaaaatattaaacggagattttttttattcaaaagttctatagaaaagttattttaaaaatcatattactatatttttcaagtttaaaagaattaatacttaattaatcatacactaatggttcatcttgtttttcgtatcttctcaatattttcattcctctcctctcaaattaatataatttaattaattcttgtatcaggaggatgagttcaaatgcccaccatagtttaaagctttatgtgtgcatctttttcttcttattccacttcttctctgaccttggtatctcaaatgtagactttagagtcatactcctacctattaccaagtgaatttaatattgtgatacccactgaaagtttcatcaaagaagtggtgggtgagtgaaagggacctggacacggactccatcaattcactgaaacgcaacaaaaatcaggacatgcttcctaattccaagccattgtccatttgtccacagtgatccaactaaacctggagactttggagtaaaaacctgcaagaatgtgtgctaccacactacagtacaactactgcttgcattgcacccagcaggttcaaacatagtccatgacctatgttttgcttttcttttattttgttgggaaaaatgtacttttcatccgttaactcttgatttggtataattttgcctcttaactacaaaaccaaaaccaatatagtcatctactctcaaaatcagcaaaacatgacccttgattgcatttggcaatggtttttgaaccatgtatgtaggtgttgaggtcttcttatatcaaagaggaatgagcactagagaataaaaagtaggcccacatgatcataaaagatgacttaggactcatttgaaacacatgattgagagcacaagaatattagaaatacatgcatgattttgaaagaggtgaaagtgtaaaacagatgattatataaataaatggccaaccgtttggttagccacatgaaatatttcacgatgttgtttgatctcattgaaatttcctccaaaatttgtatggattgaaacatccaatagggttctatgttgttcaatcctatgttcaaagtgtgtcatttaggggagggggattcctataggatcgaaatcctataaactactttgtttttacttcagatcaaagtaggtcttagataattgtggggtcttgatgaggcacagctatttggccttagagaattgtgggccattgatgaggcactgctaccctctatgacaagaagggtctcacctattttagttaaaactactctcaaatatatcaaagtggttgttttacctagtttagataaatgaggaacgaattttaccaaactacaattaaaagaaaaagactaaatcaatcaagaatttagggaagagaaaaaagacttttactttctttttcagatagtgttataggataaatgaattcatacatgcacttgttcacattccagtcacatatactaacaggcaacccatgtttttcaacgggcattattggtggtaatttatataaatattaaaaattggaaagcatgataacatgttggttattaatttttgaatcatccctacttaagttattaatttcaaattttcaattaaattagtaaaatactaaattgagagtttaattatgatggttataacttcgtatttattaattttgaatgttggaactattagcttttgaaaaactaaaactaagggaaaaataatttcttaaattccatgtttctttagcatgaactcccaacacaatctatggtcgtaataataatatgatcctatgatggtgcatatctacttcataactttgtatttattaattttgaatgttggaattaataattttggaaaactaaaactaaaaagagaaaaatatatatatttgacatggacttccaacacgttctactgtcatattaatattactatgatccatatgattaacatgggagctccttcaaagtgccacaacacgatagatccataaggtgtagataagatacatttagcttaaaattaaataagcatatatatacacacatccattgcaacttgcttgagtatcaatccgttcagcaaaatattaccacaacatgcacgaacaggggagacaaaaccacaccacacgcaatggttcctacggtccagaacagtttgcagcttcagcaagttactgtctgtgtaaacacttatccccagcttcactctgcttcagcaacagacagacaaatggctccggtccaacacacagttggagccatcagtttgttgcattgtgtatgcggttaataagttaatcctggttgagtgcaagcttatgtgtaactaaagttgaaaatcatggattcatctttatatgagcttgtaattatcagtggatggcaccagattctcaagtgtacttgtcactagacttttggagctttcatgctagcagcacgaaaccgtctcccattagcagcctttttcccaggaggattagcacagagccactgaccactttgagaacttttaagatagtagaagtaactttcggtcttaaacttttggagtatcatgcatacttcctatatatcatctttgttgtgtcagctttgatcacaattctttttctaaataatttggtgatgacaagtaaaatttgcaatgttagatttgccatgcaaaacacttcaaaacttaattaaatattgagctgtgcgttcattaattactaagtactaaccaaaatgtcagtaaaataaggttgtatgtttttccccggaccgtcgtgggactgtcccaagagaaattctcttggagcaagtttaatagtatagccaactaatagctgtcattctctattttgcggagaatctttgcagtgaaaactctattagggtttatctagatttgataatatcatcatttatttgtcaatttttttgttgaaagtgttgtcttagagttgtctcggttgaaagtggtgaaaatccgccactgattgtgattgatttggttggatcggtttatatcggcgaacacaaacgtcatcttgaacattgtgtttgatcatgagagcaaattgctgcatgttgcattagttttttttttatgtgtgcatccttggttgagtgatcatagacttactcctatgtatttcattaattaatgaaatgtcctatccttgattttttttcttcttcttgcaattataggatgcatggatcagtttctgaagagtgcatacttgtcaatggacttctccatcatgcatgcggcccaaaaccaacttgcattagcagacttttatctctgaccgatatgattagctgagtatcatcagacgaaggagcaaaacgttgtacttttcctcgatgctctctttctacttgaacctgcagtttgttgtacttgtctgtactgattcactgaaggacagtgaagttcagaagcatcagcaagctagtagcaagcaggcaaaaattgactcgagacgatatgatgctgaggtggcggctaactaaagctgaaaattctactacatatgaccgtacgtgttggcaacagtgacttgcgaaatcaaggctaaaattgtaagtttggttgaaattggaacgatgtgatgaaaaaattgaaagtttatgtgtgtaggaaagttttgatgtgatagaaaagttgaaagtttgaaaaaaaagtttaaaactaaactcggcccaagttgaactccaatccatcagttaatcttctacgggagcagatgaactgctcctgccaaaacacaagaaattgacagcgctgacgatgtaatcgtctgatgcatgatgtatactagctaaaatgatgataagaaatcatcgcaactggtaaatagaaaacgatgatgatgatgataaaaacagagcaatcacaattcacaaacagtagctcttaaacagaggaggttggtcagctcaatttggggtaaaaaacaaacacatggtcaaatattgcttgattgattgcatggctgcgatggtttttcaataaacacacaataaaatttattctgatttttgtttcaataaagttatagtcacttattacataattcgctcaacagagagcatatacaatctagaactcacgatgcaatgactaatgctttccagcactaaaggagacacgttattcaagtctgtttgtgtctattctaatcatggaaaactcaaaacactaactgtaattgtttcaaaaaacactcattataaaaatctacaactaaagcaaaatcatgtcgaccaatcgttcatgttgtacataaaaatatgtgcacaagatttagccaactaaaaatatctcttaaaagaaatttccatccactacgtctattactcacatgatgcacgcagaacaacacaccacaaaaagcatcgatcaccattctcctccttaattactttttaattaggagcagaatgagaaattagattaaatcatgacgactcatggggggtcatggctgccaaaaataaaactaaaaacaaaacagccgctagtagctaagctaagcaagcaaaagaacacaacacgggcggtcaaggtttatactgaagacgattacgcgcacgcgagattgtgggggggggggggggggggtggcttaatcagctcgctcgcgccatccgcgatctgacgattaattctctcttaatctgcgaattaaaagttgccttcaggtcgcagcttaacaaccattgaactgaaccactcgtcttcgctccactgtatactgaactacttgtttttgcagcgatgatgcatgatgagctttcaagtttcaacaccaatgtcgccatcgatcgacgatcgactggccacgacgcgacctaaatgcgatgcaatttgatgaatgcattccatgtcgtgtgagttcgacctcgacttggcggccggcaaattaagcatcctagtcaaaaaaataaaaaaagtaccggccgtacctagtcaagattaaattaaatgatgatggcagaaagaggtaagttaatgatcagtacggaaaatgaaatcttcggcaacatagtcgttgcgttttgggctgtagtagattggtgaagactattctgcatgcagagacttggtactgtttggttcaacgggaaaatttactatttgttaccatgcgctcaagtgttactttctcggattttcattttcatttgtcaccccatcatcaacaaagctttctgtggagattatggataccccatatctacacggcggttatattccagctgggtacatggtaccgaataaagatagaatatcttcatgaggacttgggttagattctaaacttgtatgtcaagaaaatacccggaatcctagtcggttacgattgtattttatctgtaattccatgttcctttgggatatggattgtattttataaagcggatcccttcccctatataaggaggggtccggatgcctctcggggcgcgatttttctcagatcatacaatcaataatacattcggcggaatcatccccggacaggagtagggtattacttcttgaataagaaggcctgaacctgtatttctttgtctccaaacctatccactttccaagcttgatagccacccccttttagtattgctgaaaccttgtttcgacagttggcgcgccaggtagggacagcgtcaagtttttgccgactaagtgcgatgggttctgtctccggcatcgacgacttcgcctttcctcccgggcaggcgttccggttcggcagcctcaacttcatcaccaatgacttcggcaagatctctctccttgactcggattcgaaccagtcggggagagaccaggtccccgcgccgttcggtattccgaactcggccgaggcctactccaagaccatctctcccgagttggtttcaaaccactcggacgagatccaatctactcctcagcgaccagatcaagatgacgggtcctatccctcaatcctgatgagacttcctgatgatttggccgctgtcttcacagccaaagcatctcccactcgaagatctagacaagccccggcttcggccccgatccaatctagatccagggaggttggcgttatactccaacctcttgggacagtctcgacagaagagttggatggctacctcagctcccctggtgtcagttctcgactaatcgaggtcctcgactatgacgacttcggctaccactatgactacggcgacttcgacaactttgacgacagctatgaggataattacacgcctatctttttcggcgtattcatggctgacaacgaaatggaggaacaacgccgagcccgagaagcggaggaagagcgcacacgacaagaaactgaacgtcgccgattggaggaagaacgacagcgacaagagcgagaacgactacagcgtgagcaacaagatcgcgagcgagttgcaaaggaggctgaagatcgacggcagcgcgccttggaatctgggcgacgagcgagagagctcatcgggcaacaagacgtcaatggaacagcggtttttcgcaccccccagcagaactcggttgcagcaatcactctcctcgacaccctcctcaaggaagacgcactcaatcaagctgatcatgttgtcaacatcttgaaccagacgaagaccatgattgctgcctcggttccagccaactccgcaagcacccgcaccctgactggtagccgagtccctcaccttcgatctcaggactatcaccagccaagcctcagcatagccggcgccggatctagtcgcaggagcaggggacatgatgaacgatctgagtcctggctcacagtctatggtctcgtagtccgcgcagcaggaggagacagcaaagccatggcgaattatctacctgtggccctagcagattctgcccggtcatggcttcacgggctaccccgcggcacgatcggatcataggcagagctacgcgaccacttcatcgccaacttccaaggcacttttgaacggcctggtacacagttcgatctctacaacatcgtttagaagtctggagaatcccttcgagattacatccgacgcttcttcgagcaacgcaacaagatctccgacatcaccgacgacgttatcattgccgcctttattaaaggcattcgccacgaggacctagtcggcaagttcggacgcaaacctcccaagacggtcaaacagatgtttgaaaaagccaatgagtatgccaaagccgaagatgctattacggcatccaagcagtcgggcaccacttggaagccaaagaaggatacaccgaccgtaggagggagtggaagtaacaaccacaaggatcgcaagcgtaagcccgaagaacttgtggcaacaacctctccattttccctacaacgttcccgcgtcaacaccttcgacaagataatgaactcccaatgtccgcatcatcccaactccaaccacgtggccaaagattgcttcgtctacaaacagtttgcggagcaatacgtcaagaatgcacgtaagccctcagacggagatcaagtcacatcaaagaagaaagatgatgaaaacgatgccccgactggttttcaagatcatcgcaaagaactcaatcacatcttcggcggacccctggcttatgaatctaagagaaagcagaagctaacagaacgggagatcaatgcggttcagcctaacacgccccaataccttcggtggtcagagatagcaattaagttcgaccgctcggatcatcccgaccgagtggtccacccggggcggttccccctggtactagacccaatggttcgcaatgtcaagctccgaagaactctcatcgatggtggcagtgcactcaacatccttttcgctaagaccctggacgatatgcagattccttgcacggaattaaagccgagtaatgcacccttccacggtgttatcccaggattatcagctacaccactcagccagatcactcttccggttactttcggcactcgggagaattttcgcacaaaaaacgtttgtttcgaagttgctgatttcgagacagcgtaccatgctatactcggatgaccggctctaaccaaattcatggccgtcccacactacacctatatgatgatgaagatgcttggtcctcgaggagtcatatcactatggagcgacatcaagcaagccgtcacatgtaacaaagaaagttgcgagatggcccaaacccgcgagatcactctcgctcgcgaagagatccgactggctgcgaccacggcaagcgaaggagaagtgcctgcgaccaagctgtcaaagaccgaagaaggcgacgacaaaactaagaagattccactagatccctccgatcctaccaaaactgctgtaataggcgctgagttagattgtaaataggaaagcgcgctcatcacctttcttcagaataataaagatatttttgcgtggaaaccatccgatatgcctggtattcccagagaggtgattgagcactctttacatgtcaaggaagacgccaaacccatcaaacaacgactccgccgttttgcacaagataggaaggatgcgatcaaagaggaattaaccaagctgttagtagcaggcttcatcaaagaagtcctccatcccgactggctggctaacctagtactagttcggaagaagaccgggcaatggcgcatgtgtgtcgattacaccgacctcaacaagtcttgccctaaagatcatttcgggttacctcgcattgaccaggtggttgactcaacggctggctgtgagctactcagtttcttggactgctattcgagatatcatcagatccgactaaaaaaatccgactgcttgaagacctcgtttattacaccctttggggcctactgctacatcaccatgccctttggattgaagaacgcaggagcaacctatcaacgcatgattcaaagatgtttttcaactcagatcggccgcaatgttgaagcttatgttgatgatgtagtcgtcaagaccaagcagaaggatgacctgattgcggatttagaagaaacttttgaaagcattcgtgctttcaggatgaaactaaaccctgaaaagtgcatcttcggagtaccgtcagggaagctgctcggatttatggtatctcaaagaggcatacaggccaacccggagaaaatcaacgccatcctcaacatgaaaccgccgagttcccagaaagatgtccaaaagctgactggttgcatggcggcgctcagccggttcgtttcgcgactcggcgaacgggggatgccctttttcaagttgctgaagaaaactgacaatttccagtggggacccgaagcacaaaaagcctttcaagacttcaagaaacttctcactaccccaccagttttggcctcgccacgtccgcaagagccgctattattatatgtgtcggggacctctcaggttgtgagcacggtcctggttgtcgagcgtgaagaggaaggccatattcaaaaagttcaacgaccaatttatttcgttagcgaggttttggccgactccaagacaagatatcctcaggttcatgtcacaccctaaaaattcaaaatatataaattgttgtttaattggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcataaataatttaaattgaaaaaggttttaaaaagtcttcttttggctttgggccgaaagtcggcccaaaacccttctctctctcctcggctcagtccggcccagtccgccgccgcgcgcgcgcgtccgcccgctgacaggtggggcccacctgtcagggtcgtcgtcaacctccggccgccgccgcccgaaaccctagtttcgcgccgccaccgtttccttccaaaatccggccgctcctttccgtttccggtgaaattgattgaggggaaacaatctttgggatctcctctaccttttcccctttggaagggtcggctaattcgttttggaagttcgtggaatcaagttcgattcggatcggtctctttccttcaaaccccgatctttccttcccgtcgccggccgccgtgggccttcgccgtcgcctcctagcccctttaaaaggttccccgagctcttctctacccgtcgccaccttcgccttcgcctctcgtcgtccgtagtgccctagcgccgtgtagcttcgagccgccgtcgtcgccgccgctccagccgtgcgccgccgtcgtttcagccgtcgccgtcgctcgggaaggtcgccgtcgtgatcgtcaagtcgccgccgttctcgtccgccgcttcgccgccgccgaagaccgccggagcaccgccgtcaccgtcgacccgatctccgccgccgtttcaacctcgtcgccgtcgccgtccgttgctcttccgccgcctttttggtcgccggtggtgacgtcatcgccgacgtcatcgtcgcccttccccgtgagccggtcgtggaccgttcgatctcggccgtccgttttggatcaagtcgatctcggccgtccgttcgtgtgaaccgccgccgtgcgcccggtccaccgaaaccctagcccgctgacgcaataaatctccttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctgttttctgtttagattccgtcgtttccggagagtccgttttcgcaggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattctttgttatagcccttttgttcttggttactttattccttgataccttgggttattataacttgactagttgagctttatatattggttcagctagatattagatgtgattgcttatccatacttagaaacattagcacactattgggataacttatgactcactattattttaatgatggcttaatgattgttcacgatggtcaatcgtgactggttaattaattacttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggagcaccagactgagaagtggccgagataagcccacgggggtcgctggggagtccatgccttgtttataaggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccgggatggttgttcagaatggttgggcctatgcaacagggtatgttgtatagcgttgggttaatattgtttaatacttaactgttttattaaattctcaaatgtttgctgaatgctgcttttgcaaaaagatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtctgcgccgtttattttattttccactgcttagatctttattgattgagaggaactatctacctctgtaatgacattttattcgcctattaattagagtaataattgtactctattatcaatttgttattgtgtgcctcggctgattcctggacgagggttcacacacatgtaagcgtttggaattttggatagaaattccgggcgtgacagttcaaaagttattatatggtgtcttaattaccgtcaggaaattatctcactattttcaaagtcactcggtcacggtggtcacgtcgtttccactcggggatatacttcataaccgcgaagcaaacggacggattgcgaagtgggccttagaattgatgcctttggacatatctttcaagccacgaacttcgatcaagtcacaagctttagctgatttcctcgccgagtggaccgagtgccaagaagatatgccagaggagaagatggaatattggactatgcattttgatgggtcaaagaggcttacgggtgctggagctggggttgtcctaatttccccgactggagaaagattgagctacgtattgtggatacatttttctacgtcccataacgtggcggaatacgaggcgctgctccatggattaaggattgccatctctttaggcattcgccgactaatcgtccgaggagactcttagttggttgttaatcaagtcatgaaagaatggtcctgtcaagatgataatatgaccgcttatcgacaagaggtacgcaagttggaagataaattcgatggacttgagctcacccatgtccttcgacacaataatgaggcagcagacagattggccaattttggttcaaaacgggaagcagtcccttctgatgtgttcgttgagcatctttatgaaccaaccgtgcccagaaaagaaaaaattgaagccatgaatactcaaggtgtaagcatgattgaagcagactggagagaacctctcataagatttttaaccaaacaagaactccctcaagacaaaaatgaagccgagcatatttccaggcgcagcagactctgtcattcacgagaccgagttgtacaagaaaagtccatcaggaatcctgcaacgctgcgtatctttggaagagggaagacaattgctaaaagacatccattcaggcatctgtggtaaccacactgctgcacgaaccattgttggcaaggcttatcggcagggttttttctggcccacagctgtttccgacgccgacaaaattgtgcgaacatgtgagggttgtcaattctttgcccgacaaactcacttgccagctcaggagttgcaaaccatcccgttgtcttggccattcgcggttttggggcttgatatggtcggtccattcaaaaaggcagtcaggggttatactcatctctttgtagctgtggaaaagttttccaagtggattgaagccaaaccggtcgtcacaatcaccgcagacaaagctagagatttcttccccaatattgtacatctgtttagagtaccgaatcgtatcattactgataatggcactcaatttacgggcggaatatttaaagatttttgtgaagactttggcattaaaatttgttacgcctctgtggcacatcccatgagtaacggacaagtcgagcgcgccaatggcatggtacttcaagggatcaaagcacgagttttcgaccgactgcgtccctatgctggcaagtgggtagaacagctgccgtctgtactttggtctttacgcaccacccctagtcgggctactggccagtcgctgttcttcttggtttatggcggagaagctatgctaccaagtgaggcagagtttgaatccctccgatttcgtaacttccgggaggagcgatatgaagaagatcgagtggatgatatcaaccgactggaagaagcccgtgaagtagccctaatccagtcggctcggtatttacaagggttacgccgttatcataatcggaatgttcgatcgcgagcctttttagtcggcgacctggttctgaggagaattcaaactacacaggatcggtataagttatctcccttgtgggaaggaccgttcataatcgctgaagttactcggccaggttcttaccgactcaagcgtgaagatggtactcttgtcaacaattcttggaatattgaacaccttcgtcgattttatgcttaggcatttcgtttgtatctttcctctttgactgctaacttcaagtttttccttgaagttttcagtcagggggctactataataataatggaacatgatttttatcaattcaatttgcttacttgatttatcattgccctgcttgattttttgacttagacaataaggactgaaagttttttaataacttttgcgagttttaggctcaataaggtttgacaaaagcttttaagaaatcagaggctaagtttgaaatatctagcatagcataaattcatcagtattgtacaaattgatcttccatcatcatcagaatcactgttactaatcagtgtcagttttttcatcgtcggaattatcagacccagtcgaccgaaggtcgacatcttggaatctctcaactacgtcagcagcaatcttgtcagcggctttttgtgcatcattgatgaggttgagggctgtttcttcgcttgtcccgtctgcaaacccatcaacgacgtcaatatcgattttggggtataaagatttggtcatagctaatgccatacttgctcccatacttccagcctccctgatattcttgaagtaagtatccggagcgactctcagtttgtcgaagatcttggaagtgtcaagtgtactcggaccggcgttattgaagaacatggcttggatgagcggggtagcggcattaacgactttatccctggccccttcaagcctattgatcttgttgactaagacatcaaactgtgcctgggacttgattttgcgatctgcacgaatagattcgtatcaaaagtggctataagaacatggggaatcagttatcattaccttcaacatcttttaaggccaagtccctctgctttgctagttcggccttgtccttctccagagcctcgacctgcttctctaggtcggaaatcctggcggcttgcactgtaatgcttttcggttaatcgatatgacaaggaaggcttcacgaatacgtcagacatatatggcatttacctttggatgaaccacttaattcatagttagattcttgaagctcggagattctattcctcagatcatgctcagttttcctcgcgagctctctaacctcatatagctggcttctggtagcttcaagagttccaagatgagggactaatttctcaagagttgcggtcttcgcctcattcctgagatggattctctgcaatacgaatttactggcgtttcagcaagacatgaaaggggacaattaaagccatgcatgaatggacttacatttacaatgcgagtagcctcgctgagtgcctttttcagcaagcatacttcctcatcttctttttgtttgtttattacgattccttgaggttgcctatcatcgtcccaccacttgactaggatgggagggcacgagtcttcagctgcttgtatacggggaatttcttcttcatcaccagtcattggtcctaatgtatccattgacaaaggttagacaattgatcagagtcatttggatcaacacggtttcaggcaaggtgtttacctgtgaggatttctggacggggacgagttgactcttgcgccttaacgggggaccctggcatcgggtcgttgctggcgtcttgtctacgagggctgtctgcccgagctccaacttctggaatctcttggcttggcctagtgtccgactggttttcagtcgggggctcctgattaattccggctccagcttcggccgactcgtttcgagtcgggggttgatcaccagatcctacattatcggttgctggctggttgtcactcggctgatcctcggcagttggcttggtttcttttaagttcatttccctgctggtcaggttagagtcttttccagaaggatctatatcagatggtttcctgcaagtttgattatcagtattatttccgcactaggtgcgcatcaatgcaagggagatcgttatatgatttgtacctagaagacttcctgatctttggcacagggcgactggatgttttcttccttggagtagcctgcttcggcagtttcttggttgcctctcggtctccaggctttctagcagtatcgctttcgtcgtcacttgacaccaacttccttttgcgtgaatatggctggccggctggattggaggtatttggccagtcttcagaacggatcttgggacccccgctcccttgactggtttggtggtggggtgatcggcgttgaacgactgggggatccgacttcatcaaagcaaattcctgggcataatatccttcattgttaattgattcaacaaaaagacaagactatattttgtgaaaggttggaatgtttgattacataccagtggaggaggattgaaaacattgaatggcacgactggcagcaagtgcgaatagctgacgacgatagcattcgagaagatcttgtacatcctctccttcataaccttaaagttaagagagtctggatcttcacgatttggatcatgtttgccgtcaaactcaaaagctgtgcgggacctctctttgattagctagccggctttttatgaagtgccgagtgatctgttctccttgcaaaccttgctctttcagctttatcatgcgctccatcagttccactacttgggccgcctcatctcctgtaggcaatgaattccatgtatcttggtagaccggagggagacaagagtactcgggaagggctgattcaggattttgaacatagaaccagttggcgtgccagcctttgtttaaggtcttgaagggcatggagaaatatttttggcttagtgttcccctgagttggaagccagcgcccccaacaacgcacggtctgctcttgtttggctggggtttaaggaagaagatgcggcggaacaaggcgaaatgaggcctaatgcctagaaaagcttcgcaggcgtgaataaaattggcgatgtgcactaaggagtttggattcagatgatgcaagctgattccatagaagttcagaattccccggaaaaatcttgaagtgggaagagaaaacccgccatagaaaaagtgagaaaataccacgacctcgtgtgtatcgggggtcgggaatgcctcaccaaatgccagccgccacccgatgatctccttcgttggaagaacgccgtgcgccaccatctcttttagattttcctctgtcacatcggagggcgcccactggctctcgaaactttccctctcctccgccatggatgtgagctgaatggtttgatttgaaccgaggtatagctcgaggggaatggggaatcggagcggtggatgcgcggagaagtttcgtgggattttgggaatggattgaagcggattgatgaactctagcttcgtcggcgcggttatgtactgtagcaaggagtggggaaatggtgaaagtcttggcggggaagacgaagtgacgcttagacttcggagtttttagggtatcgggagtactaatgggcttgggcctgtatagtactttggcccaatattacaatcagcgtggcccgttgtgatccctagggatttaggcactttttgctttggcaatttgtgctcacaatgatgtggcccgatgctgttaaaatcctttttaacgcggttcaataattctttggaattattatgatgaaataaaaaggtgcccggcagaaaggtgttatgccagttttgtaagctttattaggctgcaaaagctgtttgggtagatttgagatgactagtttgctaatagtcattctcttagcatgttatatgcttattttggttgtggtgagggtcatagcctaggctattagactcgttgattaccatgactttttatcatatttggtggagtgtctttggagtttttactcggattcctgtcaaataagtctgtttgagggccttttgagcgtttatcacacgggtcttcttatattttttctcgatatattaaagctaagaagcagtcggctgggagttttactgtttaccacgagtgctttgttgtataatgtttggttgtaaaaccactcggttcttgactttatgtttagttttttaactaaccacatagtcgggggctacacctaattaggtgcatctactcgatgcaccatgttttattttcgcccttcacagtctttggttccagtactcggcaggctgaagcaggaagagttgaagtactcggattattgttttttgttttgagatggctatttcgtcgactgcaaaggtctcgggggctactgtggagattatggataccccatatctacatggcggttatattccagctgggtacatggtaccgaataaagatagaatatcttcatgaggacttgggttagattctaaacttgtatgtcaagaaaatacccgggatcctagtcggttacgattgtattttatctgtaattccatgttcctttgggatatggactgtattttgtaaagcggaccccttcccctatataaggaggggtccggatgcctctcggggcgtgatttttcccagatcatacaatcaataatacattcggcggaatcatccccggacaggagtagggtattacttcttgaataagaaggcctgaacctgtatnnnnttctttgtctccnnnccctccncctcttccngcttnntngctgntggnctnagatgcatctgttcaatcaaaanacacgggggggnngggggnggttatgnagatacanttgcactagttcgacnctttcagataccggccgaaagagncnggagngaaaatgacgcgtcttacaggttagtctaactccagtcg

SEQ ID NO: 18310 - DNA, 6135 bp, Oryza sativa
  unsure (1)..(6135): unsure at all n locations
cgcgcgactgactgcacatcgccatgtgcncatcacaaattccagcacaaagagagggagagacgacatgcgagatggaggtcaaacgcggacgcgtccttttcggcggcgaccaccgctggccacgccatactagagctacgcgtagaggcgggaagagacgagggcgagggctatgcagaggcaagggagagctctccacctcgcactaccatcctgtgacgctagtggccacctcccttcacgcagcggagctgtaatacccccgagttttaaattaatatatctcgcggaatattagagcaaacgcgcaaaagttcaacttttaaaccattgttcgtatagacgatcgggaaccgtggatgcgtagagctcgccgagtagtgcaaaatagactataaatttatagtaatcggagtccgaacgaagtcccgaggattgaatagatgtgagccgttagatcttatttagtctctttatataaccaaccaaaaaaaacaaacgaaaaaaaaaagaaacaggagcgattctcctgtagccctagccgccgcacctcctgcgctctgccgccgccgctgctgttcctctcttcgccggcgccgccgctggtgcagccgtcgccggtcgccacagccttcgtcgtccgcagccggtcgttggtgagctactgttgtttctgttaatttccctgctgctgccgaaccctgctgttgccgatctgatctcttccttgctggtggtgcacggcttgctgttgctgccgatattcgtttctgctgctgctggcctgcaatgaacaggaaggagggagagaaggcagagaagaacaggaaggaaggaaagaaggggaaatttgatagaagaagggaaatttggggaatttggtgaatatttccaaattcttcatttttcttatacattagtactgctaggtaatccgttttagtctatagttgtttctaatttatatttaagacgatctgtttccggttttttcgaatttattttatatcgaacgctaggctgaaaccgtattttcaaatctggtattaaaccatcaggaatcaggttagttgtcctaaataaagtttgtagtcattgtcaatatctttccaacggtgctagtttcactcgattccgataaacggtttaggagaaacagcaaaaacagtactgctgaccgggtccggaaatcaggacagcagttcgtttttccttaatctggaattttcagagtcataatctgattttgtgctcaacatgaaagttgtagacaattttgtctagatgtccaaagttgtattatttgctagtttccattagacggtttgtgagttactcataaaacagtaatggaacagctataggttatttaatacaaatcgataaaaggtttatatgttctaggtttcgattttagtaaatatcccttgtaaccatcgttagttgaatatagtggtttatgcgtagttttgctccacaggtgtggagggttccaacgttggaggagttgagtcggagtatcgaatgagttaaggcaagtacaagacggacttatgtgatggacaaaactgagttgttttgtttggctttacttgcataattattattcaattgcttgttattactgattgtatggctatgacgttatgctacttattcgtgttttgacccatattcaaattcatgacgttattcatgtttcattattccggatgttctgtttacattatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaaacatgcgtatgttttactagttcaagattgtatttgctgagtattctttactcactcttgtgtttaatttggtttttaggtacctaatgacatcgatcggcatggggcgggagtagcacccttggactacacattattattgcacacaattgaaattagttttagactatgatttttgctcagcataagttttgcatagaacttgtaaaggtcatttaaggttctgatccttatttttcacgtgggatttgtggagctaggatggtttggattgtgtggtttatatcggtattgacctttcttataactgtctgtcgtgatgtccgtatttttaggggagactctaccaaaatttctaataattttaggacttagtttttgagtgtattttggtgtggcattctatgtacgtggttacctggggtattacagttggtatcagagcgggcggtaggtccatgggaagtgactgggtaatgagatatataaatcaacataaaattttgaactagagttcctaaccaattaaaaaaaatactttctcttagggtaggaaataataagagtagaacttgggttatatataaacatctaaaagaacttgacacactggtgcacaataggaatgggagcatgggtcattcctagcatttatgtttctgctgcatatatatgtgtatgattgtgtttccttgcatgccattgtctaacctattgttaaactaataacgtgtaaatgcttgtgtttgatatagctatgccgcctagagtgagtgtttggttggctaacagaggccgcgggagaggcggaggtagaggtcgtggtaggggccactataatgaagaagttgaaaatactcaggataatgaagaggttgggaacaactcggttgctgaatcccctattcctaatcgtggaggtcgtggtaggggccgtgctggaggccgtggaagaggttgtggtagaggtcgccataatgaggcagcatcctcgaaccagaaggaggatgagcacatggaagaggagggtggtagccattcagctgctgtctctgatgatgctcctcgagctgctcgggggatgacactcactagatggacatccatgcgcttagacacatttgatgggtctggtactcccgttaatgctgcagactggttacgcaagatggagaagtatatgaggggatctagaatgactcctgaggagaaggttactttcatgccttttcagttgactggtcaggcggacatttggtgggatggagttgttgaagcgtggaaccctgatcgtggtgctattacttgggaagtttttcttcagcagttcagagctaagtattatccagaatcatttagggacaagatgagtgatgagttaaacaatatccaacagggaagcaagactgttgatgagtatgaacgggagttcagcagtattgtacgctttgtgcctagcgtggcaaatgatgagcgtgagaaggctaggaagttctttcgagggctcaatgctcggtatagagaagtgatgggaagaaacccgcctactatatacctcaatgcagttgaggaggctcaagggatggaggttgagctccaaattactactgcgcagaagaatcgttttggcaatgtcactggtaatgagcagaagagagctcatcaggaagggggtgagaactcgcagcgaccacctttcaagaagtacaaacaaaatcaggtcactcaaccatcatctaaacctagccagtggggttctcagcctaatgcagcttcacgtccaacggagtcttagttgattcgccctgtgccaaggcaagggctaatttgctttaagtgtggaaagaatcaccattcagcagagtgtgggtttactggggcatgtcgtgggtgtggcaaagctggacacatggagttggtatgtaagcgtaacccaaattctatcatcaagtggcaaaagccgagctcctattcagcaacctcttcaacagctagctatcctcgaggtttaggttcatccactagtactccccgtggtgccgtttagatgatgacaacttatccacttccttaccagcagttcacacataattacccaccaccaccattaccaggacagtattggcccatgcctcaatcttttgctccacgtgctccactccagttgcctgcaccgcctatggcgcatccttctgcttcagctccacctcaccagcaggtctcagcctctactaccccagctatagctggagtctacaacatgcctgcagcttcatcccttggtcgcccggatgtcgttacaggtacacttttagttgattcgcatgatgccctagttctgtttgattctggtgctacattttcctttgtttcaatcgagtttgcgaaaagagctaatctatttagtcaagaggtctctcgatctgtccaagtcagctctccagggggtataatctctagttcagtagtatgtctaggttgtgcaatctctattgatggggaggaatttgtggcaaatctaattgtgattcccttaccgctctttgatgtgatcttgggcatggattggttgaaccgatatcgtgctgtaatctcttgtttctggaagactattaccttggaagctccatcaggcgaggagatggttttccaagggagcgcgcctccgcattctcttttcgtgatgtcaaggttatttcctgggcagcgtgctgtaaagacggggttattatgggccttagccgagaagtcatccaagcctttagtgattgaagatgttcctgtagtgcgagattatcctgatgtttttcccgcagaattgccagggatgccacctgagcgtgatgtagagttccgtattgatcttgttcctggtacacaacctatctccagagccccgtaccggttagctcgtcctttccaagaagagttgaagaaacaattagatgatctattatctaagaagttaatccgacggagtgtgtcgccatggggcgcacctgttatttttactgagaagaaggatggaagttggcgtatgtgtgtggactatcgggccttaaatgctgcgacaatcaagaacaagtacccattgcctcgtattgaagatttgtttgatcagttaaagggagcgaaggtgttctctaaaattgacttgaaatctggttataaccaaattcgagtgcgagaagaggatattgagaagactgcattttccacgaggtatgggcattatgagtatagagtaatgtcctttgggctgaccaatgctccggcctattttatggaggcgatgaatagcatgttgcatagttttctagataatttcgtggtggtgtttattgatgatattctgatttactccaaagatgtagaggagcatgagcgtcatctgaggatggtactagggaccctacgagaaaacaagttctatgctaaactgaagaagtgtgagttctggcttcctgaagtggctttcctagggcatgtaattaatcagcaaggtatctcggttgatccaagcaaagttttaagtgttgtcggatgggaaaggccgactaatgttaaggatgtgaggagttttttgggtatggcggggtactaccgacgctttgtgaaggatttctcgattatcgctaaacctatgacgatgctcacacataaggatgtgaagtttcagtggacggaccaatgcgagtgtagtttccaacaattgaagcagaggctggtaactgctccggtgcttactttgccccaacctggtaaacgtttcactgtctattccgatgcttcacgagtaggccttggttgtgttcttatgcaagagggcaatgttatagcttatgcatctaggcagttaaagaagcatgagcagaattaccccactcatgatcttgagcttacagcagtggtctttgctctcaaaatttggaggcactacctgtatggagaatcttgtgatattttccctgatcataagagtctgaaatatatcttcactcagaaggatttgaacttaaggcagaggaggtggctagagttgattaaagactatgatcttaacattcaatacacaccgggtaaggcgaatgtggttgcagatgctctaagccgtaaggtcgtttctccaactgtgagttgtttgataactgattttgaacgnatgnatgntnngctaaaggcgagtgcngacgtgtccgct

SEQ ID NO: 18311 - DNA, 1676 bp, Oryza sativa
  unsure (1)..(1676): unsure at all n locations
tactgattttggacgggaggaatatctcttatggtatgttgaagtggcaagtaccgagtcacgagtcattcttgagtccgtcatacccaacgagtgctagaggcccaacaacacgatcggctgctgcaacaagttaagaaacgtgtaaaggaaggaaaaactggagatttcactttggattcctcgggagctgtgcgattccatgggcgtttatgtgttccacaaaaagctaaagtcaaggaagagattttgcgagaagcacaccgaacaccatatactgtgcatcctggggagaacaagatgtatcatgatctgaagaagatctattggtggaagaggatgaaagtggatgtggccaagtatgtggcatcatgtggggtatgtcagcgagtaaaggctgaacataagagtcctgctggaaagttgcaatcattggaagttcctgtatggccttgggatgatattgctatggatttcgtggttgggttacctcgaactccacgaggaaaggacgccatctgggtggttgtagatcatctgagtaaggtggcacatttcattcctatccgcaccacttattctgcgagtgacttggcaccgatctattcacgcgaggtagtgaggttacatggtgtgcctcgctcgattgtttctgatagggatgctaagttttcttctaagttctgggaatctgtgcaagaggcatttgatactcaattgaaattcagtacggcttttcaccctcagactgatggtcaatctgagcggactattcaaactttagaggatatgttgagatcatgtatcctttcatggaaaggcagttgggaggatcatttgccgtttgtagaatttgcttacaacaatagtttccatgctagcattcaaatggcaccatatgagtcactttatggaagaaagtgtcgatccccattgtgttgggattccataggggagagagctattttaggacccgattgggtacaacagaccacataacggatagcagaaatacgacaacacatgcttgcagctcaaagtaggcagaagagctacgccgatgtcagaagacgagaattagagtttgaagtgggcgatcaagtacttctaaaggtatctccaaccaaaggtgttgtgagatttggaacgaaaggcaaactcagccttaggtatattggtccattctcgatagtggaaagagttggaatcctagcgtatcgccttgagttaccagagtccatgaaaggtgtacatgatgtattccatatttccatgttgagaaaatattgaacatcatattaccgtagagccgatgaccattgagcaagatttgacatttgagtctcatcctgtaagaatattggaggaatctgagagggtgctcaggcatagaactatcaagtatgtcaaggttctctggacgcaccagaccgagcgagaggccacatgggaacttgagtcacagatgcgggagaagtatcccgagttattcacgtctggtgagttatataagtcctacctatgagttcctttctatacttgtccgaggtataactggacgaattcgagggcgaattcgattgaaggagggaggaatgtaatatcccgtgttctagagtatgattaggcgaattcgagggcgaattccatcgaaggggggaagaatgtaatacccn

SEQ ID NO: 18312 - DNA, 3826 bp, Oryza sativa
  unsure (1)..(3826): unsure at all n locations
ttggnnattgataatcgatttacagnagtncatcatatttaagaaccatgcgtagccatgggagtgcaatttggatctttattcatgatccttgagaagcgctgatcacgcttgctcggcttaccggtaatgctaagaggatattcacacctgcccgggagggaactactatcttttgacttctttggtttaaaaataaagtaaatccaacccttcatgttggtttcttaatgcataaatcatgcgtatgttttactagttcaagattgtacttgctgagtattctttactcactcttgtgtttaatttggtttttaggtacctaatgacatcgatcggcatggggcgggagtagcacccttggactacacattattattgcatacaattaaaattagttttagactataatttttgctcagcataagttttgcatagaacttgtaaaggtcatttaaggttctgatccttatttttcacgtgggatttgtggagttaggatggtttggattgtgtggtttatatcagtattgacctttcttataactgcctgtcgtgatgtccgtatttttaggggagactctgccgaaatttctaataattttaggacttagttttttagtgtattttggtgtggcattctaggtacgtggttacttggggtgttacaggagcggaggtggatgggaacaagggagatgtatgggtgctagctagtctcgttgaccttgtctcagtggctttactgctgcaaagttggagactcgttttcagatccaacgccctgctccacctccatcatttgttgggaccctcagagaggatggaggtggggccgaatggctcgaggtcatataccctgtggcccgggttaactttctggtctgacatgaagatggcagtgccgaagctaggtgaggaggccaccggtgccacaaggaggatggcatgctccaaatgtagatgacacgacctaggtggtggtgatggcctcaagtttgttcgccatcaccaccgctcggccccttcaaggggagacgacgtcgagcgggcctatgccaagatcttgcgcccatttgtgcgaggttcgagcaaggttggggaaagaaagaggggaaaataagagtaggcgttgatatgtggaccttataatttttaaattttttttccttgtcacttacatgtgagcagttagtcctacatctactttttaatacctggatgctgcatcagtcaaatcaccctaaaaaaagcctcgaagagtttgttttgtactggattttaatatttgagaaggcgatatattcggttttgcggtggtgtacaatcatattcggccaatagtccagggagtcaaaatggaccttttagtaaatagtaaattcattaaccgggcctatgcaatgtaaagcggaataagttcatttgaggtcccttaacttgtcaacgaatctgattttcgtccctcaaccagaaaaccagatacaacgggtccttcaactatcaaaaccggtacagattagatccctcggcggttttgactgacgtggcgcctacgtggctaatttgactcagtcttcatctgacgtgacattgatgtagcgtttacgtgacaattctatccagaaaaataataaaactcgtgggatccacacgtcagtttcacacacaaattaataaaaaatggtatcatcctcacccctcctcttcctcctctctccccatctcccctctcttcagaaaagctggtccattcgcgggatgatgggctcccgcgctagcatcacgaaccgcaccatgttcccggagtcgtcctggatgccgtcggcgagcacctggagcccgtacagctcggcggcacgggatgatgcgatggcggcggtggacgagccgccggatattgttctacacctcccgcgccttcttcctcctcatcatcctccagatcccgctcttcatgtcgcccccttctccctcccaatcccctctgatttagctctgtttccgtgtcgatcgtgtggtcaatcttagcaaacgagcaaacaatggttgcctcaaaatagatcctgtatgcatatcactacttgtagctagtaggtttgattatagtgcatatgtgcgtgtgatgagttctcgacgagcaggacggcgcggtcggcgatccagagctccacggcctggaaggcctcctcgaactggtcgcaggggatggtgttgcaggtggtctggcagtgggcgcgggagaacggggtagcgcacggcgggcggacggccgtggatctggggatttgcgcggggcgcggcgctggcgaggtttcaatcctccagaggcgaggtgttcgtggctggaaagggcggcgttgcgcagccgttttgacgatggtttccctggcctaccggcgagcgcgcaagagagagatggccggcggccggtccactccatttcgtcgtcgccggccgcatctggtgcccatccccccagcgcaagagagagatgaagagaggggagatggggagagaggaggaagaagaggagtggtgagttggaccgacatatggggctcacgtgggcccatctttttttaattatttactctgtgagactgacatgtgggtcccatgggttttattatttttccggattaaattgccacgtaagcaccatgtcagatgaagaccgagtcaaattagccacgtaggcgccacgtcagccaaaaccgctctcaaaaccgccggaggacctaatctgcaccggttttgatagttgaggggcccgttgtgtctggtttttcgatcgagggacgaaaatcggattcgttgacaagttaagggacctcagatgaacttattccatgtaaagccgtaaagcccatgaggtccgtgaagagcagaactgggcctcctccattccatctcggcccaaatcgcgactcgactagctcccccctagctagggtttcactacataaacacgctcacgacgcctctcccctctctctctctctctctctcctgcctccgcttctctcccccgcgccgccgccgcctccaccgaaagcagcagccgccggcgagccagccagcagcctagccatgtcggaatcgaaggccgccgcggcggtgaccctccgcacccgcaagttcatgacgaaccgcctcctctcccgcaagcagttcgtgctcgaggtgctccacccgggccgcgccaacgtctccaaggtgcgtttcgtttagggtttcgcccgcgtgagggtgaggggagggggagagagcgaggctgatccgctgtattgtgcgcgttgtgcaggcggatctgaaggagaagctggcgaagctgtacgaggtgaaggactccaactgcatcttcgtgttcaagttccgcacccacttcggaggcggcaagtccaccggattcggcctcatctacgacaacctcgacgccgccaagaagtacgagcccaagtacaggctcatcagggtacgcacgcatcgctcagaactttgtgccatcactctgcattctgaatttgggattgagctagcggaatggtggttgttcgcctcagtgctcggttgtgtatcctatcctgatgcgcgaattgacgcgcgcacactgtaccagtaagtccttgttcggttaggcttggattcaatccgggctaatccaatccgagccgggaatgacaagtatagtaagaaatttatgatagatacaatgagagaccgggatttattccgggccgggaaccaatttacttatgatagagacaataagagatcgggaatgatganctnctgtnccantagatangccattcatggccac

SEQ ID NO: 18313 - DNA, 6983 bp, Oryza sativa
  unsure (1)..(6983): unsure at all n locations
agataatctggcctttgtttggggcgcccccgccccccaaatatttttggtttttttaaaagcatccttaacagctaacaatattgatcctccaaagcctatttaatggtcattaaaaagattaatcctttatatttctctaaactccaccagatcatccatattacatcctctaaatcttaaccctctaaaattttaagagtaaccttcacctaccatccatatatattaatttttcttttttcacctttcccttatcttattattcaccattcactcgaattntagaaaagnggngcagaagaagcgggaggaannnaagnanaacnnnncnanngcnnannnnnngannannnagnnnnnntcttactatacttggcattctcggctcggattgaatccaaacgtaaccgaacaaggcctaagctggtttgctagcatttaggattattttactttggattttgtgagaagcagttaggaagttgtctcgtgatgtttagattagttttctgatgtggttaataggtgcagctactgtccgttggaaacggttgctttgtttcgagaggtgttctgggcattccgtgtgaagttaggtttgggaatttggtgcgattagtcaaatcgtgtctcgcttagcacttgcacaggtagtttagccaaggttacatgccagttattactccctccgtattttaatgtatggcgccgtcgattttttttatcaacgtttgaccattcgtcttattcaaaaaatttatgtaattatcatttattttattgtgacttgatttatcatcaaatattctttaagcatgacataaatatttttataattgcacaaaaaatttgaataagacgaatagtcaaacgacgttagaaaagtcaacggtgtcatatattaaaatatggagggagtacattttagtgcaagtgaagtgatagctgagtgagaatcttagtgtcaaagtaatggaggatttgggaaataaactgcgttcatgctgaattagacctagtgggcatttatacatcacaacacatggtactgttgccctttcctttttctagccttagtgttgtgatctatatatgccctttagggctaattcagcatgaacatagtttattctccattcctcaaatcatccattacttttgacacttaaaagtatatcaatgtataactgagggtcggtttggtttgttccttgctaaaattttggaatgccaaattttggtgcggcttattttggttgcaaccgcactcttaagacaaccttaccagaattatgggaatgcccatgatcctatgttgcataccaaaattttggtggcaaaccaaataatacctatcccatctctaccctaccaaaatttggtagtgccattacctgacattagcaaattttggtatggtagagaaccaagccagccctaaatcagctacaacattccgtggatttcatttgggataattggtgatatcatccatgattagattggcactctggaatttgccccatactagaactactcccttcgtttcatattataagacgttttgacttttttctttaagttgtaacttaaagaaatttgacttagaaaaaagtcaaaacggcttataatttgaaacagagggagtaattgataattaggtctagaaggtggcaaatcctttgactacccaatgggtggcatagaaaatggacgcgactccctgaatgttgtgtagatggcccaagtagattcttagggcgagttctaaacagcaaggggaaacagctacttcctcgtcctctgtgagcattgcttcccaaactgctaaataatgtgtttcatgcaaaagttctctatatagaggtttcttcaaaaatcaaataaatcctttttctttctagtttttaacaattaatattcaactaatcatgtgccaatggcttgtcttgttttgtgtgccataaaaaacactaggctcagttcggaatgagtgttggcttgaatttttgatggcacgcaaaacgagccaagtcattatcacatgatcagctgaacaagctgtagaagagatacttctgattagcttatctagtgatatgtagtttgggtgcattgtatattagtatatactctattcctttaataaggtgtattataaagtcaaaagactaagtgtatactttggccactagttactcataaactaatttgttaatgagtacataactaaattatatgaaaatacattgccgtataattctattcgtatagtttctacatgttaaatatacttgtaatttgagtaatagtggttaatgtttataagcttcacttatataaacttgataatatattaatattccttataagaagaaacagaggaagtaggtgatttgtttaatcagggcttgttgtatttcccttgggatagtgtggcttattgttttggatgttaatgctatctcaaattcacactggtgatacaaactttttatctcaaaacaaaagaaaattagcactctagtatgatggaatgcaattttttatggtgattatctattgatttaagataacaatatactatggcaaaaacgcaaaatattttagtatggaaaaccagttttagtgacagtcattatcagcatatgcacttctcctgcttggtactgaagtgttgctttggctacttgcttgaactgtattgacattatggtacacaaaatacacattatacctttggttacttgtttcatattattgattgattcatgtgaaataggaactgcacatgcaccgatgtatgtggagtcattgacatgtttgaatcactaatgttttgttattctccacagaatggtcttgccactaaggtagagaagtcacgtaagcagatgaaggaacggaagaacagagcaaagaagatccgtggtgtgaagaaggtcagtaccaagtatcaacccagcattttgagcatttatgttaacaatattgcaatagtatttaggtagcttcaacttcagtcttcagtgcgtgacctaacttcgtgttatctgctaattttgtagacaaaggctggagatgctgggaagaagaagtgagagatgatactcatcttgcagtcttgatgtgttcattatcaaaaccttgctttgtttagagctgtctccttgtggcaatattactgaatgcttaattataactagaaaaattttgccacttatgttcttgcaatgttgaggcatctgtagtgttcttggattttgaggaaatttgtcggactctagcatatatagtactttaatcacggcgcatgttctttgtgtcttctaattcagatttgggttatcctgtttcaacaatgcaatgcgtggcttgggtacgaggcactgcaattaagtcgtattttgcaaccaattaagttaccgtgattagtttacataattaaatcgacttccgttcggtaaaacaaacgaatatgaaatactccgtctctaatctcaaaatatgtgcagttttgtattattcacattcttatttgaaaatattttatgattattatttttattgctattagatgataaaacataaatagtactttatgtaaatatttttaaatttttcataaattttttaaataagatggacggttaaatattagacacggataactacggttggataactacggttgtacttattttggaacattttaggacggaggtagtaattgtttcgtgtcggcatcagataacagtacgttgtctctagttacacgagagcaagtgtgttgcttgaacattaggaacggtactgtcctaataatactgcaagttctcatccactgttgcaaatcgtcccactgggatgattttacagaaaccaccgtcgtatcattaacaggttaataagcagtgccagtttgtcgattaacctggtatgagatcaactccaggttgtttgtcagtgaaatcccaagggcaatttgcgactattggttccccatatacactagcagttcatcagttgacatgaaaaactcagaaaccagagcttccctaactgatcggaacacatagatgcatcttgcaggggataggaaaggaaacaactgatcaggatccacaagactagacgtaaataaactacgtcaaacaagaaaactgttccttctcgctgcaaaggaaaccatagacctgcttcaagtttcctctagatggtcttgcattaacagcatatttgcaaacaaaaaccagcctcttcctcatctccaacttcgtgacgtctcctttcagaaatgaattgccatgatcaaagaatccttggaacaaagagcaattaattaaagatacgtaaacttgatgtcgtgaaattattaaattgttggaacatacctaatcttctataaaaataatttgatatcgagagcattattatgttttgacatgatttaagatgagtagaaaactgataaaaatggcacaacaccacaaaattacctttttaattcaagagaagcaaaattgatacaaagataagtcatcttctaaaataaagaagttgtataaatatgcttaccatcgcaatcaaataatcgtgtaattatcgccaaggccacacagatgcttatatcctctcctgtaagggaaataaaacaacaatgaagggctcacttgtacaaagaactgtcaggcaaacttatggttttacttattacagcatgatgaagaaagcatgtgtaagctttttcagatagggaaatgtgctagctttaccattttgacagcatattagtagcttcttccctgctatcaaattcctgtttgcaaagctaactgcttttggaaggtttttcatcaacgaaaaccggtcgtcctttgatccctaatagcataaaagtacaaaatgatgacaatgtttacatactgggaaaactaaaatggtcagaaaaatttcacttaccaccataggtagttcaaggtaagaattctctgatgaagtcaaaggtaaatttgatgtgctgtcacagttcagtatacaatccacttcagctaaggaatctccaactgcatagatcatgcatacagaaaaaaaaaaactatcatcaacagtacgcctgcatcatatgaaactttgtatgtatcttgaaacaacaaatttgattaaaggaaggttctaactagttgatatctatgattctatccacatctacataatacaaaaacttgtagacaggctagcacacttttttgcagtatacagagatatgcataaaagaatgataaacagacccgctaaagaacaaaaaaaaaaaatcaacagatcaacgcagtacatgacaagatattgacaagaaagcacaaacaataataaaacaaatatgcaactgtataaataatcatgttttgtaccttggagagttgatgctactgcaaggtttgatgtcccaatccagaagagtatatggccatcactggaattttgtttgtccatagcagtaacggtaggaggatccgagtccattggttgcacaatacttgtatgatcaccattactgaaaggaccatcatggcttgaacacttcaaaggcttagctgtaatttggggagaatattcgcctctctgtgcacgatagaccctatctttttcaacaatatctgcaactaactgattacaaaggtctggtccaccatcaagcagatcatatgagtgcttccagaataatgtaggagtgagaccacgtgcccaactctcttcatcatctccagctccaggaatatagtgccagctgaactctgaagtcatcctttgtgtagctactgcaccagatgcagatgctgaaactaatatgataggggtgaaatcccatgattcaagctctggaacttcatttaaccatatccgtgtcctttgtgatatccacaatggacgtagtggtttcttcaaacttaacgcaagagaacgaatgtctgcaccacatgattcaaattgggttgtccattcctcgatacgcccctctatagcatttttctcagtctctagaacccatacaggaagatgcactgagttatcccagtttgatgattcagagatcttttcagcgtctttgttggctacagcagctgactaacatgcaaaattacaaaatatcatgaggatgggtgaacatggaaagtttgaaattcaaacaaagggacaaatgagaagaacaggaagaaaggatcatataacaggaagaacaggagacataaatcacattgtgaatttcaacagccttatttctgttgtttgcctttggttctctatagtgatcacttgggcccagattttggcatactctaaggatagtagttactagttaccaaaacaggcatcttatgcatttttactgtacaaatttaactatatcaatggaaagccgtgaaatgaggtacatgtgcacaagggttatttactgtataaatttaagtattaaactatagcaataaaaagccttgaaatgaggtaaatgtgcacaaagggaaagggtagagtgacataatgccgttccagtagaactataggaagccgatataccaaccacatccaaatccactccacttaccttgttgttagtctgcagccgatacctctcaattgctcggttgaggacacaacaccaaatgggtatggtctttgacatgctgtcagggaaacgtttccctctccttgttgaatcaacaattatgcaccctcctctctcccctgcccagagaaaaaatagacaaaaacaaattacttgtgttaaaggcattttgcactcatcaagcatcatatttagcaagtgaaaattcttgaaaaaaatcacaattacatgaattattaagctggatattacacaaccttccgagaattcgaattattcgcacagccacactgatattatattacttccttccgttaaaaagtttgaaacgctaacttttaatattggttgccat

SEQ ID NO: 18314 - DNA, 22320 bp, Oryza sativa
  unsure (1)..(22320): unsure at all n locations
gtgtgaaaccttgacnatgactgaacactggcacanagcnncataatgtgtttgaccattcgtcttactcaaaaaaattaagtagttatttattcttttcatatcatttgattcgttgttaaatatactttcatgtacacatatagttttatatatttcacaaatttttttaataagacgaatggtcaaacatatgctaaaaagtcaacggtgtcaaacatttcgaaatggagggagtattatatactgaaatgttcgaactatttgaccatggttattcgaaataactgaattagcaaacaatttaattataccacctgcttcgacaggtaaaacggattgcagtgctaaactctagttctagacgcctggattaaacatatagcatagtttagaccaaatacttcaacaatgagtaagggggggaaccaggagcagaccagcgaggagggcgaggtggaggttgaggcgggcggtggaaaaggcccagttgcccgcgtgcccatcggtggacttgaagtagcaggtggcggcgacggcgcggggcggcaagtaccagagcccgcagcggaggttggcgaccagcggcagcgccggccacagcgccgcgatctccgccacgaacgcggcgtcgtccgccacgctccgcagcgcgttgtacagcgtgctctcccgccgcttgatgcgccgcgccgccttgtagatgctcagcgtcgacggcccagcggcggcggcatccgctgactccgacgacgccgccgccgccgccattggagagacgagaaagagagagacgctggcttgtcctaatttgggctctctaaactggaaatagagtgggccaaaacccattaataattagcaaggttatgggcctaatttcgttctatatggtgggcctctttaaagtcatggtccaaatacggcccattttctgctgatggtggtcgttaattaggtccattctggatgatcagcctaacttcggctcgtcagttggaagacgaaatttttggggaataagttcactttatatccctcgagatagggtcgagtttaatttgtatccctcaaccactaaactgggtattgaacgtcccccaacatttaaagccagtgcaaatccagtgagaaaataataaaacaaatatgtgaaggacacatttatgtgggtatatggctaaaaaaatggatccccatctcataaaatatatggttcaaaaaatggcttgagaaattcacgcaacggttcgctgaggtgattgatgcagcccccatctcgttctctggcgagtgcaaggtgcagaaggcgcaccctctcctgctggtcaccgttgtccaactcctctcttgctgcccaccgcccacatctatggagggagaaggcgatgcatggaggcacgctggccggaggtgaaggaggtgggatctcccactgacatgtgggttttttatctttttatttgactgatgatatatggccccacatattttgcttaaacttttataattttgcttttagtgtcatgtcaatgtccagtgggatgaggaccaagtcaaaccagacatgttgatgttacgtcagttaaaatcgtctagggaccgtgtttgcactggttttagaaggacatgattcaaactcgacgtcaagatgagggagctgaaatgaacttattcgtagttattgcccatgtaaaattagcggtaggcttaatctcggcctgttgtttgcccaattttgtttttttaagagcatcctcagcagctcatccatattcgatcctccatatgcctatttagatggtcattaaaaaagattactcctttatatttctctcaactccaacagatcatccatattacatcctctatatcttatcctcttatattttaatagtatacttcaactaccatccatttatattaatttttcttttttcacctttcccttatcttcttattcaccattcactcgaactctcgagaagcggcgcaggagaagcggggaggaagtgaggagaagcgggcgaggggcaagcggcggaggaggaaggcggcgggcaccgggcgacggcggcaagtgaggggtgatagcggctggcgaggggcggcggcggctagcgggcatagggcgacgacggcaagcggcggccatgcgcggggcgacggcggcagacgagggaccacgcgcacgctggcggcaagcggcggccacgcgcggggcaacgcggcggacgactgtccaaatctggtatgtctctctccacgattcgctgaaaaaaaaaagcaaaaaggggcaagggagctctccttcgctagctggggatgacgacgatggaggtgaggtcgcgccagagggagatggtcactgaagtccggattagagcgggagaggcggctgttgcaaaatggcgtgaggagagagacactccatttttgcctcttctctcttctaatttggcacatccgctatttttggagtgcctggtagcgcatctgctggaagccggtttttccccttctatacgccaaatgaaagatggaggatcggttagagtagctgttggggatgctctaacatagccgacggtcatcagcccagcgccccagctcattaacatcaagttacgggtccaatttgtggcctcattcgggcccatgctaaattgtttgtagggcctcattcaacgaagaagttggcccaaatttctcctgtcaacaatctcgatgggcctaactatttcctcatattgtcaggcagtttgaaacagtttagtatgttattttgatcgattttgatcagtttgcaagagtggcatcttgattcaccttggatgctttaagcaggtctaacggttagccatttcatattgtctgtgcccatggtatggaccaagaaatgtgtttgtcatgctttgaaacattgcagagggtctatgctgtagcatatttttcaaaagttgaaactgactctaaagtccaaacattgacagcctgagacaaagatgaaaaaaaaaagcctcaagaagtcattagaccactccatgtgtttcaggatgtttgtttctgtccactacctcagctactctaaaaaaacatcctgctcacatattctaaaccaattacactgagttattaacatctagctagttaattacttccagcagaaattaagcactcggtaggttatcaatgttcgctcactgtcaccgaattgtcagcttgtcggctcactccctgaagttgctaggcagtccacctcacgaatttcctgtggttttcagaatgtgatttcctgtggttttatctgactgattttgaattgtttgtttatagcatttgtcctgattaaaggatactgctggggaaaaggacacattggagcaaattggttcaaccatatgcaattcagtcaaatgaggttatatatctgctccctatatcagttacagcttgttgcagagaactactggctcactccttatctaaaaaaaaaaagaattactggttcacttgttagacttaagtagcagttgattgatatctattttcagatcatgcctactacaaattagtttaaaacaattcaaacatggtcctcgttttaattgattttcaagttttgctgcgctttcttgcaatttatatgcatatatttaccagtgtgttggatgtcactatccaaaggatcttattaaataaagtgcatgcaaaatgatggccaatattaatgataacagcatgtttataagtttagtagctagactaaaccaccgtgtaaactgcactgattttattttaaagttgtcttaaattaaacaagggagttattgttcaacttactccatatcttggccaaatttggttacctgaatatttataaatctagctaagtttaaaatatccatttattcatctgcttaattttttttcttgatccatagatttttattagataatatagatcaagcatcttctgactcagaatcaataatcaatttgcaatgaaaactgcaccagatctgcttgatggccagtccatacgtccatttcccggttgccattttttggcgccatccaagctcgtcaaaataaagctaataacaaatacatacgtagatgcgtgccatcaaaattaagtcacattatacaacgaggaatcatttgtagttgtctaagaaaaagaatcttttgtattccttcatacagtactatactttataacagagagctgatctgtttagaattgtgttccatgtttctttatgccactcttctctgaaccgctatttattctagatctgattttcttcagggattttagggaatttttgtacaggacaagacagcagggatggcacgagatgcaactagggacaaatgcagtgaaaacctataaattatcattagatttagaaatggatgtatgagatttagccacgtcacccagagtgaaaaaatttactccaagatttaagtatgaataatttttttaatggctctttttttttattcaacgacagtttctaggttttcaatacatatatgatttttcactgcatactttcccgtaaaactttattatactatgatatccttgatataactagcttgcttgaataaattttcattatattttaaaaatccgtgtagtatggccaaactacgcacgcgacggtgtgaacttgaccgtccgtctaccacagaaattcagagagagagagagagagagaataaaaaagagaagatgtaacatgcatgttgcatagatggctacgtaccttgttctatccggtgtcctgtgctaagcttttgcagtccagattctcttcttgttgttctaaattctaatcaatccgtttgccacatgcatatgcttcacaggctgcgactctctcaattggtccaattatttggtcgatcgatcgacaccggcgctggcaaacggattataaagaataatcgaattgtgttctgtactgctagctagctgttgtgtatagcctttgtataggcttgtagcgcggggttcctccacgatacgttttgagatgtatcgcactaggcaaaagtctcttcattatctgcctctcaataatctacgtacttgactcggataatcccatgtttcatggtcagcaatgtaatggaagtggcaatctttgaacagacaaatcatcacaaaaagaaattgagtatattgggctttataatttttaacaccacacatatatcttgacaacatggtttgtcccctttacattagtgacttaattttcaccggatgggaaagggacactactaaaaaaccattttcccatacagacaaaacctatttttccatgcggttgagctagccgtctgcgtcaaaagttctacgaaaatagcgatttttccatgcatatggcacatccacgtgtgaaaatcatattttcacatgtgggtgcttatgtcgttcgcatgcgtgcgaaaacaaaatactgtgaaattttttttccaaaaatcgaaaccccaaaccctagcccgccgccccctgcttcttcgtcgatgccggccgtcggaggctgagcctgccgtcaccgaggtcaccacagccaccgccagatccgcgcgcatggggagcagagcgatggctggatccacacggtaggaagagggggtgctggatccgctgtcgtcgcacccgcagccgccctcgctagatcagttgcgctacaaccagaccgcacacgtggggggggtgagcggaggccggatccatgcgggagggaggcggtggaagaagaggtggaaccgcccagcagtggaggaggtggagtcgtgcctctcgcccgccggctcccagtcgcctcctcgttggcagtggtgccactcgagatcaccgagccaactgccgccactgctcgcccgcccatccgcctgctcggaggaagagagagagagagaaaggagaggagtggtaaaaaagtttgaagtgccttagaggaaaaaagagaggaggggagaaaaaactttgtggaggagggggtattttcgcatgcagatcactcaagaggtccgcgtgcaaaaatctattttttcatgtgataccttaagaggactgcatgtgaaaataactcattttaacacgtagcccattaacagattcgtctgcgaaaatagatttttgcttgcggacctcttaaggagccgtatgtgaaaataaaagtcgatttttacatacgtgaccaatttacggtccacctgcaacctataggggtcctcgtacagaaagaacgccattagctctgtcatgttggatcacgttgtcagggttacagataaggcataccttctatcctatgacttatcaaatataccggattggtatacctcatatcctacgatatgtttccgtatgcagtaaggaaatacacaagatattatggaaaatatcctcacgggctagatactatcaaaatcctactcggaaaggataaggactattctatattgtgcagggttcgttgtctccgagttctacttagagactaaggcaactcatagtataaaaggcacacccccggaagggttcggatcatcaaatcatagcgccgacacacccagcatagtttacgaagccgaaggactcaaaccaaagccaccgggagatctcgtcgaacaatctcgacaaggatctcgccgatatcaacgagttcatttgtccctttgtactatgtggttttccatatcaattccatattaaactggattagggctgttaacttacgaggggcttgaaccagtataatctttgtctcttggctgcttcgatgtcgtattatgtagatcctcataccaacgtaccccagtaccctatttatccggtctacgaatattcccgtcgacacacgtcgtcgatgatattggcgtcacaaaaatatccattcatagaataattcttttaaggatctatttgtaaaatacaatttttaaaacgaccaacaggtgaaaaatccagcagcaccgccgcgtctgaggctttactatttatttatttttgttttttccggggttgtactactttgtagcgcgtgtctgggcgatggcgtacgggctcgtccatacacggaaaaatcaaaacgatccaatttcggaagcgtgccggtttgatgcaggcgtagctttttgtgctgatgtaatttgtcgcattagttattagtcatcgctctacgtacgtacctgacccgaacggtcacgtactcacgtatgtatgcgcgggtgccttacgtacttcctccgtttcacaatgtgagttattttagcatttttttatattaatattgatgttaatatatatatatatatatattcaataacatcaatatgagaaaatgttagaatgacttactgtggaaggaagtagtactcaacgtgacgaaagcaacacggtgtgatctgcggtttagtttaatttgcgtcgtgtaacatggttattaatttgtcacaacagtactacagaaagacgtataaaaatgatactatagataccgaaacaaataaaaccgatatgtatagtgctgttctcttccacatgaatatccgtgacaaatacatgtatctttcggtataaataggtgttggtttttataaaaccgatatcattcttcttcctttagtgggaacaagatacacatgtccacaattccacatgtagtttaattaggttgagttcgagaggtgaggtcgggaactcacctttcgcgcacgtaaaatggagtgacatattttctcatgattaattaagtatttactaatttttaataatggattaatatgatttttaagcaatttttatatagaaaatttttacaagaaacgtaccatttaatagtttgaaaagtttgaagagcgtgcgcgtggaataggagggaggtgagttgggaactcactagaaagaacatagccttaggtagggcaagtgctataagcatctaagtacaatcccatagatgccacctaagcttaaatgatgaggtggaggagagaagaggggagagagaggatgaatcacccctcatgcaaggaacaatttcttaacaaattttaaggaagaaagagaaaagagtgagactgattggatgagagtggataaaataaatagttatgtgcattaaggctagtatattagaggcaatgtggtatatgagatgtccactaatattatatgtgacaatcacatctaaacactactacacaaaagggattcggtgccggttgggaatcccctttggaaaaccggcaccagagaggcggtactaatttgaaaatcaaaaaggtgctggttacttagaatagacaccttttaggttcaacgaattaagaaaatgccggctcgatgcgtcggctcgatcgagccgatcagccctccttccacatccgcaagaacagaatgaacaagaaaaaaaattggcaacattcatcccacaacattcaaagatggattcatccacatatcaaattttggcaacattcatcccacaacacaaattttagcactcaaatttatgcaataaaaaaaatcacacctcttcagtcatcgttgcacggtcagtcgtctttgagacgtcgcgccacctcccgtcggtgaacccgccgctgcatctcctccacgatcccgtcgcccatgctgccgcctcccctctcactagatctagcggaggggagggctcctccctgcaggcaagccctctgttgcctcccctcctcgagcccgccacctgccgccaccttctcgagcccgccacctgccgccacctcctcgagccctctgccgcctcccctcctcaagacaccccgccctccactgagccggatccagccaccctgccctccgccgacctgccggccccacctacagccgacctcgcccgccgctgatgcctcccctcccgccgcatctggcggaggggagggcgcggtcgccgctgccgcctctgtcggccagccgccaacaacgggagagaagggagggggagagagagaagagagcgagagagaagggagggagacagagagaagaaaccttatctcctcgcgtcgcctcgtcgtggtggggcccaccggctcggcttgatttatgtgggtgtgtcagtttttaattaaccgacatctataatatattttaggtgccgtttttttttaaaaaaagacacaaaatataataggtgtcggtttttatttagaaccgacacctataattacttaaaagtgccttttttgtgatttcaacccgtggaggtgggaaaaggcctataggtgctggttttagcactaccgatacctatagtggcgatacctatttgatgttttgtagtagtgaaacttgccttagcccactcccatccacagttacttttttccttttcttttttgcatgaaatagtttcaatcctgtatccaacattgtcctccaatattgctgtagagctttaggccggattgagaggatacggtgaattggaagatgttggagatcaatatgctggtgcggtgcagcagagtagtagccagcctaacatactaagagcaagtttaatagtacagcccactactagctccaattcatttatagccaatctaatagctaatttatacaatagttgcttactatactattaatatatggtcccacatgtcatacacacattgcgtcttggagtccatgctgcagctggctacagatctatagcctgctactcttctctctcatccttatctcattaaaatatatttacagctggctaatagcctgctattgtacctgctctaatgcacgtagcgcgtgtgctttttgcatagttgcatcggtaatacgcggcactgtaacgaatgcggctggtgatgatagatcaaccgtacgtgtaggtcctctcaaaaaaaaaaaaaaacgtacgtgtaagtgtaacttgtatactcaaaatctctatctcacatgtacgttacatataccctataaaaattcaatataatacaataatccctcattttttataattttatattataagttgtttgactttttttctgttaagtttaactaaatttatataaaaatttaacaacaactaaaataaatctaatattgaatatattttaacaatatatatgtttctttttggttgaaaataccactatattttccacacaactggcctggatcggatagatacgatcagatccggacgggccggcctctcaacgtgtaaaaaatcactggttcgacctacccaaaattgggttttgcagggagccatccagctgcacataccggacgacccacgtatggctctggtcccctcccccaggcgatggacgacggtgactgcacagtgatctcatccgatcccatcttctgtgcagggatagatggaggatgatagctggtagctgtagtacgtggccaagttgcacttgtttgtactgcacattgtacatttgtacccacacacatacagtatatagtgccattgttgatctcgatttctcgaatagtagtagcaacatatatacgcattaacgtggcacgaactatttggccaatctttgatggagaggcgaactttggctccttcattccttggatggaaaaagctctcgcgatcgcgacgctgacattctctccggtagtggtagcagtactagtactgtgatgcgcagtctggcagtgatagatcaaggggtgctgccaaacagctcaccccgcaattttcctggtaaaacagtactccctccgttttaatttcaagtttgattaagtttacagacaaatatagtaatatttataatactaaattagtttcatcaaatcaataattgaatatattttcataataaatttatcttaaattaaaaatattactattttttcttacaagtttgatcaaacttaaagcagtttgactttgactaaagtcaagacgtcttataacctgaaacagaggtagtacatacatgcatagcgctagaatttttattgattattctaagaaattgatgtgtgcaaagtttggaatgcacgtagcatcagattcgtattttctgttgtgggagtttttaatttatcttggtggacaaatatggatgtggtcgtgaaggagggaggaatatggtatggacacatatcattcaatcctcatgcgaaaatggtggaataattccacatgatttttaaggactagaaatgaattgaatgaaaatcttgtaaaattcttgacttaaagaaacccttatccatatgcataaaatttgatctcatagctagaccaaactcatttgtttgaacagagttcaaaatctttaatgagaattgctcaagcctatgattcacttttcgaaaaaagtgagagagggggtggggagggggcagtgttccaaaaatagccgtcgcctttgccgattgttaggtgctcagcggcgagtccctacccgcgatttgcccctagtcggcgtgctaggcggactagtcgccctggcaagggtttggtgctgctcggcggacctcgtgcggaggtcacacatggaggcggtggggcttgatgcttctcagataagctcgtggaagtcttctcgcacgtggcggcgtatgtatcgatcaggaggagactagaaagaagaattataatccaatgacctttatacatcatggcccagttggcccaggaaaacacgtggaacacgagggttttctcttaatctggtccacccctcctgcatggaacacaaggaacacgaggggcgtctttgtcttcctcttgtagcgaagggcatcgacagcggtgagcacggtaggcatcctcttatgtcgttcaaatcgtcttctttccctcttcttataccctctttctctctgcttttctccatctccctccccagcatggccgatggtggtgtcgcctccactagatttgcccctctggtcctccttctgcaagtctacatggtcttttcccctcctagtcgctgcctcgacaggtttaggcgctaggcactggttagccgtccgaataaaaaacagagaggaatttcaaaggatttaaatcctattggaaaaaaaaatcatatgaagtcctctggaacaaaggattgggtcactagaattctgctgaaattcctatggaatggcatgtttttttgggaatttctctaaagttcctatcaagagctccaaggtcttggatttttttccatttgtgtctatctctcttctaaatcgtgtgttttttcttaactccatccaaacattttcccgtgtagttttcatgtgtttttctttccataggatttaaggtgcaataatattcgaatcttacgttcctattcctgcattttaagaatcctatgtccaaaggagtatagagtgcttagggttagttcaatttactagttcataagccattccccgcacagaaaaatggtagctcattagtgcatggttaattaagtattaactaaaaacatttcaaaaatattaatatgatttttaaaacaacttttctatatatatatttttaaaaaaacaccatgtagaagttcagaaaacaatcgtgcataaaacgagagagcaaaagatgggaaaggggagtgcacaccctaataccacatactttatgtagtatcaaatcattaatggttcaaatctactacagattacaaaatagacaaatatattatacaagttgattccacatcatctagatatgatttgaaagattatatatatagacattagcattttgaaccactgtttatgcccttaaagggtatcatttgctcgctttagaaaggtgagagcatcccaatttttttcacaactcccctatgttaaaaggatggttgtggtatgtgtgcttcttgatctatggtatactagcaatcatagcatcccatgagctgttttagagaccaaaccatgttctggtgattgcaaaaataattctacttcattcgatttcaaatgcaaatcatgttagccattaactattttctaaataaaaaccatttacagaacatctagtcattctttaatcttttttcttggtaaataaaatgctacctactcaccggtaaattttttgaataagacgagtggtcaaacagtacaagcaaaaactcaaaatcccttatattatggaacagagggagtactatagaagcaattatattttaggagcgagggattagtgtaaaagaacgacaacaaaagccactggattaattttcttaattcctatgagcaaaattaaaatggcaaattatctgtaatcatgacagttaaaatagttatcaaatatattaataggttacaattgaacttagagttacaatagatgctatgaggtggagtaaaaagtcaaactttgtgactcaacaactctttaaatagagaagggaatgtcacaacgtaaccatgtcaactggaatacaatatagcgtagacatgcaggaagataatgacgacaaggccataaactcgtagcggagatgctatgttgatttagaagaaacgcctatagttagaaccatgagatatgggttcggttgaaccccgttaagaaatatcgtgcgttcctatatcataatgtagtatatctgaattgaacaatagttgcagtgatcggaaatgttagttgtcattttgctatatcttgctatatcaactaacttttataacaattattattttattggcaactagttatagtcccgtgcagtcaagtgcattgcaacgatttctttatccaatttagtgaaaagatttgaccagagtgggttgattggttttttatatcatgatcggattcttttaagaaatcggtttttacatgaggaaaatggtttcttttgagaaagtgagggaggggatgaggggtggatgacttctttttaagtactccctccattttaacaatgtaagtcattctagtatttcccacattcatattgatgataatgaatctagatagatataatgttagaatgacttacattgtgaaacggaggtagtagtagagagacagtgataatggttggattttagaaatcaggttttatatgaggaaaattttttttaggaggaagtgagagagaggatggagggatatactatagagataaagataacgatagaaataaagataatattctgccagagattccacttcattaatacttcggttccacattccacaggaatcctgcaatgaaaaacaaaaaaaactgaatctctccaaccaccattgatttccgatttcagagcccatatttgacctccatgcatttgcaatcaacaggttaaaacggaagccgcgtccattcaaatcgcttcgataaattgcccaaaaacaaaaaaccgaaaccaaaacagaaaaaataaaaggtgaacgagggaccctgccgccatacgcgtcgagtaccattcacttgtagtgtatatatactgccaccattcactcgttccccccgcatcgcatcctctccccacacaatccccacccggcctagcgagcgagagagagggaagggttgcgacttgcgactcgcgagcggcgagatggcgaaggacgtggagatggcggtgcggaacggagacggcggcggcggcggcggctactacgccacccacccgcacgggggcgccggcggcgaggacgtcgacgacgacggcaagcagcggcgaaccggtacggatcaaacccgaccccgacccctcgtgattcccccgtctcgttaaccctcctcttctcctccctccgccatggatgatgatgtggctgtgctgttgtgtttccgtgcggtgcgtgcgtgtccttgtggtggattggattttttgcggtttttgcttcctatttttgggcgcatatatgcccgctttatcaatctcgcttagagtcgagtggatcatcctactcatcaaaagggaggtctagaaacacggtgcacgcgagatttctggtagggaaaactccacgaaaagttggttcaaattcgagacaaagtagttcgaattcaaaaaaaaaaaaccgaaacgtttcaagggatcggaaggcgtgaacaaccatggtcctagctggacccttgtcatctcctcggtttctgttccaatctagcgagcggcgcggcgccgcctcggatggatttttggttggtgctgactgcttgacttctgcgttttcttcctcccttttcccggaaactcccatggattttggttggttggtggcgctctggtgcggtaggcttcgtccatagccaacaccgccaattaagccgccatgaatggacatcgttgtgcgtatgtatcgtggtaaaaaaaaatcgaactacagtgttctctgtgaagtgaaaccctggagaatttttactgcgttcaagataaacggtgtgcgcttttttttttgtgtttgtgtttccctttttgggttccccaacggagcgcatgcaagcgtccggcgacgtgtacgctgggtttttttttccagcacttcgtctagatctgtctgttcctagagtccaaaattaattaattaattaattaagtatgtagaggttcaaaattaattaattagttagtggaagcacgggaggtatggtggtggagtcgtggacacttcacacattaggattaaaatccgtgcatgaattttagtgagatcaactatatatcgcttcacccatcaagactaaaatcccgtgttaaggcttgtttagttcataccaaaattgaaagtttggttgaaattgaaacgatgtgacagaaaaattagaagtttgcgtgtgtaggaaagttttgatatgatgaaaaagttagaagtttgaagaattattttggaattaaacacggcctaaaattttaatgagatcagggatatatcgctagtttattagttttcatcttttagggcatatattagggaacatatttataaaaatgtgtgggttttcgagtctatttgaattgtttccctaccaattttttgtagtgccaaaatctaggcaagttttggcactaccaaatatttggtaaggtaagattgttttttatcatatttggtttgctacaacatagagtcaaaatgtgaaattgtagtaaagaatgttcataatgccaaatctatattaggtaggagtaccaataaatgggcttcaattcaaatcaaacacaagtactatttaaattaccaaaatattggtagggcagtttttggtagcaatccaaattagcccttcatcttttagtgtttcatgtgtatgtgtatgtgctatctaatcgaaaaaaaaaattagttaatcaagaattaactaatttttatatcacgtgaataatttggcttgcgccgttccgcgtcgtgcgcgctgtcggatgctggatgcaagaggccagagccaaccatccacagcacctagcacagcagggggtcgcgcgctggtcaacagccgcgtacccccacggtcaacgcgcatcagccactcgatctgaggcatgcacggtctagatgatgccacgttcgcaataaaagctccccctgatcaacaagtgacgtgctgtttcacggagtgtgacgtggcacgggcagtatagtacgtgtacgtgtgaacacacgcgcatgcgacagcgcatttccacgcgtgcaattctgactcgcaaaaagcgtatagtagtactagctgcttttttgcaatttgtattccttgaacggcacaacgtgtttggtggaaaattcataaaagtcaccgtactttttgacgaaaaacggatatatgcttggttgagcggtccactttaagctaccaatatcgattatcttatcgttagtcagcttcagtgagatcatatctaaagtaactggtgctgaactcgtcaaggaatcattccggcggcctgaaagcccctctttggatggctctgcgcctctgcctggccgcttccgatcggccggaatctatgtcctcgtaccttttacgcagcaccaactgatgattgcgtgctttcaacatattttggtttggaacgcagtgatctcgtattttattcgaaatgcgtaaaagctttgttgattctacggaaacgctctttggtttgtagaaaaaaaacccttcatatatcttttcctttgaaattcctttgtaatgacaatcttgtaaatagtttggaatttttttcataagataatatcatccgacgtgactagggattttaagtttttgtttgcgaccacttatcttatttaaaaaatttgtgcaaatagaaaaaacgaaaagctgtgcttaaagtactttggataataaagtaaataataaaaagaaataataattccaaatttttttaaataagatgagtggtcaaatagtgcaaataaaaactcagaatagggacggagggagtagtttctaaggcctggtggtcggcatgaaccaatctttttttttttctagctgtacctaaacacctgttttaaagttttctttctcgtagaatcatactgtatgtagaattgaagaaactatgccatcctattcatgtgcttttacatactcttccctattcttatgttttgagttttcttccttctagagggcccttgtttctctgtaatgtgaagttctttagtgccaactgccaagaccttaatcacggactaagggtctgtttagcggagtttaaaattctgatcaacaaccagctggtagccaacttctaagaatctggaaaaattagattctataactacagcttctcagaatttataccaaaaactgatctatttaggggagattctgattctggaaaaagctgcaggagctaaaatctcccttaaacgggctctaagtggatccactatatatatagtggacttttgtcttatctcagttctttcaacggagtactaggcacagcccatattgtgaaggagaagaaaatggccagaccttttgactgcgaggcatgggctggatagtctttgggatgaggtgaccgatgcgagggtaatagatgcgccgtagacctgctgtttctgaccttttggcgcacagctctacgcacgacaactctactccgtgtaggatagtgtaggctagtgtagcggtactgagtattccgtattcgtgctgtacaaccgtggtgtgctccctgcgtacggtggtttggggattttttttcacaaaatatgtggattttttaaaaataaagctatctaaatcttgcggagttattggaatggtattttttgggataatttttcatgacaggtattgtgcattgatataggtagtgggcctttttgaatggttaaagtgaaaatatttttcactgaacgctttctaaacgtcaatgcatttatgaatagagtagagagtactatggagtctgaccttctcagatgggagactctctagctaccgggatgatactagacctttgtgttcatcaagagatcacatgttcacatgtgtaggccctttatatatgttgagttgttgacttgtgttcttcagagggtgacagtctccatggctcaatgatttgtttggaattgtctattctgtttcagttggcatgggacatgggtcttgtactctgtcccaaagtgtgcatgtgtcctcatccgattaatcaaggcactgtgttaatcattctttagaaactcattaactgtatgcatacatagactgattgaggggctacagatcataaaccatggatgcatgtgggtattaatcattttttaccctcggtttggtgcatgctgtcactaagtggagtgaacttgttcacagttgagattatgagtaaatatcaaggagacaagaactgaaattcgaaaggaattaaagtcataaatgaaatgattgaattttcagaatgttgaaggactgaaaacttgtgcaattcgttgagcaggtaacgtatggacggcgagcgcgcacatcatcacggcggtgatcggctccggcgtgctctctctcgcatgggcaacggcgcagctcggctgggtggtcgggccggtgactctgatgctcttcgccctcatcacgtactacacctctgggctcctcgccgactgctaccgcactggcgatccggtcagcggcaagcgcaactacacctacatggatgccgttgcggcctacttaggtaaatactattccttccatttcaaaatatatggagctgttgactttaatataatgtttgttcattcgtattatttaaaaattatataaatattatttattttgttgtgacttgttttatcaatatagaaactagtcttaacttatacttttacatatttacactaaaattttgaataaaacgaatgtcaaacgttatacgaaaaatcaacaccgtcatacattttgaaattgaaatggaggtaggaataacaagctgtgtctacatgaacatcgatatgcatgcgtcagagaatttagaattttttctctgaattcagagatgtcatacgagccttgttgctgttcttaaatatgcaggtggctggcaagtctggtcctgtggtgttttccaatatgtcaacctggttgggacagcaattgggtacacaatcacagcatccatcagcgcagcgtaagttctgaagaattgatctgttcataaatcacaatggcatactacaattctccattgctttcacaactcaatgctatgcacggttctgacttctgaggttaatttgaatgatcttctacagggctgtgcacaaggccaactgctaccacaagaacggccacgatgccgattgcggtgtctacgacaccacgtacatgatcgtctttggagtcgtccagatcttcttctccatgctgcccaacttcagtgacctctcatggctttccatcctcgccgcggtcatgtcattctcatactcgaccattgccgttggcctctcgcttgcgcgaacaatatcaggtgaagaaatctttctgaagatggtatcagtgtcactgcatatatagtttgtaagctttctcatcatctccatgtgtctgtacaggtgctactggtaagactactctgactggcgttgaggttggagttgacgtcacttcagcccagaagatctggctcgcgttccaagcgctcggtgacatcgcgttcgcctactcctactccatgatccttatagaaattcaggtaagctgtgcacagcaaagttcagagtttgagaaacatttgagcaacagtcacaaacatgtctcagtttgtttgcttgcaaggtttttaagtaaccgatgatgagtctgaaaaaaatggcatttgaaattgcaggacacggtgaagtctccaccggcggagaacaagacgatgaagaaggcaacgctgctgggggtgtcgaccacgacggcgttctacatgctgtgcgggtgcctggggtacgcggcgttcgggaacgcggcgccggggaacatgctcaccgggttcggcttctacgagccctactggctgatcgacttcgccaacgtctgcatcgtggtccacctggtcggcgcctaccaggtgttctgccagcccatcttcgccgccgtcgagacgttcgccgccaggcggtggccgggctcggagttcatcacccgggagcgccccgtcgtggccggcaggtcgttcagcgtcaacatgttcaggctgacgtggcggacggcgttcgtggtcgtcagcacggtgctcgccatcgtgatgcccttcttcaacgacatcctgggcttcctcggcgccgtcgggttctggccgctgacggtgtactacccggtggagatgtacatccggcagcggcggatacagcggtacacgtccaggtgggtggcgctgcagacgctcagcctcctctgcttcctcgtctcgctcgcctccgccgtcgcctccatcgagggcgtcagcgagtcgctcaagcactacgtccccttcaagaccaagtcgtgatcccgatcacgacggccttttttttttgcttttgcatcctgatgaaaaaagatttcagaaacatatgcacaacaaatgccggaagttagccaagagtttggtcaccagctcggtgcgttggtcggtcaggaggaggagggttcaacttgtgtaggttaagaaatgctagagagtatggagaccatcttcgattgctgctcatgtatagaaaaaagaggaagcttcgtattcatgtaatgaatcggaatgtttaacaaacaaggcttgttctgaactcttctcagggacaggcatggataacagattaaagataaatgaatgtgttagacaagggcagattagaagcggctcttaagcttcacacaatggttttttctctttcttttattaatgaaaccaaagcagttgaacaattgagcaatatgattaatgagaaacgactggaggtctcactcctctttataaaattcgatacagaagttcttgctctcatatctaaccttttttttatatatatatattttgctagaaattgctttggcagtgtagaggattgtaccaacccaaaaacatgtcactagtgtacttatgcgtgatgatgtcacgctctcaagttttccccttcttctttccttaaaatttgttaaataaatcatccgaagaaatggtttgaattaacctagagctaattccctaattaataaatgcaattaataattggaattggcatcgtgggatttttcttgggttccacatgtcgcaatgcattaacatgatttttagcggaattttcagagccctataaataatttttaaccatttaaaatcatcaaggtgcaattttaatcccaggaaaatccttttcctttttcttttttcttttccttcctttttttctcttgatggaccgtcggcccatctctctcccgcgcccccatccttcttgctgggccggcccaagccgccttccttctcttcccgggtcaccgacaggtggggcccacctaccgccgaaactgcccacgccgccgcggttttccgtcctttttcgcacccccacttcgtccccaacttgtgcccacgtngttggcctcttccctctttatttacacccccacgtngccggacaaataaggggacaccccacccgtttgcgcccttctctgcctataaaaagaaatccccgagtgtaatctcttgtttccccaattggcgcctctccatacttctaccgcgccacactgtacagttagttcttcgaccgacgcgaccttcgacgtcttcacatgatggaccccaccggctatgaaacaccgccttaacttgggggttgttttttgcat

SEQ ID NO: 18315 - DNA, 1777 bp, Oryza sativa
acgtcccggccaaaaagggggccaccccaccgttttcggccttccggcgcccataaatccactccccgaagtcacctctttggttccccccattggcggtcctttccaatgccccctacggggcccaggatgtcacaccgagttccgccgcccgcggcaaacctcggaccgcgcgctgtcgttgatagcttcgccgcggcgttatgcaaccacggccgctacatcggcggtcgctggtttgccaccaaacatcgccgaagcgccgcttccctcgcacgccggtgagctctccatttccgcccaactctggccggccgctctagtcgccgtggtcatcctccccttctcctaacccggtcatcgcttttcccaggttgtgcccgaccccgtccgccattgtccgaagcgccgccgccgctcgtctcttcccgcgccggtcatcgtcgcctctccggtgaggacccccttttcctccccttccactcctctctcgtgcgcgccgccgctccccgcatgcgtgccatcgcactgcgccgccgtccgcgttgccggccgctgccaccggccggtcgccggtcaccggccgccgttcgccaccgtgtgccatgcccgggttggcctcggtgtcgcccgtccccagccgcccgatcggccctcggccgatcgtggccgtccatcccatggcttgggtggccagccacgtggtgccacgtcggcgccacgtggtacaccaccaccccggccccgtggacccggtccacggtggaccaccccctttgagccgctgacccgtgaaccccgcctgccaagctgccccccctttcgctgacatccgccctggggatttattgcgcaataattaattaaggcctttttctttattagtaaaaacatagtttatcttctaaaattcataagtaattcatccgagctccgtttaagtctattcaactgtcagtaaattcataaaaatccctagaattcattaaaaatagttttgttctctgtttcagtagtcttatagcatgttttgcttgtgtgctttgtttgtcgcgtagatttcggccgtttcgtcgatccgcggttcctcgaagacattgctgtggtctcatcagtgctagagcaaggcaagtcatgcattacaattgatcatattgtacccaatttacaaatatcccacatttctattaaatgttgcattcttttacaatgtcatgtgggatgggtcctattactcagccatatattgtttaccttatgccattgatgacttgggtatcaaaatgactagatgttggtttaggaaatgcttagccatgcctagctcaactagtacacaaatggggatcacattattacatagactttgactattagcatagctttggattggtgccaccgaaatggtgttagttaattaaaatacactgaatggtgggctgtgggtgcatggtttcgctggtcgcacccatggcaattaaggaccggttcacgggaaaccctgggagacttaccgtgcttaccacaagcgggagtgggcaactgcttgatctgaagtatagctcgaccctttcctatgcaccggtggcgagggtgggcgtgatggagttgggtcagccggggtgtcccggtgtccaactgccggattcaccgcggcgcaagaggggaccacccactgtcttttgaggggtgagggtgaaaccctaacgtggtgtggatgttaggggagggtattccgaggtcttgtcacgatttctctcctttgcagtatcatggg

SEQ ID NO: 18316 - DNA, 2183 bp, Oryza sativa
  unsure (1)..(2183): unsure at all n locations
cgggccttgaatggcatatcagatcgtacagnagctcatcaaggagaagaagaagagaagagagaagagagaagagagaagagaaggagaagagaagagaagagaagggaatgaaatgtgcagctgacatgtgggccccacatacttttttatttttttttgactaggatgccacatcagcaaaaccacccatatatactacctagggacgttgagtaaacggttttgtatagtttaggggtgaagatttctggttttgtggttaaggacgttaaaaatctcgctattaaattgagggacctctggtgaacttattccttccgtaaaaaggaccttgatgactaagtgggctccgattctagggccatacccaaaacccagcccaagattcgttttctgcgttgtgatttagcccataaagaccacaggcagacaggctcccactaccactaacgagaagctaccctcgagtccgacggagaaggggagggctaccgccttctgcgccgccgccgccgccgccgcggcaggttggccgcctccgatcgagtcccgctggggtgaggtgagctcagcactgtacttcttgtgcagtatttttggtttcctagatttgcccggttctcgcttggctcaaactcgttctatccctagcttgccccggcgcccgccgcttgttcgacaaaatggctgaccggaagaagtgcaaggcggcggcggtcgccaccacggatggcggtggcgaggaccgcatcagcgcccttccggacgaggtcctccagcgggcgctctccttcctgccctcccgcgacgtggtgcggacgtgcgtgctctcccgccgctggcgccaccagtggaagtccgtgcccgccctgcgcatctacgcgttcgatgattgccgggacgtccagcacctgagtgatttcgtcaccaactttctgctccggcgcaaccggttggctctacatgaatgcgacatcacatgctttgacgagggagacggttgtgaggtgttcggggagaacgccagacagtggatccggtatgctgtatcgtgccaagttcgggtgcttcgtgtttctgttgaagcgcacacccgtctatttggtgcgcctctcaaagcccagcgtttgaagagattagaacttttcagcgtggagttgggggccttctcccttgatttctctagctgcagggagttggaggagttggagctgggaggttgcatcatcaaagacaaagtaaagcagatcttatcagaatcattaagacgtctgagaatcgaaggatgtgattttttccgaaatcgcactcgcatttcttgcccaaatctcatttccttggagattaccgattttaccttgtacactccagtgctcatgagcatgccttccttggcatcggcatttatcaggtttggtgaacactgtgctgattcttgtgactgctactattacggcgaatttggtcccgattatactggatgccatcacagtacagttaagggcaatggcactgtgcttctcaatggtttatcagatgccatccaattagagttgataagtggtgccggagtggtacgcttgagccgccctataagaactcctagtgttttttgttgtcagctacatcttgttgacttttcttatccatccaagagaacattaagctttctacaaaacaagctatctaagtgtattgcctgtttgttgccaattaacaattgcggattatcattatattaacatgtaaacatcctttacagttgtttctgacatcatactatattaaactgtgactagcagagcttaactagttatccatgttaattttcaatacctggtatatcatgttcttgtttactatgtcttgttcatcagaagatagcaaaaccaagtacaggttataaatctctgcatcttcttctacctaataattacttgaaatataaaaaaacccctacacacagctcctgttcaatccagtatttccaaatctgctattatgaagttagaccttgaatttattctcatcaatttgtgcattgtccagttcattttcagaagggattttagatgttgccctacatttaacaagctgaaaacactgttgctcaatgaatggtgtatggctgatgaagtacttgcagtaggnggcgtgtcaatcgatnntcaatgcccggn

SEQ ID NO: 18317 - DNA, 16041 bp, Oryza sativa
  unsure (1)..(16041): unsure at all n locations
gttacacgcacgatcngcacaaatattgcaggtctcaaaaatgcaccactcaattctctttggggtgtattggttgtatcgtactacgacacgacctccccngcggctcccnnnncnnnnncngtggggtttgaancccngtttgattgactnccctgcaagnagnncatcagtcttacattgttacattgcgttcacataactttgcacagagagatggatatttgtatgaataatgaagaaaacaacattcttacatacttgcattacatccatatctataccccttacaaaagggagtagtcgtgggggttgttctgcccccccaccccccacccccccaaaaaaaaaaccaccaccaccaccaactcccaactttcttttagagtaaaaatgacatgcggggctagaggacccacatgtcaaccactcccactaaccctctactctttatagcaaggaaaaagaatagtgtgggaccaaagggcccacatgtctgtaacaaacatatacaacaattaagagatggtaataataggttaaagataattttctttaattaattaaaatcccgttgcaacgcacgtaaaatatgctagtaacctataaattctttagctaagccttagcagcattgtgtacctacattttcatgcatcttttttctgtgattgttggttgccaacccaaccatgaaaagagaggaaggtgtcttgtgcagcccatcagggccccaagagtagtccacctctctagggccgccggtactgtacatgaacagtaccatgtggttactgtccatgcgtggtactgttcaaattgggtgttgcaacagagataagattacatttatttgttatctatttccttaatctgagacataggtttcctaagggtcaagttctcccatctatgtaagggtgggtatgtatcttatttgataagtttgttatgggctttgattaatggatagggtaaaaggtccaaagaccgcgataaaggtgggattgcactggttggcgtcatgtttgcctgttgtgccaggagcccaggacctcaggagactctgatcaagttagccgaactttatggttttttgcttaattcccgatggggtacatactagccacatagggcctgtagggagaacactttacatccaaggaattaatgtctactatcagagaaaccaatccgatctctatctctaatttgctaacaaatctcatccattggctaactagataatctcctatctttatttcatttattcttaatttgctaattgacctgctaagtatccgtaaggggttaccacaagcccattacagggttactgtaatcttgttggcccattggaaagattggcttgtttcaagctgacaagtgctagtgccattcaaatgataaccccgtactatctgcaaaaaaagagaaacttgcatgatctctagggtcaaatgcactatctgtagcttacaggtagattagatgggtgcatgtagatgataatacctgagagcgtcaattagagtgagtacacgtgagaggtgtctgcatgtgttttcaagccacagatgatgggatttgacctagagctagcacaccacttcaacaagattagctgttaaaatgagcagttacattcattcacccagttagaagttttttagacccagtgatgatatatttataatacatcgttagggcttatgttttagatcaaactgattgttgaaggcaaagggaacatcctgtaagtaaaatgccctagccaaaaaaaaaactgtgaaaatgaaggattcctgcatttcaatgtccctttccatcaatagatttttcttattacttttatatggacctttttcggtgcttattgtatcttgttcatgtttatacaggttttagtttcgagcagaggaaataggctcgttgattgttgagaattgtgcccctgaatctggcgccacgaagctgctggcttccacgtctgtctatcaagatcatgggtagagtgacattcttaggaactagtagtagtagaatgagcagcctgacttgcttgttgggactagtatgtttcgtgtgaatatctgatggcacatggcatgtttcttgtgcttccttctgattaaactcattcatgtttggtaatgcctggagaaattgtgttaatatgtgctgttcttgagtagaagctgaaactgcagcctgaactgaaacactgctgaaacttgtgtgtccaacagagctctatgttgccttaattttggactttattcggaattactatatggctaagcagagcattaaatttgacccttataatatcgtctaaaattacccagctgttaacaccataataatacttatacgaaccacacttaagctaaatccttctcataaaatcttcagataaagctgcacctcagagagtccaaaacgactgtagtaaatcattattcccccatatccatatggaatcaaaccgagagtatacactaacgcactacggcgaggtcgaatcaggacctggtcttgaagggcacgtaggtcttgagcgagtcgaggacgccctggatggaggcggcgcaggcggcgacggtgacgaggaagcagacgaggctcaggctctgcagcgccacccacttggcgctgaaccgcggcagctgccgctgccggatgtacatctcgacggggaagaagacggtgagcggccagaacgcgatgctccccaggattcccaggatgctgttgaagaagggcatcaggatggccagcagcgtgatcaccggcacgaacgccgtcctccacacaagccggaacacgttcacgccggtgggcccgcccgcgccgccgccgagcagccccgggcaccggcgcgccacgccggccttcacgggggcgaacagcggctggcagaacacctggaacccgccgacgaggtgcaccacgatgcaggcgttggccacgtccaccagccagtatggctcgtagaagccgaagccggtgaggatgttgcccggcgccgcgttcccgaacgccgagtagcccaggcagccgcacagcaggtagaaccccgtggtcgtcgagatccccgccgccgtggcgcgccgcatcgtcgcgttctccggcggcggcgaccgcagcgtgtcctggatctcgatgaggatgatggcgtaggagtaggcgaaggcgacgttccccagcgcctggaacgtgagccacaccttctgcgtggcgtcgacgtcgacgccgaccaccgtgcccgtcagcgtcgtcctccccagcgggtccatgatggtctgcgccagcgacaagccgacggcgatggcggcgtacgagaaggacatgacggcggcgatgatggacagccaccagagctggtggaagtttgggagctggcagaagagggcctgcaggacgccgaagccgatgatgtaggcgctcgtgttctggctgcagtccgtgccatggccgcgccagtggtagcagttggacttgttgatagccctgcacacgcgcgccacgccatgacattgtacgttaattaagctcgatgcaaagaacatgacgtcatcaatggcgggaaggaagggaatttttttgtttgaactttttaaattttcttttattttaaaaaataaaccttataaaaacttatttccaaaatctggcatggcgtggcaactgtcagatacccgtagtgagcgtgatagttttgtccttaccacgtcagccagaccggcataatcaaataatgagggttattttgtcacgttaatccggctagcatgatcaaaaggtttagatcttaaaaataagtcttgaaaagatatatttttaaaattattcttttaaaaaaataagaagaaattgaaaaaaaaaagagagtggctaagcttacgcggcggagatggaggcggtgatggtgtagccgatgccggtgccgaacatgttgacgtactggcagaagccgcagaaccagacgtgccagccaccgaggtaggacttgacggcgtcggtgtaggtgtagttgcgcttgccggtggccgggtcgccgacgcggtagcagtcggagaggaggccgcaggtgtagaaggtgatggcggcgaagaggaggagggtgatggggccagccacccaccccagctgcgccatcgcccacgccagcgacagcacgccggacccgatcaccgccgtgattatgtgcgccgtcgccgtccacaccgtccctgcaaattgcatttcatatgcgcccaaaacacatcacttgaaatcgatcgaatattttgcactgtccgttcaaaattcagaagaatttaaaacgaacaaattattcatcagaaaacaatgcgattgaattgcaggccaggtttgcaatttctagaatttcaggctaccggcacgaaactattacgcctggaaattttattttcgttctttctttcacaacctaagttagctctgttaatatataactagtttttagttttcacaatctacaattcattgcctgacctatcatctaccagtagctggttcataagttaagagctagtatgttaattgtgcatatcatatcagattcctgctctatcaatagaactttgcaccgtcgtttaaaaaaattgtgcataccagataatcagattcctcgtttttgattttaggggaattttcgaattctcaaaggcaaacaagcattcaaacagcagctagcttaacacaacaatgtcgccaaccttttctttctccctttttgtaaacagaatgtcctgaaacattgattaagaaaacagatgatcaatgatgccaaaagaattcgatgcagacaaaacagtcgcagttcttgacttggacatcaaacggccggctgcatatataacagaatcaccacaggacaaaacctagaacagcaaagatcaatggaatatcggattggagttgaacacggaaggaccttcccatccggtatctccttttgttttcccatgcacttatatatatactacttttactcgcagcgcgtgtttaagataattttttttaaaaaaagaaaactgtataatagcatcctacaaatacgcgagttataaaataccatcatatttttataaaagggcagtatataaaagggtaagtttagtatttttaaaaatttaataaagggctgtcaaatcatttgaagttgagatttatttccattgggagtaaattattttggatctcgtcgtccgtttgtgctagcgctttatttttggacagaccgagtacgtagctagcgtacatgccgacctatcaacgacgagacgagcaagagactaagactagagtggatttcatctgagccactctctctcgagcgggttctggaaacgcaaaaatacaaaaataccctcacgcaaaaagatggaaagacaaatataccctttccgatttatactgcaaaactaatatgaaggaagatcaaatgaatctacaccatctatactgttagatcattacttgtagtatactgtaccataaaaatcctcttcgactaagcataagcacaatctgattgtcatgcatccataactctactactatatcaataatgtttttcaaagttctcaagtgcaatgtatctgaagtcaggagtatgtctttctacgagaaaggtacaggaaaccagcacaaaagatctcaaaggctagctagctagctagagcagctgctaactgaactagctagactgctatatgatcatgtatgagcaggagtcaatgcatggtgcagccgccgccgccgccggattcggtgacatcgccggcgtcggcttccatggagaccgttctttttcctgctgatcatgatctcctgtacacctaggaggctatggctaggagtggagtatatgcctatccctgcaagaggcaactttagggagatgtgccagtttttatgggcaaaaaacccaacccaatcacaaggacctctattgcatagcataggcggcgatgctctgtggcatggtgtccaaatatctgaacttgcaatgacatcctcaataatcaaggtcaatagcctcactacaatgcatatagcctcaataatcaagatcaaagaatacacattcttgtattctttgatctcactacaatgcatatagcctcttcttggtctttaagttggagcccacaaaggaaataaagaccctattcatccaggattcaaataacaacatgtatgttgcataggaataaaatgttttagccttaagcttaagattggccatagcaatattctctcctttactcatctcccaagacaaaaagatagagcaaatacactattttatttttggctctctcatttgttgcaaaataagtttatttttaagcaattatcgtatcggagcttgtgaaactaggaaataaaattgtgtgagtaaataatgcggagaataattgtattaaaatttaatagagtagaagtattctagtctgtttgattttgtattggcatgtgtgggacatgtgaaaaatgaacttattttgggatagagggagtacaatactacatctacagtgaattattttttgtgataacttcaattatgctagagagatttgaactctaaaattatattttttgtgataacttcaattatggtaaatctataatatagttttgtggcaaatttattgctaaatgcatagttttctgatataatgcgttgtattgttcaatcaaagtatgtgtaaactcttataatgccttgtattgttcatccaactatggacaggggacaagtaagtgtaatttaacaaattccatctgttctaataacagggtcaattaaaccaacactaatatttcctcacagacaattagacaaacatcaataggttaaaaaaagtagtaataaataagtgaaaaacgtgaaattttgttcctatttttgtcatcggtccaaaattaattctgaaccaattcatgcatgcgggggcataagcaaggcaacaaatagccagaaattctttgttttttttccttagctagcaaaagattcaaaatagaatcattaattctctctaaatccaaaggatcatggtgagcacagctacagttggaggcaatcaatactagccaattcgactgatcgtgcaacaaagtaaaactaggatcaaaccatatgcatgacctggacacagagattattacatgcagataatgcaaggttggtgcaattaacgtagcattaattattatttgatcatctacatctacgcaaagcaagctttgataatccaccaatctgttgcgagaaatacatagaggaaggagtagcagtagctcggatatcgtagggaggaagagggggcccgagtttaattcccatggggaatctgcatctgcttttaatgacccccgtttcacgaagcctgacggcctcagtcccaacaatttcaattcaggttttcaccaattattactggatatatatcagatgcagaatgaatctccaatcaacatcgaccagaaagaggatcgattaccatgcatgataaaaacaaaaaggatcttttccattgcatggccggtgatcatcatcagcaagaggaggaagaagaagaagattgaagtcttgaagagaagagtatgtacctgtcctcctctccttgccgtcgtcgtcgacgtcgccttgggtccggggaaggtagacgtccatagctgacgccgctccgccgccgttgccgttggtccctcctcccatgcgaagagagaggcttctttgtctctctctctccccgagctagagagctagctagctattcgatcgatcgtacgtctctccggttgatgcgcggggtggtatattgatcccctctccctagctagctcggcgcagggtagcgaagcaaagctgcctccgacgaaggcggtgggttgggggagtggtggtggtggtcgggagagggaataggagaggccagtgaatgcccccatatatatagcgaggagggacaccatgcatcagcgctctctcgctagctactcatagagagtatagtaggctacgcgtggaaacaggggataccccggcgccagtgcgttcaaattaaattaaatccaatccccgtttttatatccatataaacagcttaatgaagtagtagcatgggttatctaaaaaggtaaaagaaaaaaagtatccataaagagcacaactcgtgttttgctgttttcatcttatctgcgattaattgtataaatgtgtcaattcgctttgatttaactcgctgggtttctgtcagatatttttgttcaaaattatttgaaattttaatgaaatttggtcaaaatttaaacaaattatgctaacttcaaaaaaaaatggaaaatttggacgaagtagtttcaggtggggtccgatggactgttattaaagcatgacttttgctattgtttcgtgcggtttctgataatatacggtacggatggattaaacaaaaattaaatagccattatatgtccaaatttgccatgatcattgaattctatatgtggtgtaggatgccatgttacaagggggtacacgggccatggtcaatttcatacagagccccttaggatccaaatcctcttcacaatcaccaagacagaactaggacaaaacaaaaatatcaaacgaagtttcatacccctccgtcctccgccgcaatcttgatgatgatgagctgaattcactattcatgccactcattttgggaatgttgtgtgcatagtataagcagatacaaggatatgttatgtgtggtagcttcaaggaagagaagcaactttagacaactgcaaagtattgtgggtgacgaatggcaacatggaactttagtgtgttggattcacaggaaagagagacggctgcgaacaaaagaaaagggaaaccgtcgacggtgactagggggacaaggtaccttcgaggaagatcaacagatgtggtgaaaagcacaacagcatggtggcatgaaatgaggcacacgtagatcaccaatacaagggatttgggaatattaacaattgtgaataagatttcgatcaagagagattttttgcgaaattggctatgcccaaggaccccttgcaatgagaatacacctggcatgccacatctctagactctaggatacaatcatggcaaacttggaccttcaatggtacatttaataaaattagaacgactaaatttgcaattttaaagattagagattgggatgagaccaccaaacatgtgttgtagcagggaccccgcacctcctccgatctagggaaagccgaaactaccatgtatgtcctatttgatttgaatatatattcaggagtcaagctagccatcacacacactcgaatcaagaagttttcgaatatcatttggaaacctagtcattcgagaaagccaatagggcacagttttgaaggaggtacttcgaggagccaagcctaagtctggggaatcaagccggctcaaacatgtgtttccagggaccacgacaaaaggagcggcaccagcttgtaggtgtggccctgagctcgacaattggataaatgggtcccctcataaaggccagaatatacatctgtaccctttgcatgtgacgtcctttctaggcactaatgtaacttcctaaagggggttggatggcctgtaaaagggcagcttgtcctatcaggaggcagatgcattctgaacttaaaaaaaaggctagcagcgatatactaaatatacccatatacctttcggatacattcattactcaagataggtaaggtcaccttatttcctcctctatcttctacttgttaacgaaattttgtcacggcatatattggcatcgttcgttgggagcgtgagtggcctcgaaaggtagatgaaaccaagacctcaacgaagataagtggtaatagcgagatatgctgaagtgttcggaaaatcaccttagtcacctgaattcaatgttgtagaagcagaggagccgaatttgagaacatgaatgatttcgagtaaggtgcaactgtcaaagatgaagagcagaaagctgaggaagcaagagtcacaactgaagtggcaagtggagtgctagcattgagaatggaagcattagttagtatggtgcaagaacaaagggctctaatgataaacacgacatggtacaaagcaacgcaacaagaatacaaagacttcttacgacaaaacatgatttgtgcaagtgcagatgttgatgtggctacacattcttgaccaatcgacatcaagcctttgatctcttagcagaatgaaaaatggtctactaagttcaatttagtttgttcagttgaaccttctgaactcaaacatgaatagtgcttcggctcctgatttgaatacaacaacctaataacaaccattcactgtaaacccaaaccattctattccatttcaacccacccaacaacattcaaaccacaataactcaatgagccaaaatccaaacatagtcagcaaagcagtctttcatgcacatcaaaagaacatcagcccaataccttatacaaccaacctaataccccaaatacaaatactagtcaatatacctcaaccaacccaagctataccaatacaaaaccaaacatcacaatagaacatacaaaatatcatcgctcagttaatccatcaacaagacaaatcgagcttcacaatacaacccatcccacaacaaaacccacaactagtctcacatcaaacgtataaaacattgaactttgcaaaacaactttatcaccaatagtatcagtacacattgttccaaccttgtgtgccaacatttttgaaatagcaacagtttgtacaatcacgaggagttcgatcaatcaatgaaaaatactctctaagtccagcattgcaaatgaaaccctagccaatgaaattcaaactttcaaacataagaaagctcaacagcaacacaggcgcaaatgaattcttgagagtatatgagacaacaataaaagccaccggtgaagatggcaacacaaatgcaaaagtcttgcgcacggtgctcaaagagatagttttgtcctagctcttcacaataccaacattattgctacactcatgggaacaattgagggagatgtttgaaaatggatttcaaagaacttgtgaggagttgaaaggggcagaagatttgatgcaatgaagtaattaacatggcaaatgattagagaatacatcacaatattcttaagggttcgatgatagattcgaggggcttgtcatagtagggaccccacacctcctctgatccgatgaagccaaaactaacatgtctatctaatttgatttgaatagattttcaagagtcaagcaggcagagccaggctcccatggctggtcgatggcggatccgcgctcccgcagtcggccagcggcagacccgcacacccgaggccgaccaacggcggatccaagcaccattgaagttgtccagccgctgtagtcgttagcggctgactacaaatccaggtgtcgtcgttgtcatgacctgcatgaagctcgaaggtggaggaaggctggaggaaatgagaagaagagatggatggggacctgtgggacttagccaaactttaatagcgcctccacattttgcaggcggaccactgaaggtcccacctttgaaaatcgtatttttccaagcggaccacttaaggctccgaccatagttgattttcataggcggggcaaaaatctagggggtctctagatatttttgcaaatggttatatgagggggtttttttttggttctagaaaaataagaaccagagttagtaaaaatcattttctagtagtgcctactacccccgttgcctcccctccaccgcgttgttccgttccaccaattgttgcacggctttggaggcggcggagccgacactgtcgccgtcttctgctacgacatcttgccgcccactgccgtagcggcgtcgacagtcatccacggcatcgacaagtagtatgccagttcgaggggtaggcgcgaagctgccagtgaggtgtggggcgggggacaaagcaacggcacagcgaggtcgtcactgcggtcgggcaggatgtggatcgaccgatttgatttttttccttgagagaagcagtctatctctcttcctatcctgacatgtgggcctatggataaatccgtctggccaagttgggaagaggaaagaaaatatgagaaatttgagaaactcgggaaatagataaaagtggcatggaacgaaggaattcacgcttctgattgcatattataaaagcagtcaaattgagtggcatatcctgaaatagtgcgaattatatggccttttttacccactaatgtaactttctaaaggaccacacttattacagtacaacattcttgcacttttgtcagggcatctgtcacgcccagaaattcacgaaccagaatttctaagctgaatgtgcattaaacccctgtctaggaccagccagggtacacaaacgataattgttgacatacaaatcaacgtcttacaaaaatagaaaagattacaaatgcagcggaaaaagataaaacgagctagacttggaagcttgaattctgcagcggggcgactccactccacaggcatcccttgatggcagcgacgaaaccaacctcaacaagacgactccaactatgaagatcttcagctctggtgtgggggaaaagagagcaagactgagtattacccactgtactcagcaagtcataccggaagaggaggtatgatgcaggatatatccaaaggaggctaaggggttcctttgcaataaagtagtcatttaaaagaagtagttgaaagcagtaaaacaattgtagtaattaagcagtattaaccaatcactgtccaacgctacaccacgttgcaacaggcccaaccaaccacctgaactacaccagttcattaagctaagctagagttgagactaatcacggtgaatctggttgatcgcccataaccgcgggcacggctattcgaatagttttactctggccagaggtgtacaactgtacccacaagacacgattccatacatgtcgccatgccccgaagtatcaccatgatactgcaaagggggggaaatcgtgacaagaccctccgcataaccctcccctaaccatccacaccacgctaaggtttcacccctacccctcaaaaggcagtgggcggtcccctcttgcgccgcggtgaatccggcagctggacaaccggacaccccgaccgacccaactccatcacgcccaccctcgccaccggtgcctaggaaagggtcgagctatacttcagatcaagcagttacccactcccgcttgtggtaagcacggtaagtctcccagggtttcccatgaaccggtccttaattgccatgggtgcgaccagcgaaaccatgcacccacagcccaccattcagtgtattttaattaacaaacaccatttcggtggcactaatctaaagctatgctaatagtcaaagtctatgtaataatgtgatccccatttgtgtactagttgagataggcatggctaagcatttcctaaaccaacatctagtcattttgatacctagtcatcaatggcataaggtaaacaatatatggctgagtattaggacccatcccacatgacattataaaagaatgtaacatttaatagaaatgcgggatatttgtaaattgggtacaatatgatcaattgtaatgcatgacttgccttactctagcactgatgagaccacagcaacgtcttcgagaaaccgcggatcaacgaaatagccgaaatctacgcgacaaacaaagcacacaagcaaaacatgctataagactactgaaacagagaacaaaaccatttttaatagattctatggatttttatgaatttactgagacttgaatggacttaaacggagctcggatgaattacttatgaattttagaagataaactatgtttttactaataaagaaaaaggcctttattaattattgcgcaataaatccccagggctgacgtcagcgaaagggggggggtggctcggtaggcggggcccatgagtcagcggctcaaagggggtggtccaccgtggactgggtccacggggccggggtggtggtgtaccacgtggcaccacgtggctggccacgccagcaatgggatgaacggccacgatcggccgagggccgatcgggcggctggggacgggcggcaccaaggccagcccgggcatggcgcacggtggcgaccggccggcgacgcggacggcggcgcagtgcgacgacacgcatgcggggagaagcggcgcgcacgagagaggagaggaaggggaagaaaaaggggtcctcaccggaggggcgacggcgaccggcgcgggaagagacaagcggcggcggcgcttcggacaatggcagatggcgtcaggcacaacctgtgaaaggcgatgaccgggttaggaaaaggggaggatgaccacggcgactagagcggccgcccggagtcaggcggaaatggagagctcaccggcgtgcgagggaagcggcgctttggcgacgtttggcggcaagcgagcgacggccgaggtagctctcgcggcggcggaggtagcggcggtggttgcgcagcgcggcggcgagcctagcagcgacggcgcaccgccggaggtcggcggcgggcggcggagctcggtgtgacggcgcaggcgcggttgggggcgtgggagaggacggcgaatgggggaaacgagagaggggactcgggggagtgattttatgggcgcggaaggagcggaaacgggcggggtggccctctatttggccggcgacgtgggggtggagagagagagggggtgggattcaaaatcgaatcccgcccattatcgggcgcgcgtgcgcgggagatgccggggaggggagagggcggtgacgtgggcgcgaaatgcatgcggagtgggggcgcggagaaaggccggaaacggcggtggcgtgggcggtttcggcagcagtggcggttgccgccggttggaggaggaagacgggtccgacaggtgggccccacatgtcggtgacccggggagaggagggaggcggcttgggccggcccagcaagaaggatgggagcacgagagagagatgggccgacggcccatcaagagaaaaaaggaaggaaaagaaaaaggaaaaaggaaaaggatttttctaggattaaaattgcacctcgatgattttaaatggttaaaaattatttatagggctctgaaaattccgctaaaatcctgttaatgcattgcgacatgtggaacccaagaaaaatctcacaatgccaattccaattattaattgcatttattaattagggaattagctctaggttaattcaaaccatttcttcggatgatttatttaacaaattttaaggaaagaagaaggggaaaacttcagggcgtgacaaacctacccatcttaaacggaatctcgaccccgagattcggaagagctggcgaagaggtgcggatgggcggccttcaactcatcttctctttcccaagtggcctcttcttccgagtggtggctccactaaactttgcagaatctgattactttgttcttggtccttctctcactagtttcgaggatacgagtcggcttctccacatacgtcagatcttcctgaatttcaatgtgatccggacttgcctgttcctcaagaactctcaaacattttttcaactgagagacgtggaacacattatgaatgctaagcatgttggagggaagcttaagctggtaagcgacttcacctctacgttccaaaatccgatatggtcgcacaaagcacggtgccacctttctttggtttagaagcggtgtacttccccgtgtggagtgacgcgaaggtacacatagtcccctgctttgaaagcaagctccctttggcggtgtctacatatctcttctgtcgagattgcg

SEQ ID NO: 18318 - DNA, 5922 bp, Oryza sativa
  unsure (1)..(5922): unsure at all n locations
ccgccttgagtgactcgtctgctatgcaagnagcncatcacttcttaggtacaccatgtaaacacatgattcttgccagataaagctctgctaacttcttccctgagtaggtagtgtgcactggaatgaagtgagccactttggtgagtcggtcaacaactacccaaatagaatcatgccccgatgacgtcctgggcaaaccggtgataaagtccattgctatttcttcccacttacattctgaaatctgaaggggctgtagcaaacctgctggcctttggtgttctgccttcacacgctgacagacgtcacagagtgcgacgaattcagctatttcccttctcacgctgacccaccagaatttttctttgaggtcttggtacattttggtactgccaggatgaatggaatactgagtttgatgagcttctgtcagtatcaagtcttttaattccttgttttcaggtacacacaatctttctcccatccagattgttccgtgttcatccttagtgaaacctcgggcttttccaactctcatgttctttttgagctctgctattccaggatcacttgcttgagctatgcgaacctgctccactagtgtgggttgtgcctctagggcagccacgaatccgtgctcaactataccaaggttcagctgttcgaaatcgcgttgaacctcacaacatagtttttctacccatgcaacattgtagtagctcttcctgctcaaggcatctgctaccacattagccttgccgggatggtagtgtattcccatatcataatctttgattagctccaaccatcttcgctgtcggagattcagatcaggttgggtgaagatgtacttcagacttttgtggtctgtatatacctcacaacggttaccgatgagatagtgccgccagatctttaaagcatgaacaaccgcggccaattccagatcatgggtcgggtagttgccttcatgaggacgcaactgtcgtgaagcataagaaaccactttgccatcttgcatcaacacacaaactagcccctagcgagatgcatcacaataaacctggaaatctttcgtctgatcaggcagaattaaaattggtgcagacaccaaccgtcgtttgagttcttcaaaactcctattgcattcagcagaccagataaacttttcttccttcttcaatagttgtgtcattggcttggcaattttagagaagttctcaatgaaccggcggtaatagcccacaagtcccagaaaactccgaatctgagtgactgtctttggtggggtccacttggtaactgactccacatttgctggatcaacggccactccttgagcatttacgacgtgaccgagaaactgaacttcctttagccagaagtcacacttgctgaacttggcatatagctggtgctcttttagcttttcaagtaccaaccgaagatgctgctcatgttcttcctcggacttggagtagataagtatgtcatcgatgaaaaccacgacaaacttgtccagaaattccataaacaccttgttcatcaaattcatgaagaaggcaggtgcattagtgagtccgaaagacataactgtgcattcgaacaacccataatgagtaatgaatgctgtctttggaatatcctcttcatggatcctcaacttgcgatagcctaatcgcaggtctatcttagagaacacagtagctcctttcaactgatcaaacagatcatcaatccttggcaaagggtacttgttcttaatagtaacctcgttgagtgcgcggtagtcagtgcacatcctcttggttttatctttcttttccacaaagataaccggagcaccccaaggcgacgtgctcgggcggatgtatcccttctgtaactgctcatcaacttgcttcttgacttccgccaactcgttggctcccattctgtaaggccacttgtggatcggtgcagttccaggtaccaagtcaattcggaactcgatatccctttttggtgacattgttgtcagatcgtccggaaaaacctatggatactctctaactacgggaatatcctccaacttcttagtggttttctccattgctacctcttgttcttcaccagcaacctggtttaaactgatcccttgcttctgcagcactggagactggaaggttaccacttctcctttcgcattggtcaacttgatggtgcggctagcacaatcaatcactcctctgtgccttgtcagccaatccattccaagaataacatctagatccttggattcgagaagaatgaggttggctggaaaaatcaacccttgaatttcaactgtcactgatgggcagtagtgagttgtggtcatgccacctccaggagtatgaactcgcattggtatcttaagcttcactaaagataacccatgtgcaccagcaaaacgcttggaaatgaaggaatgagttgcaccataatcaaataatattattgccggtgtcgagttgacgggaaatgtgcccaatatgacctctggagctgactgcgcctcctctgcagatgcatgattgacacgggcctgaacgaacttgagtccggcacgtcttggcttcaggcacgtacgtaccatgtgtccgggctcgttacaattgaagcagagttcgggcttttctccaaacttcttgggctgtcctagctaagctggcagagctgactgagctggaataattagtggacttggagtagggttgaggctgtgttgctcactgttgctgtgactgccactgttgtagttcttgctatagctacccgggtggtaaggacggtgctgccagataatcatgctggaaggtccaccctgatgtcccatcgtgaaaggaagcttctgactgatcccctgggaagtcctgagctgagctggcttcctcttacgattcatcttgttgcactgctcttcctgacggatagccttgtccacaagcttctcaaggtcctcataatccttggagatcagttggttggtcaattcatcatcaagaccagacaaaaacttctcttgcctctcggcatcagtgcgcacgtcctcaggagcgtagtgtgcgaggcggttgaactcatgcagatactctataactgtcctagttccttgctgcaaagaacggaactctctcttcttttgtgccacaattccctcgggaacctatgccttattgaaactctgacaaaactctgaccaagtaacctctgtcccagctggacgggtcaccatgtagttgtcccaccaaacagaagcaggaccttgcagctggtgtgtagtaaaagcaacattctcttggtcgttgcattgcaaaagattcaacttcttctaaagtcgcatggagccaatcgttggcctcgattgggttggtggtgcttgagaaagtgggcggcttgacacggagaaactccaacagtttggactgggcaggtggaagaccaaactgcaggttctgctgctgctgctgtgcttgctactgcacctactgttgctgcatctgttgcatcatcattgtcatcatctgagtctaattgtccaacacctgagcgattgttgggttctcgggcggtggagacagactgttgtcagacgtatcgctggcacgtgctccactgatatgctcttcgctgccactggtgttgttggattcacgggaaccattccttgtcttcaccatctgaagggggataggtagaaatatgaggaaaggaagaaaaacagggggcttagaaactaatctttcttataaatttaagtgcaattatcttaatctttattaaaacactgaaaaagaggcacgcaactcctaattaaggcagccataccactgacacatgatatcgaccgccgactaacccacaagcaacaaacctaaaacatggaaactagcaagcaaatagactaagcagacgataaagctaagggcggcgactctgaagctcggagcggcgcttgcgatcgaggaacaggtctaacacctaagatggacaagggataggaaccaatgcatgctcaaatccaaataaacaaagcaacaaatgactcaaacaaataactgagcatggtgatttttatgcatggaacatttttcatgaacccagatgaagatactaatgcaactgactaaacaataaattaatgcataaaatagatgcatagttataatgatacgcacaaaattgccccatcgaacatagacacgacttagtgcatatcacccgatatattcccgactgactgttgaataaactccaaataaaatttttctaaaaccctagactgagctaattttaaagatccgatctgaacgaccaagatttttcccacaaaccaaagaggcaaaaccccaaattttcccgaaacaaatccaagtgcaaagagcatatgcagatgaaaaaggggttcagagggctcttaggtttccagttggcttgtcctacggtcaaggtcggctctgataccaacttatcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaacgagctagacttggaagcttgaattctgcagcgaggcgactccactccacaggcatcccttgacggcagcgacgaaaccaacctcaacaagacggctccaactatgaagatcttcagctctggtgtgggggaaaagagagcaagactgagtactacccactgtactcagcaagtcataccggaagaggaggtatgatgcaggatatatccaaaggaggctaaggggttcctttgcaataaagtagtcatttaaaagaagtagttgaaagcagtaaaacaattgtagtaattaagcagtattaaccaatcactgtccaacgctacaccacgttgcaataggcccaaccaaccacctgaactacaccagttcattaagctaagctaggggtgagactaatcacggtgaatctggttgatcgcccataaccgcgggcacggctattcgaatagttttacgctggccagaggtgtacaactgtacccacaagacacgattccacacatgtcgcaatgccccgaagtatcaccatgatactgcaaaggggagaaatcgtgacaagaccctccgcataaccctcccctaaccatccacaccacgctaaggtttcaccctcacccctcaaaaggcagtgggtggtcccctcttgcgccgcggtgaatccggcagctggacaaccggacaccccggctgacccaactccatcacgcccaccctcgccaccggtgcctaggaaagggtcgagctatacttcagatcaagcagttgcccactcccgcttgtggtaagcacggtaagtctcccagggtttcccgtgaaccggtccttaattgccatgggtgcgaccagcgaaaccatgcacccacagcccaccattcagtgtattttaattaactaacaccatttcggtggcaccaatccaaagctatgctaatagtcaaagtctatgtaataatgtgatccccatttgtgtactagttgagctaggcatggctaagcatttcctaaaccaacatctagtcattttgatacctagtcatcaatggcataaggtaaacaatatatggctgagtattaggacccatcccacatgacattataaaagaatgcaacatttaatagaaatgcgggatatttgtaaatgggtacaatatgatcaaatgtatgcatgacttgcttactctacactgatgaaacacagncacgtcttcgagaaaccgcgggatttccaaaacccgggaaaaaaaaaaaaatacccgaatctacgcaccaa

SEQ ID NO: 18319 - DNA, 789 bp, Oryza sativa
  unsure (1)..(789): unsure at all n locations
ncgcctacgagtagatcgaccntgcgcngagcncanantccgcagccctggagctatacctcggtcagatcaaagaaggcactcaatacatgaaggattgaaagtttgggaaatttggtcgaagaacggccatttggggaatttggggaatattaacaaatactttatttctcttatactacttccaactgatgagataatcgtttggcggcttgcatgtttctaatttatatttaagaccatctgtttccgggtttttcgaatttattttatatcgaacgctaggctgaaaccgccttttcaaaattggtattaagccatcaggaattctgttgagtgagcttgatcatgtgtgtgccatctccttatatgcacatcaccggtcttattcacactctgttacgatttactaggtcatgagaaccatttaaacttgttccgctcgcctgttcttgcttatacccaagccaaacaagagcagactatgcgttgttgggggcgctgtcttccaactcaggggaacactaagacaaaaatatctcttcatgcccttcaggaccttaaacaaaagctggcacgccaactggttctatgttcaaaattctcaatagaccttcctcgaaactcttgtcgtctcttcaatctaccaagaaacaagggttttcattgcttacgtgagatgattcggaccatgcctggaaccgatggtaccgctgataaagctgaaataccaagtttgcttgacaccagttgactcgtcacttcattaaaagcctggtagctaattaa

SEQ ID NO: 18320 - DNA, 13547 bp, Oryza sativa
  unsure (1)..(13547): unsure at all n locations
gtttgactgcgacaccataatgangtgtgtgaataagctatgacanggtgactctcncacttacacatataatcatcgtccttattctcataatagtattcgttattctctctanttcctcctcccnnccnccncccccaggaggtttggatttgcatttgcanctaccgcaagnagcncatcactcaacgattcgctccgattcttgggggaaaagaaagaggagaacgagaggaacaaaacccctcaaaaacccggaggaatcggggtcggattaaggcggatttggaggtagaaggcggcggcaaagcggcggctcgggcggctcggccggaggttgaagacgagcccgacatgtgggccccacatgtcggtgactcgagagagagaagggcgggcggcggctgggccggcgtgggccgcgcggaagagagaggatgttgggccgaattcggcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatctagctcatttttatattgaaaattttcctagaaaattagggtttagcttgtaggcttttaaaataatttctaaaaatgatttaaaatatgcatttttaatttagttgatttttagggcgtgacaatccccttacaaaaacagtttgaaaattttcagaaaaatttctctgaggccgatctgaccgaaggtgtacagccggtctgaccaagggtcggtctgaccactgctgtaccgttggtctgactggtgctcagtctgaccgaagcacagccgccggattgactggtcgccggtctgaccgcgggacccattgcggtctgaccggtttcctcgagaaaacaccagatttttgccactttgattttgcaaaagcaatttctctctgctttttctatctatgagctaatctaaaacaaaaaccaacaagatgtccatctttaccacaaaaagaacaagcatcctttttctttagaagaagatggttttgaaatatttgtttttgtttattttagtgttgtagaaagagagggcataactccagcagacttgaaaactgttttcttagcactaggtttggtcaaaatttagccatgttcagtcacactcaaaacattgggttgattttttattgaaaaagtcatgaacatcaaaacgaacacccctattgtagctagtcactttagattgatccaaaataatgttaagttgtttcttaccatcagaaaatctttgcaaagaacttttcaaataagaaacctatttttccaaattagcacaattttcacaatctaccatgacacttttgctttttcgacatttggggcaagaaagcacttcattggttttcacaacatcttccatgtactcaacacgacctaaagcatgttttagtttcatcttgtttagtgtgcatattgagcaatcaaaaacactttgttgttgttgttttaactttttagcacaaaccatgttaaacatcaaactagcatgaaaagatatttgatatttttttcaacaactttttagttaaaaacaactcatccaaagtacgtgtgtgcaagacaaaaccaagagcaagacaagatctatttttcaaatgatgtgcaacgttgacatctctaatttttgaaatttcatgcattaaaacctcacaatttttgcaaccatcatcattaggaataagagattttaatctataaattttagaattaagggattcaataataaattcctgttttctatacatcttctcacacttcttattttttgtacttaaaataagaatagcttcctcaaaagaactcacatcattgtcttcacactctgaatctgattcaccatgtgccatgaagcaaacaccggagatgttctttcccttatcttcatcttcactttctccatctacatcgcttagtggctcaaaagcggcatagactttctcaaacatcttcttgagattctccttggtcttcttccccttgaatgtgctcttagactttgttctccttagtcttctctccaccattgtcttcctttttgcctctcctaagcttaggacaatgcgaacgattgagatcaagagcaccacattcaaagcaacgatcgatttggaccacttcttttcctgtacctaacattattcatagctcgagaaaacttattaatgaccaaaaccatgtcctcctcctcgaactattcgagttgctcattcgacatggcattaattaaagcaagaatagtagtaattcgatgaagaagcaccaacatccaaagaagtcaaggaagaaaccaaatcactagacttagagtcaactttacaagaaataatattcatctcatgtgttttgagttttgtgtaaagcgaatccaaagtcaaagtaaacatatcaacagactcctgaattgatgtaactttcatctcccaaatagacatgtcaagaccattcaaaaagtgacgagaaacctcagattgtgtgtaatttatatcataagaagaatcaacagatttaagatcactaaaaattttttgaacctagaaagatagtcattcaaagcttctccaggtttcatctcaaattttatatactcctttttgaaaagttatcgatgaagttctttaatatttgaagttccttgatgaaagtttttcaaagcgttccaaatctcatttgcagtttcaagatgcgaaatacgatcaaaatccgaacgagaaatcccacccaaaagaatattgtgagctttgcaattattttcaaattcagtttttaaagcaatagtattaatttgatcaggaatcacataaggattagaaacttttctcaaaatatcaatatactcaatcataatgtaagattgcatcttactacaccaataaagaaaatccgttccatcgaaaacatggagcttagttgcaaacttattagccatggcaaaaaaaactctagatcagttaaaatccaaaaaaaaaacaaggttctaatactacttgtaggatcgaatagaagaactaagccaaccagagggggggtgaatggttggtatacccaaaaacccaaactttttgtggaattaaaagttacactcaaattcgacggatcgtggtctgaccgaagttgtcccgtcggtctgaccacacttgtgccgtcggtttgaccgatgtagatcgcccggtctgacagccccgaagtcgccactgcctcctgatgccaccgccggtctgaccgctgcgatgccgttggtctgaccgccggtgtttcgccgggtagactgctgaatccgcgtaaacacaaattgaagaactcaagatgtagatgacaactttattacttttctctgtgtttacaaagtgcaacaacagcactcctcatgaaaatctcgactaaactcgaaatcctaactaaactatcaactcaatggtctcagaagcaataccgggaagcctcacgctccctctctatttatacataaggtaggcagcctaaagccacgaaccaaactcatactagaagtcctaatccacataggaaaccttcccgtacaaaaaacaaacattacaaactccaatcataccaaatttggccttccaaatttaactccacatcccatatgcacacaatacatccatcgtatgccatatggaatcttcaccaaccacgtgcattgaattctagcctaagtatccgcatgatatctaaccatcacggacgtcgccttatccccaagtcgactcccgatctatcaccagcaatactctctagagacatcaagtcacctatacatgaatcaaacaaagaaaccatattccgagactaagctatctccaacttgactcattgttagcaaacaacagtattacatacgaatagtatccatctagaagccataaacatgaaacaatcatggatatccaaacaaacaacccgaaaccgaaaccgacacagagtcggccggtcagaccgctcgcatagcgccagtatgaccggcagcacctgcccggtctgaccgtacccgacaaaacagcagcacctgttaatcacttgaaaatccaatcatctccaaaaccacttcgccaataatctctaaatatcaaaaccaataattacaaatgccaattgttcatcacaaaataggactcaaaaacactttgattttacatccaatacctatttagatgtaggtaattgggagggagttcttttctaagtacgatgtgataaatatgagccatacattatcacttaaaattcaattcacatccatacttcccatgattctcatctctactatcaaacaaaggaataggaataaaaatgaaactcccatgatcagtcgtcctctaaacttccaatccgctttccatctcttgccaaacaggcagtataaggcctacacaagaactatttcaattcaaaaattcatacaaatctctatcatttgcagggagacctaaataaaagcgcaatggcgtcttacataacattatcgaacattttgcattagcattcatgtttccttggccacagcacgaagtggcttagccatggacaacacaagaccaaactcttctgccatgtccaagtcatcacccttaacttcatcagggatcgtccactcaaaccgatgcagtagtgatgcaagcatcagatgcaggcatgcagcatcccttctgctaatggcatcccaaggcagatgcgtcgtccagcaccaaacggtatgaactcaaaattggttcctagaaaatttatatctctacccaagaacctgtatggcatgaacttgtccagatcatcccaaatcttagctctcctacaaattgcccatatattcacatatacagttgttccctgaggtatcttgtagccctggatttctactgtggcctcagccttgttgaatgctattggaacagttgggtgaagccggagggtctctttgatgacagcttggagataaggaagctggctgatgtctgattctgcaacgtgagtttttgtgcccataaggcctttgagctcctctggaagttgtatcatggactttggattttgcagtaactctgccattgcccactctattgtacttgaggttgagccgcttccagcgacgagcaaatcctgataaattgcaaaatatgtttaaaactaaacgtgcattccgtatgtgtgatgtgtcttccatattaactcaaacaattcatacacctataacaaaataaagcttaggtggacttacgtattttcctaaatactgccatttttggcaaaaatatcatgtactatcttttaggtatctaatgaaataaacataacaaacttttactcactgtaaaattttgcaaaattggctgtcgagagaaaaaaaaactgtattaataaaatgaaattgaaaacctgtaaaaattgaatcacaatgggacagtattaatattaccatgaacattcccctcatggtgtcttggttcatcacccatccttcgctttccacttctccttccatgtcaaacgccacatccagcaagtcattcttgcgaggctcgcagacgatgcggcggcgccgccgccggtcgatctgcacatcgatgatgccgtacacccatccgacgagattatccatccttcgccgcacgcccatgacgtcggcggcagcgatcaccgggaaatagtcagacaggttcggcgctccggcgaccaccaccgccttctcgatgacatccctcagctgccgcgtcgtcgcggcgtccatgtcctcagagaacatgctccaccacagcacgccagccaccgctgcgaacgcctcgcgtgccaccgacaccggcatgcccccggcgctcccgtcggacacgcggtgcgcgagctcacgcgccacctcctcccgcatggcatgtgtcacaccctgaagttcttctcgcaagtctaaattaatttaataaattacctcaagaaattatctgtgtattggcaagagagaaaccctaatttaataaatgcaaataataatcggaattggcatatggaatttttgttcacttctacaagtcaaaatatgctaacaggattttcagtagaattttcagaggtcaagaaataattttaaccaattaaaaatgaacacaagcaattattaaatcccttgaaatccctttttttttccctttttccttcgagtgggccatcggcccattctcccctcccctccccgtgcgcaagctgggctggcccgaggccaaggcctagcaaccggcccagccgccgcctcgcacccccctctccctccctctgggtcaccgacaggtggggcccacctatcagccccgtcccctacctccggccggcgccgcccgcgcccgcaaccgccgctcccgcctctcccgcacacgcccgcgcatgtcgcccactccccgcactcgccccgcacgtcccgcaactgctgcccctcacccgcccatgcgccccaccgagatggccgggattcaatttttgaatcccgcctctatctcctccccacctccccacgtcgccggccgattcccgcgcctctcggcttcatctcgcccccttgtgcctataaaaagcaaccccgtcccctcctctaccattttcccgttctcgtcgagctctcccgtgcactccaccaccctagcgtcgcgcaccacccgctgccgccgcttcagccacctccggccgccactcgccgccactcgttgccgctagagcccccgccgagcctcgccgtcgctgccgtcgggttcacaagcccacgggccacgccgcccaccccttccccgtccaatgccgccgccggagtccggcttccaccgtgcgccggtcagctcgccattgccacctcctttggccggcgattttgcccatctcgctccctctctccctctctaatcacactcatttgcttccctaggttaccccggagcccgtcccgccgtagccgtcgcttcccgccgctcaccgtcgtcgatcgccgtcggtgaggcccctccccttcttcccctctctctcccgcgccgcctagcgctgctgctgcttaactgccaagcctccgcgccgccgcctagctgcgttgccgttgctcgctgccgtcggctgcgccgccgcctagccgtgtcgccgccgctcgcctcctcgggccgccgcgcgccagggccaccgggccagcttaagccgcccgcgcgtgcgctcggccgtacgccgccttcgccgtctgatctaccctcgggtagatcggggccatccgttgccgcccgcgtggcagcccacgtggccgccatgtgtgcgccacgtggcgctccccatccccgatcccgtggactcggtccactgtggaccagcggacttgagccgatgacttgtggggctcgcatgtcggcgccccccccccttcgctgacgtcaccagggttaattattgtgcaatgaatcaattaagttttttctttttatagtaaaaaaacacagtgaatcttctaaaattcatagataattcatccgtgctctataagccattcaagtctcagtaaatcaagaaaaattcaaagaatccaattaaaatggttttgttctctatttcagtagtcttacagcctgtttgcattgtttgctttgtatgtcgcatagattccgactctcccgacgctccagtgtacttcgaaatagtcgccgaggttcctccagccacagagcaaggcaagtcatgattgtcacttgaacatgttgatcccatattggaaatgctctattgctttcctttaaatattgcattgttttataatgttaccatgggatgattacctactgtctcagccatgcatgttatttgatacctttatactttgctagcttgggttgtaacatgattagatgttggattagggattgcttagccatgcctagttcaactagtacacaatgggggaactacattaatacatagacttcagattctagtattgatgttggattagtgccaccgctttggtgttggttaactaaaatatattaaatggtgggctgtgggtgcatggctttgatggtcgcgcccatggcaattaaggaccggttcgcgggatgccctggaagaatttatcgtacttaccacaagccagcgtggacaacggctgggcttgtagtgtagctttcctctagctgacgcatccaggcaagggtaggcgtgatggagcgggatgggccctgcgacggcctttggtacttccggattcacctaaacacgagaggggactgcccgctgccttgcaaggagtgggggtgaaacctgaggtatggtgtgtttggttagagggggttatgcgaagggtcctatcacggcctctttccagtatgccgtggtggcatgtcggcgcacgggaacgtgtcgtggggctgtgtcttgtgggtacagttgtacacctctgatcagagtaaaactattcgaatagtcgtacccgcggttatgggcgttcaaccagattcaacgtaattagtctcaccctagtttagtctaatggaactgattagttcaggtggtggtttgggcctgtcccaatgtggtgtagcgttgagcagtggctggtttaatattggctaattatcacaactgttttactgctttcaactactgtttataaatgctagctttatgcaaatgaactcctttagcctcctttggttatatcttgcatcatacctcctcttccggtatgacttgctgagtatagtgggtagtactcagtcttgctctctcttctccacaccagagctgaagttcttcccagttggagccatcccgaaaaagttggttttgtcgctgccatcaaggatgcctgtggaatgaagtcacctgctgtaggagtcaagtcttcaggcttagctcgcttttaccttctctgctgcatttgtaatcttttatatttttttaagccgtggatatgtatgtcaacaattgttgtttgtgtaccctagctggtactggacaggggtttaatgcacatttagcttagaaattatagttcattaatttctgggcatgaaagtgcgtagccccgtgagccgtctcggcgtgagcagtgtcgacgtttgatgtcgcgattccggtatttgcatagtatggggatcgttggtattaggatatatgcgagacttaggtaaaagagacagaggcgaggatttttctacaggttcgggccctagaattgtcaggtaatagccctacatcctgttggccgaagccggtcgttgctcttattcaccataatcacaccagtacaatatttggggtagcctatctatctgttgtcgacatagcggactgaagtatcatcacgtagtcgacaacagggtagtcttcctcctcgaatctgtgcccggcgagatcaaatacagcgctagattcctctctttggttcccgtagataccatatgaggttttcctaggcttatctctgatatcgatatctggcagcttgtcttggcgtatgtaggcttgtattggcttgtggttttgtggcgtctatgttgtccgtgtcccctctcctcctagagggcgttgtatttatacccataggtgtcctcttgtccaagtagaactaggaagaccaatatggatacaatccgagtactccttgtcgtttccatgtaaaactctagttgtctttctttatccggaactccctccatatccgaggtcagtttccatataaaacatggtatgtgatgggtcctgccgagatttagtcaactactattaggtatatggtatccataatcctaacaagcagctcctccgtgcagagcattctcatggcgcaccacttccagcgcggccacagcgcgatgctggagttggcgtggtggccgcaggcgtgccacgagtccataccgccgcggccggtgatgtcggcgttgttcctctgcaggatctccctcgcggcgtccgcggacatggcgaccacggcgcggacgccgccgagccttatggacatgagcgggccatagcggtcggcgaggcgagcgaacgcgtggtgcgggttcttgccgatgttgtggaggttgctgatgaccggcagccggtgaggtcctggcggaaaacggcggcgagcatcgagcagaggttggaagatgtaggagatgatgaagacaaggagaagagacgagatgcataggtggaagaacgccatcattctagcttgcgagttgcgacactatgcaaagtgcgcatgcattggcatttggttctattttgctagttagttctgtcaatttttttccgaaattgccaaaaaatactgtcgcaagttttttttaaaaaaaaactttccaatgttactgtagttgcagtgtaagtataatgtacattacggtgtaactgcatttagatataaagttgcatgtattattttaatacttatatacaaattatattatattagttatagtaaaattatattataattatactatagttagatttgaaagtttttgtcttaaaaaactcgtggcagattttcttttgatagtcctttttttcttatatatttttgaatgttggatgccgtttattttttacacatgtgttgaatcatttcttttataaagcaaataatatgatttttatttattttgatttgttttgtcactgatggtactttaaatatgactaatatttttctacatttacacaaattttttaacgagaaattagttaaatgtatgttcatccatatcaaacattaaataccgaagggtacacttgcacgacataaaaacaaaagagtttctagctaggactactaattttaatgtaacgcctaaccattactatttcagatgagatccgtagggacttgaagtacttcttctgtcatgacgcgtactagtaataatcataacaaaggtagaatatatcagtctttcgaagataattgaatactccctctatttcaaaatgtttgacaccattaattttttatacatgtttgaccgttcgtcttattaaaaaaattataaaatatgtaaaactatatgtttacatgaaagtatatttaagaataaatcaaatgatatgaaaagaataaataattacttaaattttttgaataaaacaaatggtcaaacacgtactaaaagtgtcaaacattttgaaacggagggagtactttggtactaccgtgtgctacacttatttttctgtgcatcaaatggacatttcagtattagtacgtgattgtgctgtctcgtattagttgtacatgaaatgggtggaaaaaaaaggaaataacgaacgatggaaaggaagtcaaggtattaaaaaatgattcaaactttccatgatatgatgatacagttgcacggatcaaactgagctttcagatcagatttaaatgaggaacttcgttaatgcgacgtggccatttcaaccttcacttccagattttagcctcgtggcatgaatgtctttaatgtgataggaccatatctctgaactctattaaaaacacgcaccaaatggaattcttttccaagatccaacaatgcataagttagggctaccatgcattcaaagtatgacgtttgataatttatcttattcaaataattcaaagtagttactccctgcattttgttaatatcttagtacatggctctgttggattttagtatgacgtttgataattcatcttatttaaataagttatatatgcttcatttattttgataattgtgacttattttatcactaaaagttatatgatgatacctacaagccagattgaatcagcaggagttactgacagatattttagctaattttgttgaatttattttatagagatatatttttactataattaaaaacttgattgatatgtaaggcattttaatcaggatttgaacccatgttaatatatgccaactaactatatataagtaacatagggcacacatttatcagtaatgatacgatattaagatggttaatgcattgaatatagaaacgatttactgaagaaatattgagttcaaaaattggcaatagtagccagtgataatatttttatcaatatttctcacattgattttctatggttgtgtataatttcatgcctctggaaaacattttataaatgcatcttcgtttatattgacagtatgttgatcataaggtatttcagaaatgtctctatactaatttaaaggcattttaaaagtgcatgtatagtataagaaaaatatctttacaaggtatgtttgttgtagtgtacacgacaagagtaaggacaatcatattcacttattcattttgtttaaatatatataagtataacatagtatttcaaacattggcattgtcttcaatatataattaattagacattcttaacattttaatgttgaatatatagcattttttcgactaaaaaattaaagttacacaagattgatagtatactctttcagataatttagtgtgtttcgcaaatcacgatccaggtgacatgttctttaagcgaacacatttttcgagattatggagtactgaacttcagattgatctgactactgctgggatgtctgaaaacaccgtttcaaattaatactcctaggcactgttttgatcccttctcaaaaatttttatcctgtcagatcaaatagactaaaaaaataactaattgtacagattgtgactaatttacaagacgaatcttttaaacctaattactccatgttttgataatgtggtgctaagtaaatatttgctaatgacggattaattaggcttaataaattcgtctcgcaatttacaggcggattctgtaatttgttttattattagactacgtttaatactttaaatatgtgtccgtatatctaatgtggcacgccaaaactttacacccctcgatctaaacaccccctattaacaaacaacgtgtctttacctccaactatatataaatgcattttcatcaatatttctgacctattatttccgattgggcgatatgatagcttgattcggatgcacatgtgcgtgtatcaccagtttttatattagagttagcttatacaagtgaatgtgctggacatttttctatagaagcatttattttccttgtagcataagttagaggaaacgtgttactgtacaagcttgacaaaaaattgtcagattaccggtggacgatcataatcaaatactttctttgtcccatttcaagtgcatttgtatgtttctgggttcaatatttaactgtccatcttatttaaaaaataaaaaaataagttacaaaaatattattcatattttatcatctgataacaataaaaatactaattgcaaaaataattcaaataagatggatgatcaaacgttgggcatcgaaaccatagctgcacttaaaatattaaaatagtacggaggaagtagctt

SEQ ID NO: 18321 - DNA, 13358 bp, Oryza sativa
  unsure (1)..(13358): unsure at all n locations
cgatcccccttgagtgacgtatcactggtacacnagctcatcataattcaataatatattccgggttatcaaattttgtaatatttattaagagaagcgggctaatctagtagtctaacatattgcgtgtttttatagtagaaaatcttaatttaaaaagacgatataattttttctactgatgtacatacatattttaagggtgttatagttttttttactcgtgcataaaacaatatctaaaggttttttaatagtttttcttgtcgtacttatgtacgtttctttgtttccatcgttagtacgtgcgctagtttctgatacgcacgttatactgagaggaagcaaaaatagatctaatataacagtctatttagtccaccaatttaaatgaaaatcgacggtgagattataaaatgccatatggtgatttaggagcgtttgtagggatgccaaatgacggcttaagaacgtttataagaagattaatggactttagtatataatagatagatagatgtatacatgcatcactcatccatatatttgcaacaaagcgcggggtatcaactagtttatatatgagaagatatgagacagtggatgtttaatttatagacataattattggtgtgattatttctgatttttaagaagtgctattactcgatctttataccatatattgttggaaccaaacactcattatgcattgagccacatcatctagaaaataatagttttttttcctattaatactttgatcacaaccattcatatatcatattcattgacaatccacttagcatagttattatcgtaaagctcaacattaattgagttatgccaccttagaaaaataatacccactgcatttctctcatgcttcatcgtatccgatcatgtgtcatgcctaaactgttatagaagtttaaatattatcctttaagcattatgactacatattttctaaattgttttctttgaactattttataattatttctaaaattcccacggcaatatgtggggtatccactagtgaatattataagtgtgcacaatgaacccaattagcaaaaattttccttctgtcgagcaatcatcgttaggaagtacaataatatatgtttgcttggatgggagaataagctgtatataacggataaacattaaacaggtgaaatgagttcttgaagttaccttaggtactacttattgcttcatttcttattattcatctctctttacttgtcgttctgtagcttattgatgtttttctttttctgatataaataaggacacggccctgatttacaatttgtagaaatcaagcgtacgtagttgttcatttcaagagtcgtcaagtctgcacagcaacgaggagaataagatcatgagcccgtttggtattactccatactatgaagtgatacagagtattggtttgcaaaagcaacggaaatcaccatatatatggcatcccctttttttcacgaaacacggcaaagtcgcaggtgcttatataaatgcacacacattcctccttataaacacaccatacctctgtaattgcctctgaaaactaggttggcatatcttgagattcatagagtcattataggtgtctcgctgtcaacagatatgtcgtgtaacattgaaagaataattagccgtaaatacgagcactcatctcaagttgaataaccggataggtaggtttcatcacaagaaacattgccagttgaattacactcacttcacatcctatttttgttttacaatacttcgtgtatcagaaaatatcttgggtgattacatatttagagcagctatcatcgcattacatttgtaatgttcttctattcttcatcataaaaaagtcacatgtttcttattgtatttcttgagctattacatagaggggagcaacaaatgatagtgttaacccaaacctctccctcatatccactccatttttcccagcctcagctggcaatgtccatgtgaatcggtgtagcaacgagccaagcatcaaatggaccattctgtgagctagtggcaatccaaggcaaatgcgctttccagctccaaaaggaattagttgaaaatccctccccatgaaagtaatgtcactatcgtagaacctctctggcatgaacttatctggctcggtccatgtgttggcgcatcgattgatcgcccacaagtttataagcactttcgctcccttaggaatggtgtaaccttgtatttctatcgtggcttcggcctcgtatggtggtagggcagtttggtaatatcatgttcatccatttgttgtttgctgcctatcacactcttgagttcgtgcacccttctcatcgagtttggacactgcaatagttctgccattgcacactccattgtgtgagaagtcgtctctccaccagtgaacaaatcctacagcaaatgaaacttgagtttagaattatcaatgaaatttacttggttaaattacaaaatttaatcaaaacgaaaaattgtaatccaaatttaaattagaaagctggttcaataattttagctaaattaaataaattagtcatgcatgataacaagggtcttatcttttcgcttatgcttatatttatcagtcaaaatttgaatttcaaccttaaatttggatctgattttgaggtttttaatcgaagtttatttttcagctgatggttttagatcgctaagaacacgtatataaaagtttgttttattcacaaattaatatccgtccgcaagttgtacaagtactcactgtaaaaagtccacggatggcatcacggttaatttcgttgctatcttctttactctccccctcctccagcatcacgtcgagcaggtcgttcttgcgtggctcgccggcggtgcggccatgcatcctccgctcgatctgctcgtcaatgatggcgtacatcctcttcaccagcctcgccatcctccggcgaactccctggaggtcggccggcgcgatcgccgggaagaagtcggagacgttcggcccggtgcccagcaccgacgcctcgtccacgatgtcgctcacctcgcgcgccgcctcggggtcgaggtcgacggagaacatggtgcgcgacaggacgcccagcgcggcgacgtgcgcggcgtggcccacgtccacggcctcgccgcgcgcggcgtggccggacacgcggcggacaagctcggccaccttctcctccaggagagccctcatggcgtcgagccggcgcggcgagaagagcccgacggtgctgagccgccgcagggcgcgccacctgcggcgcgggggcaggcaaaccacggagttctcgcagtggccgccggcgcgcatggagtcgccgaaggacctggcggcgatgtcggcgttgtgccgctgcaggacctcccgcgccatctccggcgacgacgcgacgacggcgcgcacggtgccgaggcggagcgacatgagcggcccgtggcgcgcggcgaggcgcgcgagggagcggtgcggcaggtggtcgagctggtggaggttgccgatcagcggcagcggccacgggcctggcggcagccggcggcgagcgtcggcgaggagctggaggacgtaggcggagatgacggcgaggaagagggagaacgcgagagggaggaagaacgccatggtcgtagcaaaacgtgcaactcacctcacctgtccttgtgtgtatatactgctgcattgcttgctgatgaagactgtttattgtttgccatttcggtcgtaacatactctatgttcccaacctaggtgtgtttagatcctaaaaatttttggccaaaaatatcacatcaaatgtttggacatatgtatagggcattaaatatggacgaaaaaaattaattgtatagtttacatgtaaattgtgagacgaatcttttgagcctaattgcgccatgatttgacaatgtgatgctacagtaaacatttgctaatgacagattaattaggctttataaattcgtctcgcaatttacaggcggaatctgtaatttgtattattattagtctacatctaatacttcaaaggtgtgtacgtataattaaaaaaattttggcccaaagaactatacacggccctaatttctaatgaaaattttggttggaagtgaaggaactcaagtcatggatgacaaccagaaaggactatgataatgctgagattgactataataatttttatataactagatcgaagaaacgtatcagatcgtgcggctacgaacggagggatcactgttgcactgtagcaagaggaatgcggccacgtagcgacggcaaaaacaataagtttattatgatatgatatgcatggttcatacagtgcctgtagtggctatggtagtagcagtggcagtagtagtatttgtagtagtagcagtaacgttaatatggttagtagcaatatctgtagcagtacttgtgaatttctagtgtactgcatatttgctgagcttttagggtttgtgtattattacgctgttatcgctcgaggcttgtcttgagctgtatctatggtattgtaataactggaaccaatacgatgtttctgctatgctactctgatgtgcatatctctgagtaaacgatgtttatgaagatatatgctatagacttatattctactcttcttgtggaatatgtcggtcgtttcagagcggttgcggtgaggaggtggcgtcgccgttgccgctcgccacacagccgcccccgccaccgcccacctcccacccatgcgcgccctgtgagagagatagtggagagagaggggaaggagatgtatgacagatgggtcccataatttttttaaaaagaaaatactatacagaaacaaggtgttgcatcacctacaatgagcctatgggcttgtttggcgcattccatcttgtttggcgcaatcacagaaacaaggtgttacatcacctacaatgggtctatgggcttgtaactaggggtgggcaaaataagaccgaaccgaagaaccgaaccgaaaagaccgacaccaagaccgagaaattcggttagtagtccggtcttggccattgaaagactgaaatttattcgggtaattcggtcattgctctcagttaaccgaattaaccgagaaaaccgaattgtgtcccaataagcctaggatgcccaataagcccagtaaactactaaaccctagaggcaaccacacagccactccctcctcccacggtcccacgagcctcatgcagcgccgcctctccccaattccccatcgcgtcgcgcactcgcgctcggctcggtcacggcgcctccaccgcgccgcctccggttccacggcgccggcaccgcctccgccttccgcctccacagtgccgcctcggcctccaccgtgccggcgccgcctccacctccgcggctccgccttcagcctctagccctccaccgcactggcaccggcgccgcctccgctctccgccctccgccctccaccctccgtgctccgccagtccgcctccatcgcgccgcctccccggcccgtcatcctcgacctctatcgccccggcgctgcatccgccggtccgtcctcggcctccgtcgcgccgacgccgcctctgcccttcgctgtcatgccctaaaaatcaactaaattaaaaatgcatattttaaatcatttttagaaattattttaaaagcctacaagctaaaccctaattttctaggaaaattttcaacataaaaatgagctagataaaattttattaaatactatgcttgctcttctattttctagaattttctgggaattatttgagcaagggaagtatttttaataattgaaacaacatttcacaaattgttttattttaaaaagttcaaaaacccctcctttaggttattgggccgattttggcccaatactctctctcccgcgcggcccaagccggcccagccgccgcccgccctcctctctctcgtgtcaccgacatgtggggcccacatgtcgggcctttcttcaagctccagccggccggccgaccgagcccgagccgccccgccgcgccgccttctcctctcaaatccgctccaatccgaccccgtttcttccggatttttgaggggttttgatcctctcgttctcctctatctttcccctcaagaatcggagcaaatcgttgggtattttgtccgagttttttgtttccggcttcgattcctctcgtttggagtccgatctcttcaatccaaggctatatataggaccacctcgtcgccctctttcgtttgccctctctctcgtggtctcccgtgcctcctagccgccgcgccgccgccttttagcccgccgccgccggccgtcttcggttgcgccgccacgccgctcctgccgtcgccgccgcttgccgccgccgtctttaggtgcgccgtggtgaggggaacctcggccgccccttccccatcgttgccggtcgccgtagctcgccgtcgccgcgcaagccgagccaccgccgtcgcctcctcgtcgccggccgtcgtcgtgcgtcgtttgtcgttgtggtgagtaccgttgggttcgtcttgtcgtcctctacgtgtacttgtcctccaaagccccggccgaccgttctagctccggcgaggtggccaaccctagccggccggccattgatgacgtcatgctgacgtcatcagttttcctttttcccaattttctaatagattaaaacttcggaaaatcataactaaataaccgtagatccgtttcaggtggttcaagttgctaaatttttctaaaatcaagatctacatgtaaaaatatccacatgtactgtttatgcttgtttttgtactgttttgttgattttttgtttaattgctttagtttccgacgttccggaggagagtgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcttagaaacattagctaactaaaggggttaaatattaattgataattaaaatctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattaaagtgcgccagactgagaagtggcgagaagtccataggggtcgctggggagtccatgccttgtttataagggggtgattatgatccaggaaaggtgcgccgtaatgggttatgttgtgcgaggggtattgtcacaactcctctccgaggtaccgtggtggtattgaggcacctggtgacatgatgtggggttgtgtcttgtgggtacagtggtacacctctcatcagagtttaaactattcgaatagccgtacccgcggttatgggtgagttgagcaatgtttttcgtgattagtctcacactactcatcaatgttaataatgtggtaattaatttgactcctggtttggaatggataattcctggtttggaggtttaatttgttcaactggggttggttgttcaaatgtggttgggcctatgcaacatgggtgtgttgtatggtgttatttaatattgattaattattcaactgtttttactattctcttaaatatttattaaatgctgtttctgcaaatgagctatattatgccatcctttgttatcttgtgcacttgcatatttgctgtgtgacttgttgagtatgttatatgctcattcttgcaatattcattcatcagaggaggagtatctcagtgaaggtgatgatctggaggattaggcttgttcttggttaagatgcctgtggagtggagtcgccatagctgttccgtagtttgttatagttttttttttccgctgcgtagaacgttattctttgagaggaactatctacctctgtaataattagttatttgcgaatattaaatagttatttatttgtactctattattaatttgtcattgtgtgcctcggttgattcctggacgagggtttaacacacatgtaagcgttcggaattttggatagaaattccgggcgtgacattcgcctacatcacgccgcctccgtcggtccgccctctgcgagcccgcctctgcctcaatgctgccaccgcgtcgcctccgtctccagccagactgcggtgggggatttgatgcggtcgcgttcgatccggtctcttctctgtcaaaattcggttagaccgagatcgagaccgaatttgtcggtcctaagttttttaggaagaaattcggtcctcacttttcaaagaccaaaatgaccgaaagaccgaagaccgagaccgaattttggtcaaaccgaatgcccacccctacttgtaacttcatttgggacccaggcccaagtagggcccacgtggggtgcaccccaaacaggtggagcatgaccctagggactcctaggtcatcctcccacctctttaaatagctaggtgcctcttcagggtttctcgggttttttcagactaaagtttagcttcgttacttggccgtataatcccgtgatcggttagatcgccggtttgttcgttacagaaccctaacttatcatttgtattcaattgctatttgcaatttagattgcttttatcttgttcttgattgtttcttcgatttgcttataggaataaggttgatctgcaccgacaagattaacaacccacggagttaaggcgcaacacaacaacgtctcgtacgattgtagttgggtcgtcaacgtttctcccaaatcgtaattatcatcaactcaccgaaagattgggccaatcctagccatgagcatctcaagtggagctcagggttcatcagatagggttggaaaagatccgactcattgtgaacctgtcagcagagagaagaatcccctcaagggacacatcgtctcactcatctaacttttctttttggtattgctagtagttatatgctgtttgtgcaatcctttccctaatttgtttgtggtgtgccaagggagtttgtgaaggtcggatctcaccttcgaagggaagagataccctcagtggaaggaggagtgcatttgaggaaccttatggggatagggttggaaaaaaccgagctcattgtgagcttgttaacatatagtagaatcccctcaaggagttgaatttcgggaacgcatcatcttacaagaactccggtgatatctctctcactcatctagctctgctgcttggtaccactagtagtttagttgttgtttgtgtaatcctttccctaattgtgttactgtcacttttttgctcgacttgttaatttacttgtaaatctgagatttttgtaaatatctgaaaatattaggaaatattcgacaaattcagcttatgcttttccgtaaagtttgaaacgcctattaacccctctctagacaatatcaaggtcctttcagcaccaaattgtgcttaccgcgttaagtgtagcgcgtagtcatactaaatttatcgattagtttacatattgattttcaatctgtcatcttcttggcaaccagctgcttgaagttgaatggagtggtgaagtgggacatgccatcgtagaaggtggcggcggtgagctgtgcggacctctgggagggatgcacacggtcccagaagagaaaaccttcatggtccgtgcagagtgtggagtttggcaaacaatcatcctcggcgcccattattccgctcccacagcatgcgctatcggtgttcgtgaaccctgtagcaaaacagacacaaggtaaactctacgtatatagatcttggatgacatagtggagccataaaatattgtctgacaaaacagggtatgtactaatatacaactcaaacaactcaataaccataggatataacacaggataacacaatgtttggtagaacaacttaagtaatattatgatgaaaaaagaacacattgactagccaacagagcaaagcttattacattgtatagtggctacatattggttcttaacgaaatcagcatagcttatggtgtattggcccctgcctttgtgtgattatataactcaacaaattgtttgtcattttacttgcttagaaggtagagggttggagatatatcacttcttgtttccaataaattataagcgaatgttatttgacggaatcccatccccacaatattaacaaatattaacaggtggcatatagctcccaagtccccaccaccggtgccactatctgccgcaactcccaaagtccccatcaccatgctgtttagggtggaaaataacatctgagatctcgtttgtttagagatacatatatgtgcgggcgtgccagtgtacctaaatacacaatgtaaacaaaacatagggaacatgctctttattaatcttaaatgatcataaatacaaattcccaatgtaatatatatgtatgcgcgctccataatctgtcattggacagatctgacttgtgcgatatggtctcctgattcctggggcctcgagaagctcccagttaattacctccgtaggtctaggcctgcaagagaacctccgattaagctgcttgtggtcgtctcgtcgtctccgcttcacgttctccatgcatggttgtgatgatgatgtagatgtgtgtgtgtgtgtgtaagcgccggcagcgatccatggcctcgtcggtccgtgcgctggtgttggtcgcccaccctccgtcgtctagcctcgtcggtcttgaacaacgtgtcgacgtagattgttggtgaagacatgcatggagttgcatagcttgaacgacttgacgtcacagcagttgcgtcgagattagattagagaagaatcagggaggaattattgaagatggttgatatagacggcggccggatttaatcaaagctcggcatctcatttgggacaaataagaaaaaccaacaggacttcttcagcccacgcattggtttgtgcatggcactgtagcagcgatgacatgtcatcctccaattggttggccacgttgccacaataatttacttaatcaacatgcattagctagcttgttgccatccaacagcactggctcaccgtcctcccgtcgtccttcctctgtactgcagccatacttgcctccatcgtcatccgctggtttcgacgctatgcgtgatgcttgacctccggcatgagaactgatagaagtcttggcagtcggcggcagctccggcgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttcctccgcgtcaagttcgttgtagataaggcttgatcgatcaatttgttatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaggtacttgcagaagaaggaanttcaatgtcaatgagcgcag

SEQ ID NO: 18322 - DNA, 1187 bp, Oryza sativa
  unsure (1)..(1187): unsure at all n locations
catggcattgattgaacagacggttcccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcctgcngtngngttgtcattggtatcatggccgcg

SEQ ID NO: 18323 - DNA, 9142 bp, Oryza sativa
  unsure (1)..(9142): unsure at all n locations
atattggcgtcattatctttcgggtaacggccaaagaatgaatccggatcatanaagtttgaagtacattttcactcaacctgatttgaacatgcgtcagcgaagatggttagagttgattaaagattatgatatggaaatccactatcacccggggaaagcaaatgttgtagccgatgcccttagcaggaaaagctactgtaatatgtcagaaggtcgacatttaccttgggagttatgccaagaatttgaaaggttgaatttgggaatagtcagcaaaggttttgtggccgctttggaagctcaacctactctgtttgatcaagtgagagaagctcaagtgaatgatcctgatatacaagaaattaaaaagaacatgagaagaggaaaagccatcggttttgtagaagatgagcaaggaactgtgtggttaggagaaagaatttgcgtcccagaaaataaggagttgaaggatactatcatgaaagaagctcatgaaactttgtattccattcaccctagaagcactaagatgtaccaagacttaaagcaacaattctggtgggccagtatgcgacgtgagatagcagaatatgtggcactatgtgatgtatgtcagcgggtcaaggcagaacatcagaaaccagctggtctgttacaaccgttgaagattccagagtggaagtgggaagaaataggaatggattttataaccggtctacctagaacgtcggcaggacatgattctatttgggtagtggttgatcggttgacaaaagtcgctcacttcataccggtcaaaacaacctatacggggaataagcttgcagagttatacatggccagagtggtatgtttgcatggtgttcctaagaagatagtgtcagatagaggtagccagtttacttcgaagttctggcagaaattacaattagaattgggtacccgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtcttcgggacagacatattgcgacaggcagaagaaaaagtgaagattatccaataaaggttgcacgttgctcagtcacgacagaagagctatgccgacaatcgtcgtagagatttggcttttgaagaaggagattatgtataccttcgggttacgccgttacgaggtgttcatcgtttccaaaccaaagggaaattggcaccgcgttttgtgggaccttttaagattgtgagggaaattggcaccgcgttttgtgggaccttttaagattgtgagtcgaagaggtgaagtagcttatcagttagagttgtctccgtcaatggcgggaatacacgacgtgttccacgtgtcacagttgaagaaatgtttatgtgtacctacggaggaagcagatccagatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggaacgagaagatgaattgaagtcagctcatcctcatctgttcgccagttcttctgaatctcaaggacgagattccgtttaaggggggtaggtttgtcacgccctaaaaatcaactaaattaaaaatgcatattttaaatcatttttagaaattattttaaaagcctacaagctaaaccctaattttctaggaaaattttcaatataaaaatgagctagataaaattttattaaatactatacttgctcctctattttctagatttttctgggaattatttgagcaagggaagtatttttattaattgaaacaacatttcacaaattgttttatttgaaaaagttcaaagaaacccctccctaagccgttgggccgaattcggcccaacatcctctctcttccgcgcggcccacgccggcccagccgccgcccgccctcctctctctcgagtcaccgacatgtggggcccacatgtcgggctcgtcttcaacctccggccgagccgcccgagccgccgctttgccgccgccttctacctccaaatccgcctcaatccgaccccgattcctccgggtttttgaggggttttgttcctctcgttctcctctttcttttcccccaagaatcggagcgaatcgttgaggatttgatccgaatcgagttcgttttgattttatccctaaaaccgagtttgaattttttcccgagtcgattcctctcgtttggagtccaatctcttcaatctaatgctttataaagcatcccctcgtcgtcctctcccgtttgccccctttcccgtcctctcccgtgccccatagcgccgccgccacgcgcgccaagctcgccgccgccgccggccgtcttcggcgtcgtcgctgcgccgcctccgccgtcgccgccgcttgccgccgccgctgataggagcgccgtggtgaggagaagctcggccgcccatccttctttgccgccgaccgccgtagcccgccgtcgccgcgcaagccgagccgccgccgttgccctctcgtcgccggccgtcgtcgtgcatcgtttgtcgtcgtggtgagtaccatcgggttcgtctcgatgtcctctacgcgtaggtgtcctccaatcccccggtcgaccgccctagctccggcgagctcgcaaaccctaaccggccgccattgctgacgtcagcatgacgtcatcatctcctttttcttttcttttttccaattttctaatagattaaaacttcggaaaatcataactaaataaccgtagatccgttttaggtggttcaagttgctaaattcttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgcggaagcccaaggcaagtcacacagatcctaaacaaccctttgagcatgttgaacccgtttaaagctattattttatttcaactatgcattgttttcgaatgtcatcgggtggtgaacctttcccagttaattaatggccgaagatgactttattttcctatgggttataatatgattagcatgaaccttatatattggattggttcagctaaatgctatatatgtatgtttgcttagccatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggtcagagtttaaactattcgaatagccgtacccgcggttatgggtgagttgagcaatgtttttcgtgattagtctcacactactcattaatggtaataatgtggtaattaatttaattcctggtttggaatggataattcctggttaggaggtttaatttgttcaactggggttggttgttcaaatgtggttgggcctatgcaacatgggtgtgttgtgtggtgtttatttaatattgattaattatacaaccgttttactattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggtggattaggcttgttctcggttaagatgcctgtggagtggagtcgccatagctgttccgtagtttgttatagttttttttttccgatgcgtagaatgtttttctttgagaggaactatccacctctgtaataatttattatttgcgattattcgatagttatttatttgtactctattatcaaattgtcattgtgtgcctcggttgattcctggacgagggtttaacacacatgtaagcgcttggaattttggatagaaattcccggcatgacaagttggtatcagagccaccttgaccttaggataagccaaatggtaaaccttaagtagccttcaaaatattttgaaaaaaatagaactgctcttctctagtctcttataaattaattaagttggcagcacatgcaaggttatgcacaaaaatttatttaattcaatttcttttcttttaaaagcaaaaattcgtccttctcaaaatgtttctttctctctttaccaagtcttattgatttgtcggcactgtacatccattatggtatcgatacaatcatgatagcactagtactactcatctttcctatggtgacactgtaccgtgcttataatagatcataagtattttagtttatttttgttatttgtcaaaaaaaaaaatttttttgtctctgtccaaaaaagttaaattctaaaaatatttataaaatagctttgtatgtgtcttttcttttcttcctttttggtcaaaaatcagttaagtctagttggtgcagctaacttagaaaaatatgcattaattcttctcttctatgtttctttagatgccgccccattcactgagaaatttgatcaaggtgttaggattcgtcagggagctgaggttgatggcttttgaggtaggctatgaagttgctcccgagtatcgccaaatttcccatgaccccgacgaggagaagtgtcgtgttcgtgtgacgttggctagtgatagtgaagaccttccgtcttttaagttcgaagctggaggaagatcatactgccatgcttgtcaagaagcagcgttggtggccattggagagttgcgtgaacactttgaagaagagttggattcatcagctttccagtatcatcctcacaagcctcatggtcaagactatggaatctatacctgtcctgatggtgaagagagtgccactctgatgcatgcggtgcatatgcttagtgctatggatgcagtaagtgtggaacgagacaaagcagctcatgacagggaaaactggaatcgaggcaagatttgcaagttggagagcaaggtgtaccgtctacagaaggaattagctgaacttaaaggagaaacgccgccgccaacacccaagcttcgcctcactccaagaaagagaatctgtccgccacctcgtctccagttagcttcgaagattcatgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggcgggattagtcgcttagttagaacgttgccgtagttcgctgtgttagattgcttgtttaagtttgcttgtgagtgtgtgggttttagttgttgcttacatcatgggtgggatgtaacagcatgagtctagttcttttgcttgtcagagtgtaagatagttggtgagatagtgttaatgcaacttaaatgtaatcatacacagttaatagcaatatagaatttaaattaattaaataactccgttctaagggtgtctctctgtcgttctttcctgttgtctctgcttatcgtcagatggtgaacacgcgcaccggaagtggaagtggagctactaacaatggaggagatcccacgctagctcagattctggcccaacaaacacaactgatcaatctgttagtgcagcaggcacagaatcagcaggcaaacaatcagaatcagaatccaccccacctccccaaaacaagctggcagatttcttacgtgtgagaccccctaccttttcaagcaccaccaatccagtagaagcaggagattggctgcatgcggtggagaagaatttggatttgatccagtgtactgagcaggagaaagtttcttttgcttcgcatcaactgcatagacctgctgctgaatggtgggatcattttcgccaaggcagggctgaaggagagcctattacgtggcaggaattcatggccgctttcaagaagacacacataccaacgggtgttgtagctctaaagaagagagaatttagagcactcaaccagggatctcgttcggtcaccgagtacctccatgatttcaaccgtttagctcgctatgctccagaggatgttcgtaccgatgaggaacgtcaggagaagttcttggagggactgaatgatgagttgtcgtatgccttgatgtctacggatttccgggatttccagcagttggtggacaaggcgattcgtcaggaagacaagtataaccggatggagcagaagaagcacagggctgcccaattcaaggcacaacagggcagtaaccagaggccgcgtctcgttactggacctcaagctccaccgtaccctcaaggaggatcttcatcagttgtctgcccccaacgccagttctacaacaacaatactggtaatcgtggcaatgacaaccgtaacacggttgctcgtcctgcagcaactccagctcagaaccagcccgttaggaaggaacagggaagcaagccagtgatatgcttcaattgtggtgatccaggacattatgctgataagtgtcctaagcctcggcgtgtgaagaatgccccaaccccgaacaactctaatgttccagcaccgaaggcacgtgttaatcatgttgcagcagcagaagctcagaatgcaccagatgtggttttgggtacgtttcctgttaactctatacccgcaactgtgctttttgattccggtgctacacattcatttttgtctaaaagttttgcgagcaatcatgggatggaagttattagtcttgggagacctttactagttaataccccaggcaaccaagtattttcgacccagtattgtccttccgctaccatagaaatagaagaagttcctttcccatcctcgcttatcttgctagaatccaaagatctagatgttatcttagggatggactggttatctcgtcacagaggagttatagattgtgccaaccgtaaggtgaccttaaccagtagcaatggggaaaccgtttctttctttgtgtcctctcctaaatatcatggtgtgatcttaaaccaagttgctctacaagagattcccatagtacaagactaccccgacgtgtttcccgaggatttgccaggtatgccacctaagagggacatagagtttcggatagacttggtacctggaaccaaccctatccataagagaccatacagaatggcagctaatgagttagctgaggtgaagagacaggtggatgatttgcttcagaaaggatacatcagacccagtacttcgccatggggagcaccagtcatctttgtggagaagaaagatcatactcagagaatgtgcgtggattatcgagcgttgaatgaggtcactatcaagaataagtatcctctacccagaattgatgacctgttcgatcaactggaaggtgctacagttttctccaagatagatctccgttccggatatcatcaacttcgaatccgtgaggaagatataccaaagaccgccttcacaactcggtatggtttgttcgaatgtaccgttatgtcgtttggactcactaatgccccagcctttttcatgaatctgatgaacaaggtgttcatggaatatctggataagtttgtcgtggtgtttattgatgacattcttatttactctaagacgaaggaagaacatgaagagcatcttcgtctagctttagagaaactacgtgagcattagctttatgccaagttcagtaaatgtgaattttggttgtccgaagtgaagtttcttggtcatgtcatctcgtgtggaggagtggcagtagatccaagcaatgtggagtcagtattaagttggaagcaacccaagacggtttcagaaattcgtagtttccttggacttgctgggtattactgcaggtttattgagaacttttcaaagatcgccagaccaatgactcgtctgcttcagaaggaagtgaagtacaagtggacagaggattgtgaacgaagtttccaagaactgaagaaaaggctagtgactgcgcctgtgttaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtacagagatgtatacggatcataaaagtttgaagtacattttcactcaacctgatttgaacatgcgtcagcgaagatggttagagttgattaaagattatgatatggaaatccactatcacccggggaaagcaaatgttgtagccgatgcccttagcaggaaaagctactgtaatatgtcagaaggtcgacatttaccttgggagttatgccaagaatttgaagggttgat

SEQ ID NO: 18324 - DNA, 812 bp, Oryza sativa
atgggattgattggctcgtctgcaagtagttcatcacttcttagggataagaacaatggccgtatcattgaccccttcaggcatcagtccagtttggaagaaacggcgaactgcaccgattatatcagctttaattgtgccccagttgcgctgatagaacctggctggaaagccatctggaccaggtgatttcaggggcccaatttggaaaattgcctgagaaatttcatcctccgtaaaatcctcacaaagcttctcattcatgatatccgtaaccttttcctggataagacgagtaacggtttcaggattaagatttggatcagcagtgtacacatcctgaaaatattcagttgccatgctctccaacttcattgtcgaactgtgaacagttccatttgcatcccgtagtttggagatttattcttctttgctctccatactgcctggctatgaaaaaatttcgtatttcgatccccatcctttagccaattaactctggaccgctgcagccacagcatttcctctctgtacaacagctcgttcatatggtctgtcgcattgcgaattaccgttctgtcggcgtttgattctataagttccgccaattttttccgagccttctccagttctcttcctacatttttcactttggctctgctccaagatcgcagcggctgtcatgaaccttttgcaaggctttggttgttgtttttgagaatcagccttttcttcccggaacttcccaaggtttcttaatttaccgggttggtttgtggtcccctctcccacacaattcttaattggggggt

SEQ ID NO: 18325 - DNA, 11574 bp, Oryza sativa
  unsure (1)..(11574): unsure at all n locations
gtggnatggctttgcagatctacagtagttcatcannnnnnnnnnnnnnnnnnnnnnnnnnnnnnnnnnnnnnnnnnnnnnnnnnnnnnnnnnnnnnnnnnnnnnnnnnnnnnnnnnnnagccgtctgggtatgtcgttcgcccgctttaaatgttgcttttccacaacttatgctaattttcttcattttagcccccccttttttttagatacccgcagctcattgttcgaccgagcgaaccgtgagggctcgccttgacagctttaaaagtcgtcttcgggctaaggatgaagaactgggccgcaaggggctagaaatggaaaacctagccaacacccttaaggagacgaagactgagaataagcagctccaagttgagctggagaaggggagcgagcgaaggccgagatcgagcgcctcaaggctgagcttaaaaaagaacgagattagtccaccgccttgactgattactataaccttaccgagccgaagatggaggctcttcgtcaggaggtcagcaaggtagaagcagccgctaagagagacgcacaacggttcgcgcgggagatggtgaagaccactaagtccgcaaagaccgtgtgccgcacgctttgccttgcccttaccgacatgtgggcgaaggtgcgaggagtccccgacgaagatgcttctgcctttgacttctcggagtggactcaataggccagtggtgtggtctctgattgcaccactgcatacggcgattgctacgcgcgtgtgttagcggcctttaccatgggcctgctacaacaaaatgggtgcgagcatatcgccgagttccccaagttggtgaagggggattgggaagtcagttgtcaggatctttcggccgcacttcgtgcttggcgcaaacaattctggcaaatggacggctgatctactgccaaggcgcgcctgctcgagcacttggcaaaggcagaggcggcggatcaaggcgaggaggcagcgggcgaaggaggtggggcagatgcgggcgctggggtagacatcggccataatcacccagaggtgtgaggccctccgcccgctctttagatttttagattttttgcgttggccacggaaggcgaacgatgtaaatttggccgatgtttcccccttttgtactgtagccgaaaatggccttttttatatggaatagatgaaccaagtttcgccaattatcccgtttttagggctttgatatgtatggttgcatcattttgtacacgaataggggctacactttttgcccgctttatgagcttcgccctctcttaaccttgtgctttcccatttgcccctttttatgttgttttagcagggtcttcactagaaattgtgtgttcggcttcctttcagagattggcgtaaaaagaatgagaaattcatcacagttgaaggcttgctgaaatttaagtattcatgttgcgagatgataataaatggcaatagttacaaggttttgaaagtttccagctggatgcgggcacaccccgggcgaaccatggacgactacgaccgtgtccatgtggagcatcgggaggacatggctcgcttttggtgaaatcatcggaggactgatcgtcaggaagcgatcgcccaacgccgttacggtctagtttatgtctcgcccccttctcctcttagggtagtgtataatattagtagtgatgacgaaccaagttcgccagatcataccttagggcgtggagggtgttttgggggtggagatgtaatttttttgtaagttaggctgtaaagcccgttaccttctttcgcctgtaccatgttgtatggcctatattttttttcgaagttaatgaagatgtgttttatttccttttcgctattgtacgcatagtcacctttcatgattttgttaggtcgaaatatgtcggcccccttgcgtatattagcgaaatatgtctgctgacttttcagcttcctacttccgttttcgatctgtagtattccgcgctaaagaaatgctcgtgtttttcacatagatcgaatatgactgtgttcggttatttatttcccgaaacaagatgttgcggtttcaatgttcagcgagcgatgcttcggtcgattcatttcgcccccctggcgctttcgcttatcaggtgtttgccttagggtttttccacgaattatcatttacacaagtaaaaaggtgaaagacacatggattatatactggttcgggcctccaggatggataatagccctacatccagtttttttcctttttttattttcctctttttttgtatttttgtgccgaagggcctacataatagtatgtacatttttacaagttggcgaatggggtgccaccccttctagacatagaaacgcttaagagaagcagcgttccaggagtggtcgaactcttcgccttccagcgtcgccaagcgaaaagagcccgtcctggacctgttcttgatgaggtatggcccttcccacttcgattcaagctttccaaccgccattgggttcgccttcttccttagccaggcagcagctctatcggttgaacctttttgttgtaaggtgccaaagtgctcttggcatatttgcgcatgtgttctagtgcttcgactctcaccctttcgaggagttcgagcaacacctcgcgcccatcttctccttcagaaaacattacccttggtgagttagcctctaactctgttggggtcattgcttcgtcaccataaaggagcatgaacaggctaaacttggttggccttgtgggggtcgtccgaagggcccaaagaacagataacatttcgtccggccatttgcccttcaccgccccttcaagcctcttcttgagcgcctcaaggatcttgccatttgctcattcgactgccccgttcgattgtgggtgtgcgacagaagcgaacttgatttgcaggtctgggccttcgcacatctctctaaacttgtcagaatcaaactgcttgccattgtcagtgatgaattctttcggcactccgaaatggcaaacgatgttcttccacacaaatttttatacagctgccgaagtgatcgcaccaagcgattcggcttcgatccaacgagagaagtattcaattgctacaattgcaaacttgtacccatttcgtgccaccgggaaagggccaatgatgtccaacccccatctggcgtaaggccagactactgcgataggctacagctcgtactggggtgctgtctggcttcggccatgccgctggcagcttttgcatttcttggcttgctccacactgtcacgtcccaaaacgaccctaaaatatatcctctaaatggtgcctagaataattaaaatccgtgtgaaagcctccaacaattaaaatgtgcaaagttaaaagtcaaataaggcttagaggatttttgtatatttcctaaaagcctaaaatgcgtaaataaattttagtggaattttcagagcacaaataataattattaagaaataaacaaagttaaaatgattttataaaaagaaaaactctgaaaagtcccctttccctccctctccctcttgggccggctcggcccatccccttccccctccctctcctctccccgcggcccatccggcctctccccgcgcgcgcgccactgacgggcgggcccgcccgccaccctcgctgacgggtggggcccacccgtcatccccttcctcccgccgctcccgccgcctcgcccgcgccctagcgccgccgccgcgaatcccgccgcccccgtcctccccgcgtgcaatcaataggggggaattattccccgtgattccctctccctttccccccattttcccctctctctctcacgttcaaacgcgcggatttgcccccgcaaatctcgccagcgccattgatggagcccgagagcgccgcgccggtttccttcccctccggccgccctctcccccttccaactctatttaaaccctccccgcacctcctccgtccgtttccacctctcgccgcccttcgtcctcgacggaatcgagctcgcgccgttgctctctctctccaccgccgccgtcgagctccggtccgccgccgccgtcaccccggaccacctcccacctcggcgccgcctccttcggctttgccgcatcctcaccgacctcgtccacccctccgtttcgctcaccgaccgccggaacgccgtcgaccccgtcgacccgagcagcgctgccgccttcctccgcaccggccgcctttttcgttgtcgccgtcaacctagggtgagccgtggactgccgcttcttttcccccttcccttcccctctctcggccgccgctccgccgcgccggtggtcaccggcggcgaccatcggggcgcgggcgcgccgcctcccgccggctgcacaggcttggccgccctcgggcgcgccgagtggctgccgcgtggggcccggccgtcagccgcgtgggccccactcccgtggacccggtccgcgtgccccctcccctcggctgacgcaataaaccctttttaaattaaaatttaaatgaagaaattcgcaaatattcatttaaagagcatataaacttcaaatgactataacttggccatttgaactcggaattggaccgttcaagtctctaatttttccttaagaagtcaagaacccatttttgtgctttgtttctgcttgttatatggagtttattagagtaaagtccttttcttttctgttggtcgtgtagacgctgcagcttcgaaagatccgctcttcgtggaggttgaagccgacgtttgggaaagcgagcaaggcaagtcacatcgtccttgaacatattgaatcccagtttataaaattattttgatttaaattattgcattaccgctttatttaaattcccgcgttatcactgttttatttagccatgcctatttacctttattatgaccttattattattgttattgttattattaccttgttcaccctagattaaacaaaaccccaactagtggacactctactcatggtaccactagtatgattttaggtagatgcttcactggttaattaggcaacattaggtggttttacaactctagaccttgggaatactcttatcacctggacactatggaattgttggattattgtggaattggattcacacctccccctctattcaaaatccccaaaatggttttacgctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacagatggagatggacgaagtcggggatcgatggacatctctaggacaaatgaaggctacatgagctgtggcccggtagtcgagatgtcatggcacagggccggtgtcctgctgctcggggctcagtcctgcctacctgtcccaggggttccagccgtaggtggggttgggtcggtattcttgtctatggctaggatgggttggaaactatgtcacgtcttccgtccgtataccgtggtggtctgcggcacgtggttacacgtgaggaagatgtgtcttgtgggtaaagatgtacacctctgatcagagtacaatctattcgaattgccgcgccctcggttatgggcaagccgagcaatgtacccaagttagtgttttaattcttaaaacctgcttaacaactaaaatgtggaataattggcctgggttggcttgggacgagctgggacccagggtcgggttgccagttcggtctgaatcatcgtaggccttgggttaaggcaggttcgtgtgggtccacggccttgattaataatattgtatagctctagaatcgtgtttacaaaatagcttcgagcaactaagtgtcttttaatgctgtttactgcaaaccctaaccctttatattataacccccttgtactccctttcatttattctgcacttatgggtgtgtattgttgagtacggtggttgtactcagtcttgctcaatttttcccaaacccagaagaggagtccctggaagatgaaggctttggtgtctagctcgtgcctaccgtcaagcgcctgtggtcgtcgccctagtcttctgctgtttcccgtttgtctttgtgtgtgctgggccttcgccgcccatgtaataaattaactatttacgcttccgcttgttgaactctgaactgtatcaacttttggtgtaccttgcctcctgggacaaggaataatgcactcacgtaaggaacacccgttgggttattttcggtcgtgacacacacaaacttttagcacagtgggccaatatacactctggcaaaaaactttggaggcaaccgttcttgcggcttgatgcgcactgcacagcccctagtgtatttctttcgctatttcctcgcctttagcaaaggatatgcagcgaagcaagcgttggagcaccccagagcgatacaactgccctgagtttgtatcttgtggctctgagctgtaggcgcttcgcttctacttcatcctctaggagccaaccattcttgaggtacttcacgaacggtgttcgccagtcttctgggtcttcgcccagttctgcctggtcaattgccatgatgtccaggctctctgtgggcacacttggtgcgtacaagacttcaaaaaatatgcctggcgaatgtggtcctccgcaagcagcggatttcgccagggtgtctggctcctcgttctggcctctaggtaagtgttcgaccgttatgcggcgaaacacttttccatagatcgaacagcctccagatacctcttcatgccttcttcctttgcctcaaaagatgtaacgccccgattttcgttcgggattaaaacccattaaataatgcattttctagatttttaataaaagttaaagcaatttaataaagtgaaataatgggagaatttgaaattttccttaaaaatcatttggccggaaatattttgtaatattctctgtgccctaatgaactctctgaaatttcccgcgaattttcggagctcaagaaataattttaaagtcacaaagatcatttaataaaattaaataaaaagaaaagcaaataaaacctccccttcctccttgggccattttcggccccaggtcccttcctcctcccacggcccacgccccctctcttcctctctcgcctcggcccgtttccccttcccctcgcgcaaagtctaaataaccccctgggttctcctccctctctccctccccgacaggtgggcccagcgaccccacttcttctgtaagtattttacgcttttatttatgtttggaactatattttacttgtcgttttgtgtaccctggctggtcctggacaggaatttaatacacaaaatagtctagaaatttgggctaaatttctaggcgtgacaaaagacttgtcaacgtggcttgccaccagtttggagtctgttcggataagcaagcgccgaacccccaatgctttcgcttttcttaggcccatcagtacagcgtcatactctgtcgtgttgttgatcgtgtcgaactgcagccttgtggcatatcgaattggcacgccacctggcgaagtgagtactgccgcggcgcccgcccccttgtgcgaccatgagccgtcagagtacatcacacaaggttgttcgacaggctcaggttcaaaatgacacttaaattatatcctggtttggtcttgtaataatcttttagatttctaatattttcttccccatggattataaggatggatcgtattgtgggaatgatattgttattagtttaacttataattgtctgtcgtggatgtccgtatttacaggggagactctgccgtaatttctaataattttggaagttagtggtttgagtggtttttggtgtggcactcttggtacgtggttatctggtgtgttacaattggtatgtgagtgggcagtaggtccatgggaagtaaatatgacaacttaaaatattgatcatgttttccttaggatgggaaaaatagaagtaaaatttgagttaaatttaaaccaataaaatttgacacactggtgcacagtaggatgggtttgggtcattctttgcatcacacttctgatttattttatcgattactgatctctatctcattgtatttgtgatttctggagttatgttgttactatatatatatatatatatatatatatatatatatatatatatgctcttctacgaataagacctgattgcataataagtaaagctaggaggtataaaaaaattattcagttttgattcgttggtgtggtgtatagtgtggagattaacgtttgcgcataactatattcggaaagctattagggagaacaacatggggtgttacagttatacttgaggtgtgtgagtgtacatgataaagttttagtttccctagaccttagttaaactagtttgatcatggctctaacttgtgttaatctcttttatagaagtaattaatgttgtatcctataagactcaatggtcctttaagaataggtaacttttcttccgtataggcaatgcaaagtggttagaggaggggactttttctttattttttttcccaatgccaagtgaggttgtccgagtgtgagtgttaggtcgtgatacatctatcactgtaccgagttaatagtttgggtatgggatggattggcccccatgtcatctactcattctattcttttcttacagtggtgagatgtgtctacatgttatgcatgatgcaccaaggtagtgatgtcttcacccgaaaagcaaagaaaaaaagtaagaaaaaaaaaggatgttccatttttcagacttgagattcaaaggcgatatggcttattagtttctttttgtgagttctattatgtgactatggttgaggtaatgaaaaaaaaaaactttctcattcgtggtacacgttctgaaataattccaaaaggaaaacatttgactctgcattcatcacttggtgacaaatattctcctgatttctatttttttttactttcagaaaggaattaacactaaatatttattttagtttcacttttgtggctttcattcgcttggttgttcaaacataagtgttgtgcgattgctttgtactgataaattataaattattgatatgcacaatactatttgaaaatactaatttaaatcttgttatggagaacttgtattaaatttgaatttctttaccaagtgatttattttcattacatggctcagaactgtgtgcagtattgatattcttggattgatgtccacacttatttgattattaatctttatttgaatttttttatagaatggctttcggattcgctatttgagttgacaaacaaactccaaaactttgaattttggtttatgagtttatggtaaaaaaatatttcctttttgtttttttttaaaaaaatcaagttgaagaggatgcttccttctacgcattttcttcaaaaagtggttttatactcggtccatgttctaaatatttccattgtctttacgtgtgattcttgaatttattacagattgtcattatcctgatctcagatttcttaagaaaaccgtgtttgagactaaatattcatttttttatgtgtttgttttgttgcttgaccttccatatttgattatttctttccaattacatgcacccaacaaattgttttttattgagtggatttaattcatttactttggaatgtttgagtttcttagaaaattcaagatctatcgatgttcagagcagtttttgaggataatgctttcgttctagttactcagaatgttcattataagtggaacaagtgtggcctatggtccttgagattgacttcgtagatattgtttattacctctaaataatttgcaatcaaagatagacttttagttgttgaagatgagcaacatactaataagatgtgatgggtgtgagtgtttatttctttaaattttaaattaaaagcttgtgttgtattctcgattcccttgagcgtaaaggttgttttcacaatttgtttcattgctttgtagtaagattcttcatgatgtgttccaatgatttttgtatatgtcccaattgggtgttttagtatgtgcattgcacttctttggcaagccaatattcctgtctagtaggtccaagttggtttattagctgcttttgaattgttggctaccatactttcttatgctagttaattattatctaccatacctagacgcaagcagtgttgcgaatataggagatgtcctcgaaattgcttgagagtcctaactactttatatgtatgttttgtgtattcctttccatcttacggtttctcaagctctacagtgggcgaattcgagggcgaattcgattgaagggggaggaatgtaataccccgtatattaaaagatatttaggtttttttaagtttggattgacttgttaaaataaagatgttaacagaaataaacaaaagaaaaatatctttagaagtgggccaacatgtgaaggcccataaaccaagcctgctttcaagcgcgacttagaccatttaaatggcaaaataaaaatatgctttctacatgaaagttgtaggtattgttctgtagatttttaaaatgtatacattttcagtcatagccttttcatatttcaagatataaagatttgaagcagcagtcttgtttatagtccaagcggcgttccttgttattgagttttgatgggatggggcagtaggttcacctttttcattgttttatacgcatgttcgaatgtgtttgctgaggttttgtttgtgattaggtggtggaccattagatcatgcatgataccaatctttcgttggaggcaagtgcatgacgaactaattatgcgattcaaagattgtttgctctatctatctatttgcgttatatttctatgtggtatgtgactgcttatgttcagactgttgttaatgccatttatatttcaaatttatcttatgtcacgacattattcatgtttcattatttcggatgttttatttatattattcaaggaccatgcgtagtcatgggagtgtaatttggatccttattcatgttcctgtcagtaagcgctgatcacgcttacttggatttgccgacaaatgctaggatgtattcactattgtccgaaatggaaactactatttcaattcatgcctgcccaggatgggaacttctatattctttgacatggtgtttggaaatgtgtttcctatcaaagaaagaaagccttatgttcatgctttatcgtcaatgatgtgtatatgtgttttctagttccatattgtacttgctgagtatttttatacccactcttgtgcaagtagatgtgtatataagggtgctacttcccgcccatgcatgtcggtctcaatgcgtacctaaaaccaaataaaacacaagagtgatgagctncttgcagagnnggaatgtcactcaaatgccatg

SEQ ID NO: 18326 - DNA, 4103 bp, Oryza sativa
  unsure (1)..(4103): unsure at all n locations
cgataaaggttagttagataggaaggttcatggctagctacaaaagagaggagctcggagagagatgcgaggttgatttagaagaagtttcatacgccagagttccgtagaaggacggaggattagagctgatagaaaggtagattggggcagggagaagggaagtcaaacggggaagtagaagtgcgagggagattcaagggtatgacggggagaaagcctagggtgaaaaagaaaggcggagggggcgtgcatagatacagagtgtaagaaaggaaaatagtggctaagctgtgaggtaaataagcatagcagaaggtgggagcaccaagaatgcaacaagagccatatgaaactggagggcgctcgtgcaaagcataggcaataaggcatggacatggatttctttttttgaatgggaacacattttgaatcagcaagtcaaagaagatagtagttcccataccgagcaggcatgaattgaaatagtagtttccatcacggataatagtgaatacatcctagcatttgccgggaaagccgagtaagcgtgattagcgcttacccacaggaacatgaataaagatccaaattgcactcccatgactacgcatggttcttgaataattgaaaaccagaatcaaagaaccaaagtgaaacacatccatggcaagcagagaacttgaattatttaagcagaacaagaatccagaatattaaaacaagaataacattgtacacataagatcaacttgaaatctaaatggggtgaacaataatatgaacataagtagttacttatcacgttgaaatatatcagaaataaatagatagagtaaacaatccatgaatcacacaattagttcgtcatgcacttgcccccaacgaaggattggtatcatgcacgatctgatggaccaccacctaatcacaaacaaaaccttagaaaacacattcaaacatgcgtagaaaacaatgaaaaaggtgaacctactgccccatcccatcaaaactcaataacaaggaacgccgcttggactatgcacaagactgctgcttcaaacctttatatcttgaaatacctacaactttcatgtagaaagcataattttattttgccatttaaatggtctaatttgcgcttgaaagaaggctttagaatctgtctagaatttcagactgtccacactgaaacaacctaactggagttctactcgcccaatcagggtgtactttaccaatatgaaagctatgaaaaacctctacaactttgtctataggcggcctggctgattccactgtttaaccccttcaaaaacagttcaatctactactatccagattatgacacaaaaacaacagtcatattaaaaaaattatatctcctaaaccacttgagataaaatcgttccctttggtcagaagatatatccaaacattatctacaacttcctagttatacacttttgcagaaaataacatttagagccccgaaacatcaaaacagtgaaacactgcaaatctgcccacatgcagaactgcaacaaaccgaacagcaactacccaaactccttctctagccttccctaaccacgaattaatacactaaagccatgctataacaactgatacaacaaggggacaagcctcacctaggctttctttagagaacttgtgagaagacaataggggagactccagtctaaccactccttctactcctctcctcctcctcgttccgtttttctacttcgcttcttgatgcaagctatgaaggtggagatctagggagagcaatttgctgtagatgggagagatgcgaacacaataggaggggaggaaggaggcgccggccaagaagaggggtggcggcactatgagggaaggtgggatttggttcccctctctctaggttttagggaagaactaataggctgagtttatgggccttctcatgttggcccacttctaaagatattttgcacttatttatttctgttaacaactttattttaacaagtcaacccaaactaaaaaaacctaaatatcttttaatatacggggtattacactcatcaaaagtaacttcgcaagtctcaacaattttgttagtttaaaaaacatgtacacgatagccacatgaatgtgtggggtaaccaagaaacattccattggtagagtgtgccgcaaacttatccaaatttccagatttcaagacaaagcatttgcaactaaaaccacgcaaatgtgaaactttgggttgacgtccaactcgaagctcgtaagaagttttaccaggtttaaacctcaagaaaatccgatttgaaatatagcaagcagtgttaaccgcatcagcccaaaattttctagaagtatgatactcatccaacatcgttctagccatctcaaccaaagaccgattctttctttcaacaacattgttttattgcggaatatgagaagaagaaaattcatgttcaagacccttttcgttgaaaaatggttcaaatgaagcatttttaaattcaccaccattatcactttgaattcttttcaaagaactaggaaactcaagatccaatcaaagatacaaaccacgaaagtgttgaaaagcttcatccttagttgccatgaagaaaacccaagaatatctagaaaaatcattaacaataaccaacacataccactttcctccaacagattgcactctaactggaccaatagtgtccatgtgtaataattgtcccggtgcatctgtcatcacagaaccaataggagcatgtgaagaagcaatcatcttagcacgacgacacaatgtacaaaccagatcaagatctttcttaagtttagacaaaccacgaacaagatccaaaccacttaacctcgtgagatgatcaaatccaatatgtcgaagtttacgatgcgaaaacatcgcatccttattaaacttagaaaccaaacatgttatcataggtaaaacagaattttcaaaatcacctttaaacactcttccatagcgagagatattcatcataaaatcaccacaagaatcaaatactttacttacaattttcttaaagtgaacctcaaaattttcatcgacaatttgtgaaactaaaagcaaattatactttaagtcctcaaccaaagctacatttttcaattcaaacttgtcatttaccttgaccaaacctgtggcatgaacggcactagtagaagcatcaccaaagataatcgattcagtcttggatgcctattcgagggagggagaaccaattttattaccggtcatgtgccacgaacaacccggatccatgatctacatgttcttttttctcgccaccaaagcctacacacaagaagatgtcgaagccttagtattggggctagataataaaaatttaggaatccagtactgagatacacgaccattagatccaataggcatatatccctgtcacgccgggaatttctatccaaaattccaagcgcttacatgtgtgttaaaccctcgtccaggaatcaaccgaggcacataatgacaatttgataatagagtacaaataaataactatcgaataatcgcaaataataaattattacagaggtggatagttcctctcaaagaaaaacattctacgcagcggaaaaaaaaaactataacaaactacggaacagctatggcgactccactccacaggcatcttaaccgagaacaagcctaatccaccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaatatttaagagaatagtaaaacgggtgtataattaatcaatattaaataaacaccacacaacacacccatgttgcataggcccaaccacatttgaacaaccaaccccagttgaacaaattaaacctnctaaccaggaattattcatttcaaactaggaattaaaataattaccacattattaccattaatgagttgtgtgagactaatcacgaaa

SEQ ID NO: 18327 - DNA, 742 bp, Oryza sativa
  unsure (1)..(742): unsure at all n locations
gggtttgttttagactccgttcgactgcagnggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggacttcacggtcagcaggagtttgccacgcgacatcagtcgaagattctgtatggaaatgggcgacgacagctnca

SEQ ID NO: 18328 - DNA, 720 bp, Oryza sativa
taaaggtgaagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtaccaggagatacaaatgggccg

SEQ ID NO: 18329 - DNA, 72275 bp, Oryza sativa
  unsure (1)..(72275): unsure at all n locations
cccacgccaagattgaccgtcaacgccggaaaccaaaaaaccggagttcgggaaggttttaaaaagcgccgggggaaggaaataccgcccggagaggtagaaatcgcgcgcgaaaaattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaacgcccagacccacaaggtacgacgcaaagaaagcatggtgccccatacacaagacggacagacattctttggaagattgccttgtttttaaaaagtcgttcgagaagcacatggcattggaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttatccgatcgtggtcgaacccactattcggaacatcaaggtcgcgcaggttctcatcgacggtggcagctcaatcaaccttctcttcgccagcaccttggacgtgatgggaatcccacgaagcgagttgacacccaccgatcaacccttccatggaatcactccccagtcctcgtccaaaccattgggcaaaattacgttgcatgtgactttcggccaagcaaacaacttccgaacggagcagatcacctttgatgtcgctgaattcgatacagcgtataacgccatcatcggttgaactgcacttgcgaagttcatggccgcatctcactatgcgtatcaagtgctcaagataccgggaccgaaaggaacaatcactattcaaaggaacgccaagctagcggtacaatgcgacaagcggagcctcgacatggtcgaacaaacgcccagcccaccagccacaactgagcctcccaagaaagtgagcaagacaaataagacgccgaaaccagacagcgcgatcatgatcgtttcgctctctagtgccaaccccaacaagaccgtcaagatcggggcatcactaagcgagaaataggaactcgcgctcatcatcttcctccgcgacgtgttcgcttggttgccgtccgacatgccgggggtccctagggagttgattgagcacaaactcatggtgcgacccgatgccaagccagtaaagtaaaaactgcggagatttgcaccagaccgaaaacaagccatatgagaagagctcgacaaacttctcaaagttggctttatcagagaagtatttcatccagagtggctagccaatccagtcatggtgcggaaggccaacgggaaatggaggatgtgcgtcgatttcaccgacctcaacaaggcgtgtcccaaggatcacttcctcttcctcgaatagaccaactggtggactcgacagccggctgtgagctgttgagtttcctcgacgcttactctggctgtcaccaaatcagcatggcgaaagaggacgaagagaagacagcattcatcatgccgttcgaggtattttgctatgttaagatgccattcggactgataaccgcaaggaatactttccagcgcacggtccagggcgcacttagtgaccagctcggcaacaatgtcgaggcatacgtcgacgacattgctgtcaaaaccaagacaagcaactcattgattgacgatctgcgggaaacatccgacaacctccgacgatatcgcctcattcttaatccagagaagtacacgttcggagtaccgtcgggcaagctgctcggtttcctcatctctggcagaggaatagaagcaaatcccgagaagatcaaggcaatcgagaatatgaagtcgcccacaagactcaaggaagtacaaaagctaaccagatgcatggcagcactaagcaggttcgtcgctaggatgggagaacgaggacaacccttcttcgctctgctgaagaagcaagacaaaattgtatggacacaggaagccgaagaggcattcgttgcactcaagcgctacctaacaaacccccctgtacttgttgctccccaacctaatgaagaattattcctctatattgccgccacgccatattccattagcaccgtcattgttgttgagagagagaaagtacaacgaccagtctactacgtcagcgaagctctccatgacgcaaagacaagatatccacagatccaaaagctactctacgcagtaataatgacatcaagaaagctacgccactactttcaagcccacagagtcacaattgtctcctccttccctctcggtgaagtcgtgagaaacaaagacgttgtcggccgcattgcgaaatgggtagtcgagctaagccagtttgatgtccactttgtaccacgaacagccatcaagtcccaggtactcgccgacttcgtagccgattggactatgcctaacaacaaatcagacaatcaaatcgacaacgaaacatggacaatggcgctcgatggtggactcaacagctaaggagcaggggcaagattcatcttgacatcctctccgaagatcaattcaagcacgcaatccacctcaacttcagggcgaccaataatacagccgagtacgaaggactactcgccgggataagagctgcagccacacttggggtcaaacgactgatcgtgaaaggggactccgaactagtcacgaaccaggtgcacaaagattataaatgctctaaccccgagctatccaagtacctcgcagaagtcaggaagctggagaaaaggttcgatcggatcgaggtccgacacgtctatcgcaaggacaacatcgagccagatgatctagcacgacgcgcgtctagacgagaaccacttgagcccggcacttttctagacgtcctgacaaagccatcagtaaaagaggtcagcggcgaagttaacccagacgcccccggcatcagctcggaggccacagaggcagaacgcgtcattgccgaaatcgaaaccacagacgactagcgcaccccactgatcaaattgatcaacagcgaagagttgcccgaggacgacacagaggccgagaaaataactcgtaaagcaaaaatctattgcatgatcagcaacgatctatacaagaaagcgccaaacggggtacttctcaaatgcgtctcgtccgacgaccgcagacacctcctccttgatatacatgaaggcatctgtgggtcacatgccgccagtcgcacattggtcgggaaagcttttcgacaagggtttttctggccaaccgccctcaaagatgcatgcgacatggtccagtggtgtgaagcctgtcaattccacagcaagcacacaaggctacctgcacaagcgctccagactatccctcttacttggccgttctcgtgctgggggctagatatactcgggccattcccacgaagacagggcggctaaaggttcctattcgtggcgattgacaaattcaccaaatggatcgaagtggtacccatgggggaaatcaaggccgacaacgccattaaattcatcagagggatattttgcagatacggattaccgcaccgcatcataaccgacaacggctcccaattcatcaacgccaatttccaggattactgtatcgggctgggagtcaagatatgcttcgcctcagtttctcatcctcaaagcaacggacaagtcgagagggcaaacggcatagtactacaagggatcaagacccgagtctacgacaggctcatgtcacatgacaagaaatgggtcgaagaactcccatcagtactatggaccgtacgcaccacaccgacgacgtctaacaaggagacacccttcttcctcgtgtacggctccgaggccatgctccccagcgagctacgacatcagagtacacgagcacaaaactattccgacgagtatcaggaggagcagtgaaacgacgatgtgaatctactcgaggaacatcgcgaatgagttgctgtccgagcagagggctaccaacaggccctctgccgttaccacgagaagcgcatccgagcatgcatactttcgatcggcgattacgtcctccaacgggttcaaagccaagcagggcgaaacaagctctcacccaaatcggaaggaccatacacgatcacacaagtcttgcggccaggcgcattcaaaattgcagacggtgacggtcgcgagttagcaaactcttggaacattgaccaactacgtaaattctatgtatgagtcaatagtatccatgcctgtaagacaccttacagcatcaataaagcctattttcaggcgcagattacaatcaaagtgttcctgcccgatgaccccttacccagatgacacctagcgttgaaacctatccttatgtccctttacgccgtcttgacaaggcctccgaagaacctaagagaacttcggctggggacgcccagagccgataaggccttgtcggatcctgtagagacgaaagaccatgtaagacctggtcgtgtaagagttctcgccgtgcgtattaaccaagccgcgtaatcggaaattaactttccaacttcacggctgggggctaggatcagtgcttgttcaaccgaggcaggtcataggtccaagagccttgtcccccgagaagaattcttcgacgaaaaggctggggctagggagagtgtacgactcaaacgactgaccaaagtcgtgaactgagaaaacactcttacacactatatccagagtaagaagaattcatcaggatagatttcttttctatttcgcaaaatacttcttacaactttacacaagtccaaaaccatattacattttttctaagatatctatcacagggtacaaagactaccaagaaggccaacgccagtccatagactggaaaaccttttccgccagcggcgccatcgacttcgccaggtggtctatctccgccggagtcctccgagaacgagcgaacccttcatggagaaactcgaggtgcaattgcggatgatgatctcatatgcaagccaacacatgccctccagcatatcggctcgatcgacggcattcctgcttcagggcttcgtcaatgcgcaggccgacgccttcgagctgagtacaggccgacgccgccactgtcctcgcctcggcaatatcgcgacttatcccgcgagcgccagcttcgaggaggtgccccatcccgacttggagctccccccagctgaggacatcggcaggcgggccgcgaacaggcccaagatcaccagataggccatggggcgtcgcctcccgacttcgtggggcaaccacgacgtcagtggaggcagctgtaggagacgcactggaggtctcaccagacccatcctgcgccggcttcgcccgcgcccacctacaaaagatcatcacatgcgattatcaagactagtcgccagatctccaaccaaaggaatgaactcaatcttcatctacttacttctcgcctagcgtaaccaacttctgtcgtcgtggaggtggcggagacacgtccgaggcctaagtaaaccaaggatgatttgaggaacgacttttctgattacaaggtcaatggctcaagaaacttaccgtgggggaggacgccttccagcgactgccgagtacggaggtgaacttccttcccctcctcggggggcggctcccgctagtcgcggcagcagcagcagcggccgcgttggatgcctcctgtgcgacaccctctttcagcgatgccaccgcctggtggtccacgagcggtccgatgacatcggtcagagggagaacctgcaccgcatgaagtcgttatctgatccaggagcaagaatagaggggtcgccgaatacactcacgttgattgcggcttcacgatcggccacctccttctcacaaagggggatggggatgtcacttgccgttgtggggccactgatcatcagttggccgacgcggcgctccaccgtttcgctgttcaagcctgcaagtcaaggaccggaattcggtaagccaggaggagcacacatataaggaggtcaaatcaaatgcaagaaaaataccccgaggagaaacccgggtcgtgtcctccggcccagaatagtcaaaggctggatgggctcgagcctggagcggctggattcgcctaccaacgaagtcggcagcgatttcatacccgacaaacttcgtgctcggaggtcgtcgatggcctcgacgaaggaccgaagggcaggggtcaaggtaggctttgtggtccaagatgaaatcttgtctggttgttcctcgggaacaacaaagacaggatccgaattctctatctaaagatagaaccacctcgcccgccatttgctacgagaagaagggcactggaagtggatatagcgcgacttcaggccatcccgaagtcagaatccgatgcatccagacacccggttggattccgtccaacgcaactcatagtaaaagcggaagagatcaagaaagggctctaccccaatgtaggcctcacaaagatgtgcaaaaatactgaggaaggcaatggaattagggttcaaatggagcaaagaaaggccatagaagttcaaaaccaagagaagaaattcagaaggcggagggagaaaactacaaagaatatagtcctcgatcgcaaccatgcgacccaggacaggctggggttcagtacctccaacttctctctccatgcctccacgaccgggaagggcgccatcttcctggagcttcttcagcgacgcgttggtggaggtggacttgccgagatccattgtcgactggagatcgccggagaaaggacggagagtaacgagctagggttttttgcgggagcggagaagacgagaggcatttggaggctggaaagtttctccacaataggcggacttcaaaatgaatccccaaaactcccttaaatagacgcacttccgatggtgcgaattccaaggaaatgagagagatggccgccggaaatttctgggtccgttacgcgcggcagtttttcagacttcagtttaaactcactcatgaccattgggcttcacacgatgttctcgactatgtcctgtctctacggttcccacaccaagaacggcatcagcctcgacatcagaagtcgcgattggttacacgagctcatttaagcagaagtcgggggctactgtcagggttacgggttaggtataccctttacccttcgatatacgttacatatcgatatggcatgcccgcgcatatatggacattctctgcatatactaaggaaatccttcacggagtttgcagaaaataagagtcctactcggacaagactgggtcgtcaatgtatcgtatagggtctgatgtctccgagttctacttggaaaccgcttgacctgcgatataaaagggaccccctgggaggacttaaggcatcgaatctcatagccaacacaacgaccacagcctacgaagtcgaagcctgcaggagccaaatcgccgggagatctagtcgaaccaactcgattacaatctcgccggtgtcatcgagttccatcgttccctttgtaacctatgattttccatcatataatcccatatcaactggattagggctattacctatcaaggggcctgaaccagtataatgctcgtctttttgtttgcttgatgtcgtattacgtagatccttgtaccaacgtaccccaatattctctatatccagtctacgggtatcacccgtcgataatgtacatatacaaagtttgtatatctttttatacgtgtatatatgttttatacagcaaaagtgtatgcgcatacatgtaaaaaattgatttacgtatatatacaaagtttacacacatattatattatatatatatatatatatacacacacaggtacaatgggcatcaaaataaccaggatattgttgtgaatttggctctggtcgcacgccccgtgtgggcaggcacggatcaatcaccctctactagggtatatggatgagatagtattgtatccggtttgttatggtagaataggattagtttccaaatctacctaacggcttgtttagtaactcgagggaaggggattgggagtttacacaagggaattgctgatgagattaagatgagaatttgatttttaatcccaatatcttgtttggtagatgtgatggaaattgatagagagtttagttggagattaggtcattaataaaaacagatggctgagatttgcttagacaaagtaaagaaggaattccctcccaattacctgcctctacccaggtattaaaaaggagagagttcctccctcaattccccattcctatcgcaccaaaattgtcatgtctcccaaccaaacaaaacacttaatagcctcatctctttaaactcccaatccctcctaaaaactccctccaaccaaacgggccgtaagatccaatccatgtattacaatatataccggtccctgatgcttaatacaatgtatcaatatttacagtatttctctctccctatactattcaacatagtatcagagcaggcgacctagagccgccgctgccccgggagagttccgatctcccgtgggtggacacctgttttttttcctatcttagtcgtcgtcttcgtgttctacttcttcatcgcgtggtggtcttcgcgtcgtcgcaaaaacagcaacagcaccagctacctccacgagtccacctcggtcaccgggggtcatctccttgctggctccatctcccacggtcgtcgtcgatctgatctgctcctccccgccggccgctaacttggtgttctgccgtcggcgcccacactggagctccttcccgccggcactgcagggcagccaccgccacgccgggtttccgcgaccgccactccaggggacccgttgatccacccaccaccgccgggagagcccctccacatccggtgcgccgctccggctgtcctcgccagtcgtcacggatctggcgcccaccaggctcgccactgcggccgctgcctctcggggtgttcgtcgtcatcccaggccgccggctggactcctactccctctgttttccacacgattggaaccgcctccgcaagcccgccgtacgcaccgaggtcgtcatcgaagcacgctccggttccagcacgccagggcacgcccggagcgaaagccgaggtcgtcgaccactgctccgctagccttgccatcgatctcctgctgcccatctctctctctctcttatctgtctacacgtgcgtggatggataggattttgagaacaggcaaaactggtatcttcccgattttgctgcttaccaaaattatgatctgttagcagtttcacatgtcctaaaacgcgatgtatctgttttccaattgttgtacgactaaaagctctttcaaaattcgcaaaatctaattagctaattagcttgtactagttgtgaagtcatgtaagggtggtttgtacgttggctgtgtttttgattctgcaacctagaccagaagctgcggctcggtacgtgactgtttcaacgagctgaggcctaagtcctgcaaagaggggagagcgggagattggacatcggctcggctctaatcatgagcttgattgcagtaggggattggacacgcgtcattagttcacgtggtgtcgcacgggcgggggtcgtgcggcactgccacagataattttttttccatgaaacagaggattggagttgacctatttgctggactgctactggtgttgctgctgctgttgtaccttttcttttttctcctgatcagagatcgggtttgcgttgctcatcacctcatcgacatttgcgcgtctctgacattagcatcgactctgcttcaattttatcatttcgcctcgcgcatctttggcttgatcacccgttcaagcacttggctacagttacttttgcaaccgatcatcatcgagcacgtgtctacgccatcaagctcgcgtcgtcccctcggaccggagtgcttctatccatggtccacctccactagttgttgcagtgctgagaggcgcccccctcaacatagcttcatcacaggtggactcttcgccactgcatcgacatggagctgcaactgtgttgttctctcggaccgcagctttgccactttcgtcgtctctatcgccacctacgcatcgacacccacgtcatccgcactgatcatcgtcagccacgcgggtcttcttcatctacttcgagcatcgccgccgcgtctccaagcctgtcactgttgccgctctaggtcgatggtccagctacctctacatagctaccaatgtcgccgtctaggccattggtcccgctacattgccttctacttcgtccagcattattcatcgccagcgtcgccgtatctttctcgactacacttcgctcttctccggcaattgcgtgctgctccggcaattctccctcttctctgttctcgtgccgcgactatctcgcaggccttctctgctagtctcctccgacattggcgtatgattcatggtggtcccctacctcgcccacgcggtattggcaacaccagcacgcgcgttcgtcccgagttgtcccggggtctggcaaaccctgtatgacgtctcgtccttcacgattcgactacatcggctcttcggcatcatctacctcaatgattgtcacgatcgtgtcaccgtcatcgtctccagcgcgtcctcacgcaccttggtccacgacgccctcccgtgcatccacgaccactctacggcgccccatgcgtgccctacggctcgactacctcgacatcatcggctcctcaattttggctacatcgaccacgtcaactttacgcacggcttcatctaccatggctccctcgcaccctttgctttggctacgtcaactactacacaaagggctatcatccgtattgagcattcttgctagtttcttctccagtccaagtgtccgcgctgctcacgtttggattgtgggggatgttagagtatatggataagatcgtattgtatccagtttgttatggtaggataggattagtttcgatctctatctatctgagtttacttaagatccaatccatgtattcctatatataccggccccaagactcaatacaatgtgtcaatatttacagcattcctctctccctatactacccaacaccctcattctatacatacatctttggtttctatagtaccctcaactagtctttgcaattagatccaacggctttaattcacatgcaaacattctcctacatatataaaagtgcacaatccgtgtgctctcctttgattggttgagattaaaaacataacaacagtaatatactatcaatgaattactcatgtaacggcgaaaaatacgagtgagccaaattcacaacaatatccaagttattttgaagcccatttctctatctctactattataaaaattgaagatgtttttgccggtatttggtatgccatccgtacatgagtcgatttttaagttcgttcgcatttgaaaatacatatctgtatttaagtaggtttttaagtttactcgcttttaaaaatacagaaggagtcgtataagaaatttctttaaaaaaaactcggatgctaacttgagacttctaaccgcagctcatgattttcttaaaaaaaatttatccaagcgaattcctacaataaatttcaccttaactaaactatataacaataataaaaattaaaatagcctttaagacgttgtgaattgctatgtagcagcctgctgaattttatggttgtgtcatccgaatttgaggtcgtcggatatcatcaagatcgagagcagtctcgtcggcgtcgacgtggccatgatgtggtcgacggcagcgaacggagactcgcaccgcacaaaaaaactacggcagcagctgacgagggtgcaatgtcttctggcgtgattgacgtggtacagtagaggcaaggcatggaggggtctccttggccgttgctttttatgtgactatggcacctatgttagtagatctggtgttgttttctattgcattcggctagatcaaagtttattttttctaatttgtcctatttgctgcgtggaatggagatgcaatctatcaagctatatacattcttgaggaatgtatgtgatctaaatctgtatgtaaatgaattcatcaaggattgtttttatcttttccacatgctaatttcttgacttaggctcagttagatctacatggtcatgcgatttcctatgctttgttagaaactaatagtatttaagcatatactttttttctccaaattcagtagatcttagttttgtttacactgaagttgactacttgtttttcattctatctgctatgtgaagaatactatattttctgagaaaagttttgggtataagtccttacattttcaattaattatatctatgttttatttagaatacaagagctataatttgtggcaagggctaagactcagtagaagatggagaagctaaatttcacatcacaatacatcaataaccggcagtcgattggcaatgtgagtataactattttgcaacctttttttgttagataaaaattagttttgtagattttcttagttttgtacgttttggttttgtaaattttgtagtttagttatctactaaacatgttttattagttttgttgttaatttcatagtttcattagctactaaacatgatttagtttggtacgttttggtttggttttcaacaaacattgtttaggaattttaaattttgtactttctcagtgtttgtcttatttgtctttatctttgttagtttttaaaattttgttcataatctcagtttcgtcaaaatttcagtttgcagtatttttgttcatggcaagaaacacttatgcggtactttttgtcacgaaaccctagcgatgcactcaggcacgagccacttgcccttaaggagatgcggttacaatttctattgtgaaagtttcttctcatgcccttgaggatatgcactcatgcacgggacatcttattacaccatcatggtcgatatatcatccgtgatgggatatgattgtgacccgttatgggtcatccgtgacatattacaactacgacccgagaaagataaccttgtatcgatgatgggtcatccctgatagtcatatcttaaaagggatttttttttgaaccattaaagatgagttatcccatacgagtcgcattagcccgacacggttggctcgtcaaggatgcccaatctgtactagtgacagatttcagatctggccttttttcacgttgctatgttgttgcctatgtttattgtcgttatggaggtataagagaacaagagagttagcatcatgagtgaaatgactaaaaaaaaccttttctgttgttaatgtgctctgatcggtgttttcgtcgcttgtgtgagtgaattatagttgtctctacgtgacataaaatgtttattatttgttacaagatttcttacttttaccaagggggtttaaactgtcggccacctgtaaaaactgtcggccatatacattcctgagtgtatacggtttgtcacctcccctcagccatatgtggtcggtaattgatcagattgccgacagtaccctcagcaacaatgtagccgtgggtttatgtacggcttttttttatcagagaccacgtatagttctttctcgccgacaacatttcccgagcatataccgtcggttattcattgagtgacagtataatataccatcggtcttattctcaccgagaggtttgttttctcgtcaaattgtgagaaccctcggctatttagtgaccgatggtctgcaagccttcggcaatggtatttgccataggtttttatagaccaccatccattcgtcaccctcacaaatagtattgtggagaggttatttaggttacttggaaaagtaatccaaccctcagtaattggagttttttcaaaaaaaaaataacatgcaaatttaaattttacccattttgaactaatcttgtaaatgtaacatactccatagtcacatcaacacaaaatccataaacagatccacaggaagttcaaccacagatatataatcaaattgttcaaaaatatttatcatccatcaccatagcaaaactacgtaattcatgacatgtcttgcatgaaagactttatttgaaagtttgaaacaagtctgtaacatttaaaataagatagattgagattaattctctaaactgcaagggtagtccatcttttacataagaaaaagtaagcttcatgaagttcatggtctccatgttcgcttttagataagccataaatcaatatcttcatagtcgctttcagacattccatactccccatcagcgtcatcactattgccctcttctttaggaatctcatttcctccctcttgataaaaatcattgccctcatctttaccaatctcatttcctccctcttgatcaaaagcactctgtggacaaggattgtatcttaaacattaggtactgcactttatgtagataatgttatgtactgcactagggctgagttctttcccccactttcccaactcacatatctctttttccacgcgtacgtttttcaaactgataaacggtgctttaaaaaaaattctatacgaaagttgctttaaaaaatcaaattaatccatttttgaaaaaaatactaatacttaattaatcacgcgctaatggaccgctccgttttccgtgtggaggagttgggttcccaacccaaaggagcgaacacagcctaaagcaaagttcgctatcacaaggatattttgaaataaacttatttccaacctggtcatgttgatattcagcctcttgatgatctggagcagacccaacatttgaagttgagggaccctacaattttgaagcaacatctatatattatgctacaagtatttagaaacacaagacaatgacatcataaaaatgaaacagaagccaagatgaacaaacctcttttagttgctctcatgtatactatcgatatcttgtcattattcaaatatagttagttactaaaacaggaacggaagactattacatattatggagagagtgaactaaccaactcaagagcatattgtttcataagggtattgtcacatcctgatttttgtttcaggatttataaattatttaataaattattattagaatttatattaaatgttctttaattttcaagtgaagttaaatgtgggaaataaaatttcctaaatataaagcatggatggatttaatttttattaaattctccatggttaattatactctctggaatattctcggatttttcggagctcaattcctaaatgatacaaaaaacagttcagtaattagttaatcaattaatgatctaattataattgttaaaagcttttcttgtttaaaaatccttaaattgttgtttaaaaggaattattagaaatgatcttaaaagcctaaaagagaagatctaattttaatttgctaaatctcaatataaaattggggtagataaaattttgttaaatacttctcttgaatctttagttcctagatttttctgggatttatttgagccaagaaagtatttttaataaatggaattgcatttcttgaataatttaaattgaaaaaggtttttaaaagtctcttttggctttgggccgaaagccggcccaaaacctctctatttctctctccctccccggcccagtcggcccagtccgccgcgtccctccctcctctctctcagccgctgacaggcgggacccacctgtcggggtcgtcgtcctcctcgagccgcccggccgaaccctagccaagccgcgccgccgccgctgcccttccaaattccgtcgcccctctctatttccggtcaaattgattgagggcaaatgatccttgagatctcctcttccttttctcttttggaaacatcggctaattttctttggaaaccggaggatttgagttggattcggattcatctctctcctctaaccctagactttccttctcgccgccggtcgccgtgggcctccgtcgccgcctcctagccactataaaagcacccccgagctctcctctatccgccgccacctttgccttagcccaccgtcgcgtctagcgccgcctccgcgtagccctagccgtcgccgtcgttgccgtcggttcagccgcgccgcgccgccgttgcagccgccgtcgtcggtcgccgtcgccaccatcgggatcacgaggtcgtcgccgtccccctccaccgcttcgccgccgctgtagcacgccggagcaccgccgtcaccgtcgacccgaagaccgccgccgcttcaacctcgccgccgtcgtcatccgtcgtcgtttgtcgtcgtccaagagctcggtgagttcgccgcgtcgccctctacccgttggtgtcctctgtttgcgtcgtcgcgccgtcgttcgccggcgagcatgcgccgcccaagccgtcgccggtgatgacgtcatcgctgacgtcatcgttgccgtctgccttataccgatcgtagaccgtttagatctcggccgatctttgtggatagggtagatctcggccgcctgatccgtagactgcagccgtgcacccggtccaccgtgaacccgacccgctgacgcaataatcctccttttccttttcaaaaataattcattattgcgtcataattcaattaaaatctatataaatgctttaatccgatttaatctttgaaaattcataactaattctttgtaacttagtttaatgtggttcaagttgcaaaagttttataaaataaagatctacatattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtactgtttatttggtttttattagtttttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattctttgataccttgggttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggttttgagagtcgtgctcatgacaattaaggaccggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacaagatgttgaggctgtgtcttgtgggtacagtggtacacctctggccagagtaaaactattcgaatagccgtgcccgcggttatgggcgggttaagcaatgtttttcgtgattagtctcacacctctcacaataattatggatgttatacctagtaataatttgcttagctcctggtttggagttagttctgtacagccgggtatggttgttcaggatggttgggcctgtgcagcatgggtgtgttgttcagtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatacagaaggagaagacgtttggcttataccccagttgagctgcctgtgggagtggagctgaagccatcgctagaccgttattccgctgctgttttcttttcttttgtaagtgtgtaacgttattattatgatggattgtatattaaattgtcagtttgtgtacctcggctgattcctggacgaggattttatgcacaaataagttcggaaattactagtgaatttccgggcgtgacaggtatcatagcccagtccactttttgcagccaatgcccacaaagttacaaaatcaagggcaaatagcagctatgtctaagtccaaacttaagctatcaaattatgattagaggttcaacattacagaggacttggttctcataattaagcagcagtctttaaaaagtgaattgacagagcttaggcaagcttcttctgctctctggttgcatagctgttcattttttccttgtttcatcctgtgtatgtgctgccaagcagcagcaagtccttgttgcctaccttttttatgttgctacattacaaataaattagtatatgcaacgattttatataggaacaagccctatgaattgctacaaattaacaagcaccaggtacagtttcgtagcaaccaagcctcgcgacccgccgcattggtatactgtatcacctccagctaacctgtttctccccccatttaaagatttcttcctaaattcaggtttactccagtgctcacaaagtagacgccaaccctcttgagtaattgaaaaatcctttggtttagcagaaatcaaagcttgcacagtaggccaatggttaccatgcatcctcatcaacatcctctattggtacattgccttttttatataacatattggtagctattttcttctgttcgaacagcacctgtggcacttccttcttgataatatacctttttaaatttcagattgcattgcatcatgcttacaaagaggaaaatattaataaaatatggcaacattttgaactaagatgtttgtgctgctgaatttttttttgcacaattttaatactattgaataatgttctcttcattttgaagtatatgcatgccatttcataaacttatccggtcaaagttataaactcttttaatgcaaacatacatgagcatagttttatcatgtgaaaaatactcccacaccattacatttataaagaaatgagataataattaatttataagattgggacacaaccaaaatggtgccatgaagcggtacatacagcggtggggggccgagaagaacgaaataaaaaaggaaaaaaatggctatgagaatgactcgcacggagaggatatatgagaaagtggagaaacatactgtctttgatgcgaagcacaagatgtcctatagatgaaaacattaaaaataaagatgacaactatgtgcttaatatggtagagagtagagagtccattaatttattgcgcccatgtgtccgtgatcatatctactttaatttgatctaaaataaagattaaagaaaacaagttactataaggacgtttgttttttagttatagcctatgcagtacagagtattttaccttttttttcatgcaaatatagttctctttgtcacatattattgccgaaggtaccattgtgaaccatcggtaaagttgtgtcctctcagtattttttccatgtagccgtgtcactctatcttggccttcggaaacatataaccattttcgagaggtatattaaaccactctgttactaatatatcccgtcggtcactaataattgtttccgagaattatattaaacccctcggttactaatataccccgtcggccactaataatcatttccgagagttatattaaacctctcggttactaatatactccatcgggccactaataatcatttccgagagtcattttaaacgtctcggttactaatatgccccgtcggcgacttataaccatttctgagtggtttcttatataactctcactcacttaaatatcccgtcagccacatgccaaatagtcaagtgttctcttaataacccttaataaccctcactaaaatttcaaatggtcggccacataaatctttctgaccgtttgtagaatttttttcttagacgcttggcaaatctttggattctagtagtggttggtagcttcatggtataagcagctgtcaatttgagcaataaattatggaatatcactggtacaaaacatttgtgcttgtttcttccaaaaaatcgcccgacttgtgacatgacgtgcgacatgccatcgtcatggatgcctttcttcctataaaaaacgaatctaggaccgaatgtaatatgttctagtactatgaatctggacataaggacatgccacatttgatagttggttttttgtgggacggaaggaataaattagattacgatttgttttcatgcttttttgacgtctaaggattcaaaaagttggaaactcatttatataggtggttgtgctaggacgaatgcttgtctctacggaaagttggcaatgggatcctatcgatgggccaagatccatggataggggcagttgtgccggggtcgagacgtcgcctcttctctatccttgtcatagaagtcgtcgtcggagaaaccggttcgtcgctccatgatgggttgattcctgactatatttatagttgatgtgtagggcaacctggttttgtacgtatgaaacaatacaatacatacaattaaatgaagacacgaggtttatacaggtaaaagtttaactcctgtttatatggattgatttgagatgttggagaatacggtggaaacttagtaggctaatctggcgacaatgggatctcgacgggagacgattatctgggggctcgaggtggatatattattagctctggcatctggcgatataaggttgtgtcttccattgatctgcgtttaaccccaaggccgctgcttatgtatacgtgaaaccatgtcatactcaatacggacttgggcaggttcaggagttcaaaaaattaattccctggatatatgagtatgtcgtctaccatcaatccccatatccacataataattaatgcatgtaccggaaaattttctttgtctgacaggtcggtatcccctatttatttccttgatatatatgttcaagtcttttactttgaatgcccaaacaagtctttgtagaaatttgtatataattttacaattagttgctttgctgttttgtagttttggtctacgtaccttttccattatcagataatatatctgatgtttttttctcttcctgccatttgttttagtatgatactatttgatattactatccccctctaatcacttcagttttccttggcttgttgcaaatttcaatctcttttctactagcaatcttccttccagacatctaactgaagctaaaggtactcaatttccaagtcattgtttgagtaaattctctgtgtacccctgaaaactcactcaatcccttttatacccctaaaattaatccgatcccttctatacccctgaaatttcaacttgatcctttccatacccctaccattatattttacttcatttcactagctactacatttggttgcaaatgtcttttttgcccttgatgttttaagttttaataataggtaaattggaaccatgccattgtacttttgcaaagtttgagatatgccatcggtatctcaatgacatgtaggacccacatgagtcaatggcatgtgggtcaggatgccatatctcaaattttgtaaaattataatggcatggttccaatttttccaataatataagcttgaaaaagattgaaaattttgtttgagtgcatagtatgtacatttttatgaaactaatgagactaaataaaacaaatgtactaaattaaaatatttatttgaaattttaataagacaatggatttttttatcgggagcattcataaaaaaaattattgtgagcattggtagtcctatctttatataaatgctcctcatcttttatgacttcttttaaataataaatacatattttttatttcattatctaaaaataaattttgtgataaataatgcatcacacaacaaactcataataataatagactcatgcgacaaacttttacatttttaataatgtaattcataaattctattttcatccaaagggtaaaatggtcattttcatagaaattagacggtcaactatggtcaactgaaggaaggagtatgaaaaggatcaaaatcaaattttaggggtatacaaggaactaagcaaaatttagaagcatagaagggattagctaaaatttctggatatataagagattttctcttataaaatgtctcaagtttctctttctcatacaacaaatttttgtacactataaatttatatgtttgcataccatagggcaaaaatagactttttcataagagtttaacaacgaactaacgcaaacggtgcagaagagatgcaaactaaaatttggaagtataaagggaatgagcatactgaagagcatagggattagacaaagttttaggcgtacacagggaattttctctttctcgaaagtgtatggagtaaccaactctatcatccaaaccttatttactttcctcaaatcggctttctatgaatatgaaacttcatttgttataacctactcctgctttatttgtctctctatctttaatttatgatatatccccatatatacaatgacgataaattctgccataacaatctttttgtaggctctaattttcacctgcacttatgcaagttgtcaatgatattcctctatggacagttatgtctccaagaacaaaactatgtaaaaaagaatcacctagcaccaccgtgcacacataagccagtaggaatttaggcatgtgcaatatataaatgctccacagtaatctgttatcctaactgacagctgcttataccaaactaccaacaaataataaatttttggtgtcacagaatgacaattacatgttccccaccagtgacaacacactgatcagacctgttaacaacggaaaaaggatgagtctgagttaatggcaagataatatcagacacgtacatcctttttatatctcaggatggagactcaattaacggctaattaaaacgacaaaagcattatccccgatggtttcacaactactgtagtatataaatattcataccgcatgtcaatcttcttactctagcattcctcgtcctgccctctaaaaacaaaagaaagaaagaagagaaaaatgagtaataagttacacaatagtagtagacattcatttctactggcttggcattcctccaacctcgcgattttacacgaagcaatcagaataatcccgagatatatcgtcgccattgtcgtggaaattctgcgaggcctcctcgtgatcctcctcctgggcttcgtcctccacctcgccggcggcgaccgccacccgccgccggggccgatcgcctgcgcgcgcggcggaacatccggcggctgcacggtcacgaacatctacggctccttccccgaccgcgccgcctgccgcgcggccggcgtcgcgtacccgcgcaccgaggaggagctcgtggcggccgtggcggcggcggcggcggcggggcggaaggcgaaggccgccaccaggtactccaacagcttcccgcggctggcgtgccccggcggcgtcgagggcgagggcggcgtcgccatcagcacgcggtggctgaaccgcacggtgcgcgtcgacgcggcgaggcggctgatgacggtggagggcggcatggtgctgcgtgacctgattagggaggccgccgcggcggggctcgcgctgccgcactcgccgtactggtcgggcgtcacggtcggcggcgcgctggcgacgggcgcgcacgggagctcgctgtgggggaaggggagcgccgtgcacgagtacgtggtcgggatgaggatcgtgacgccggcggcggcgagcgaggggttcgctgtggtgagggagctcgccgccgacgaccctgacctcgacgcggccaaggtctccctcggcgtcctcggcattatctctcaggtacacgtgttgccatgtactatatgcacgtgcttcagaaatgtccacgtcaacatgctcaggccaaactgcgtgcatgcatgcatggcagatgtggattttcattcctggatgggatatcccctcgttatttgcatgtcatataaatagttatttgcatgttatctaaatagttattaaaaagattaaaatatatatatatatattaatacgaaatatatcacttcacaaatatgcaagatcaaattcaacttctataagttacaacaaaaataacaaattaaactgaaaaaagttatcgcacattagtaactatatttgttatttttgctacaacttgtaaaaattgaatttaaacttacatgttagtgtgtgatatgtttcatattaatctatgttgccaatttttttatatattttttgatgactatttaagtgacatgtacgaaacaagagtatatcccctcaaagcatgaattcactttcccatgcatggcccctactctggtgttcttttgttttcagagagaagaaacattatgctttcgatatttttttttcttagctaggtgctgggaataattgtattttatgattttttttaaatgtcctaacgtattatatattttttaattacatggcaaacgtgcacacacaccactacgcacgcaataccacactcattccccatgaatgtgacgtccaacacatgctttaagaaaaccaatggtatattctatcacactaaaagtctttttcaaataccaactatatatgtgtaatattcatatatacaagtattaaatcctggtgggtggatatgatcgataacatcatcacaccactcgtgcttcctgggaagaagctataatttgggtgggcgctaatagtaaccatcattatatcacggtcatgcatgggagcacacttagagcaaggttaatagtatagccaaccaaatcatctatagctaatctaatagctcatttatacaatagttaaatataaaaatatactacaccattaatatccggtcccacctattatacacacataacgtcttggagtccgtgttgcagccggttacaaatctatagtccgttttcttctctcttttaccttttcttctcgatacgtggttatagttggcttgtagtttgctattgtacccgctcttagagcaagtataatagtgagctataagtctactataaacttatgtggagaaaagagataaccaaaaatcaagagtgttggctctcatgtaagagctaacttaacacaagctctaaaacaaatacagtaaatatatagatagagaggagtagaaaattacagccaaccttatagctaatctattataaatgttggatttaacataggctaacagtaggaagatagctctaccattatcttgctcttatggcaaagatgtctcaattaatttggggagcactctagcgatattcgccaatagtgtcctgatttcgatatgacaaatctacagcaggtagccgtgtgtggttgcgtaaagaataagacactatctccatgaaaaaaataaaataaaggcgtacaagtttttcgcacgtggtcttcaatatagaacactgattattaattcatttcacactatataccgccaacaactacgtatttaacatggtataaaaatattttcaaacataaagttgatatatactatatcataacagtaagtatatttatttaattcaaattattaattagttgacagccaaaagtagttttgtcgtgcacacacatgtccacgctttcctgcaggtaaccctggccttggagccacagttcaagcggtcggtaaaattcgtgaagcgcgacgacgcagacatcgctgagaaggtagcggtttggggccgcctccatgaattcggtgatatggtatggttgccggggcagcggcaggtgatctaccgtgaggacaaccgtgtcaatatttcgacgcctggagatggtctcaacgactacttcggcttccgggcgcaaccgacgctaagcatggtcggcgcaagggtcataggtgattgaattctttatcatatctcaaaattttctgagatgagtagccagggtagaaacctctttttttttttttcaaaattttccgtgcccctttcatttcatattataagttgctatgtggtcggtagagaaatttactaacatctataactccaataatgttattacatgtaacattaaaaatatttcgataatatatttgttttcggtagaaaatattgctccaattttctataaatttagtcaaatgtaaaaaaagtttgatcaaaaaaaataaaaacaagttataatatgaaacagagggagtaactattttttttatttattttttttagagaagggtattttttatccggtctgggctctacatccaaccgaatatatgcagcctttttaaaattagaaacttagcctatcaaacaagatatacgtaactcttaaaataatctataatttaaaattcgctcctatgaagtaactatttgaacattatattggcgcagatgagtgtctagaagagaatccaatgtacactgacactgcccgatgcctagcatcccgtgctgtcaccaagatgttcgacctcctggcgtacggcttcaccaacgacggcgccaccttcaccgggtacccggtggtgggctaccagcaccgcatccagtcctccggctcgtgcatgggcagcctggaggagaaggacgacggcctcctcctcaccaccacctgcccatgggaccgccgcacgcggggcgtcttcgcctacaacgtcgccttcaccgtcccgctctcccgcgcgccggcgttcgtggccgacgtgtccaggctccgcgacctcgacccggcggcgttctgccagatcgacgccaagatgggcgtgctcgtgcgctacgtcgcggcgtcgtcggcgtacctcggcaaggcggaggactcggtggacttcgacgtcacctactaccggagccgagcccgcggcgcgccgcgcgcgcacgctgacgtgttcgacgaggtggagcagatggcgctgcgcgggcacggcggcgtcccgcactgggggaagaaccggaacgccgcgttcgacggcgccatcgccaggtacccgaacgccggcgagttcttgagggtgaaggacaggttcgaccccgagggcgtcttctccagcgagtggagcgaccgggtgctcggcgtcggcggggcgagcccggccatcgtcggcgacggctgcgccatggaggggctctgcgtgtgctccgacgactcgcactgcgcgccggagctgggctacttctgccggccggggaaggtgttcaccgaggcgagggtctgctcgttgttgcgagacgctgccgatggctaccttcgcgatcgtcatggcaatgtcagggttaatgcaactagtacagggaagcattcactattgcacgaatgattttcctaaaaaaacaataggttggacacggattataactggtcgtgtctgtaaaaattgactcgcaccatatatgaaaatcttttatagatgtatcttaagaagctatatgtaaaaatagggcttttttccagaaaagcctcttaggcggccacagggaaatatatatttttgcaaatgggcctcttaaagttttacccaaatatctgagttaccttctcttttccgttttagcactctaattttttttcaattcatccttatctactctcttctactttctctcctactcctctctttctcatatccgtctctctctctctctcaaactgctctctcctctctctctctagcgggtacgtggcggtgggcaccctacgcatcaaaagcggtgaggggtgacggctgcaacggcagtcctccctgcttggatcccatgaatctgctagcggtggcaggaggaggagcacggcggctgcggcagcggccctccctcgcccagatccggtggtgggaggagcttggcggtggcggccggctgcagcggccgatgactggcaggtgttttgcgatttttcctcagatttttgtattcgcgtacagacgatgtaagtacccatataaaaaaatagcaatttttgtatacccttcggagtagatgaatcagagatccacacgtgaaagtcacttttgccgtcctagaaaaatcgtttttatccggtgattgtaatctttaggacttggcgatgtgcgacggctgtctttgaggcatggaattgtcgtgcgctgagttggcttatttatggaccatttatatattcgccttatggtcgatgtacggcattgtttttatttggctaccgaagcaaattaatcggtacaacatcgaaaaagacagtcaaacataacaatataagtgcgacaaggtaaagttgaaatgacaggaacattatttttttcttagtagcaaaatattttgaaatatgacagcagcgtgtaagatcgaacatctcaagatcacaattacataacactgagccatattatttgttaacgaggcacaactttaaaaatgtgaaaaagaacaagttcatacattctatatctataagcctacaagttcatacagatttttgctaactaaggatgaaaattcacaaatagactttaataattgttttcttctaatttgttggttttattaattgttctagttattattgttgcttgactattgactctctttgtgagagttttataataagttataaccatctttgaagcaaaggcctgatttatatttcattattgaaaaaaggctgaatcctagacatccagacactacggacacagcatcatcgctaagatattctaggaatagatatgccagttaacctctctattaatttaagccaaattctaccctgcacctaaatctatttttcatacagagtaaaagttaattcatttatttataccttgatttggtaacctcaaatagtgatcacaaattcattcagctatgcaactgttcagagaaaaaaaaacaataataaagtcattcggataatatgctggctgatgtgatccctgccatctatttcatcataaatggaaaagattggtatatataacatgtgtaaaaaccgctacaatgacactgagccatacacaacattagcaactgctatattctcaaccgtacaagcagttataatacttgaaatgaaataaattgatattaatgttgagatatcgaccgtaccacacaatattctgccagctcagtttccctttgatgctctcaacctactgacaattctgaacttttactccaagaaaacgtgtgtcatgtccatttttgctatttatggaggaccaaatatttatgacaaagttaattaaggtttatgttaacacaacttaccaaaccttgtggtttaagataaatatttacactggaggtatgggtcgccaaataaagggctattgtttttattgttataaaagcaaaaaatataataatacgctaaacatgttggttatttttcgaattatacctgcttggactaaaaagaagagtgactcaacttgctaatacttgattccgaattttgaaatttttaaaacactaaaaagagtccatgatatttttcgatcgcttgttttctttaatgcaaactcccaacatgttttcggtgatgataatccacgtcatcagtggatataatccctccgtttgcatattacaggacgtcgatcggtttgttctaagtgaaagttcttcatgctagaccaaatttgaaaaagaactagtaacatctgtatttataacggtccatattccacaaggcaatttccaaatttttggtccacctgcaatttttggtaaataatttactgttttgaattagcaattttgtttctttagaacatcaattttgttcaaaattacccgatatgtgttcaactattaagtgttccgtctcaaatgttgggcccatccatcctcctgaaatgtttgcaattttgaaatataaaactctggcatgaatgagaacggggttaagattaggcatatttactatcactgccacagacctcctcatcaccaacggttcaaagttgccatttgtaataggcaaattttattgtaggccattgagattttgtggttttacctcctacacatgacaacactacaagaaacctgttaatccatgacggattcttgttgacggattctaagactgtcactggtaggcgcgatctgtgatggttatcttattttcgtcatagatgtgcactagtggatattctcggccctctaactcgtgacggttttatttggaccgtcacagtttatgactataaattcgtcatactctagttggcccaaaacaataggccctctatcatatatttagtgcaaagaaaaataaaaaaatgtgattgcaaaatgaatcaaacccaaaagacaatttgtttttgaactaaattattttgttacttcgttacttgtatgcgtatggtacaactgaaaatattctgtatatatatagtgtgcgaacaaaaaaatatttggagcttgtaggtattgaacctagcaaacgtcataaggggcaaaaagcaaacgtcacagatttatataatgaatttctataaaaatatattaaaagttaaagcaatttaatcaagtgaattaatgaggaaactaaaattttcctttgaaaatcatggctagaaatatttttttaatattctaagtggtccaaattattctctaaaattttccgtgaattttcggagttcaataactagttttaataccacaaagttcatttaacttattaaaataaataaaaaacaaattaaaatccctctctatgtccttgggcctttttcagcccaagtgttactcactccctcccatagtccgtatcccctctctctccttgggccggcttccccttcccctccaccttcttcgggccaccggcccagcccatttgctcatctctcgctaagaagtctatttttcctccctcctctcaattaatttcaaaatattaaaacttcgaatcgatttttatggcactaaatcaactcgtataaaccagcaagaaaatcaactggattaatcgataaacaatttagttgacattatgtccttacaaccttcatttggaagtatagctgtctgcacttgcaaggaagtacggttatgaagaacgaaaatttagtttattttagactgaagattcaagagagaccagagttcatagagtcgaatggagaatgatcaagagcttggccgagttaatcataacgagtttgatcttgattaattagtctggtccaaaaaatgggcgaattgcgttgagagcaaatcaggaacaacgccagctatgcataaaggtaaaatatgacacgtaccaaagaacatgaacaagctgacctcgaacaaaagtacagaaggacgactattaagtggggatttttgcaccattcaaaatcagaaactcaaattcaactttagggcaacaaatttcagccaatttaccaattaattaaaaaaatatccaacttttaaattaggagtggcagtgtggcacctcgcaaatgaatacattttcaacttgattctttcgtagggatatttgtgtatgactgcacctgccagaattcaaactcagtatcctggttagtgtaaaggctgaaagttcgcgaaatgaaaatttttaggtgtcacatcggatgtttgaccggatatcggaaggggtttttagacacgaataaaaaaaataatttcataactcgcctggaaaccacgagacgaatcttttaagcgtaattaatccatcattagcacatgtaggttattgtagcacttatggctactcatgaactaattaggctcaaaagattcgtctcacaatttcccctctaactgtgctattagtttttcttttaatctatatttaatgctccatacatgtgtctaaagattcgatgtgatgtttttgaaaaaacttttgggatctaaatggggccttatactatttcctgtgtccaagaagttactcaatagaaatttttcagaactatagaatatgatatttgccaagcaaagaaaaatgacctctggtgttccaataaaacagaggttgcaaggcatcagtcacacatctatctataatctatctatctatttataactatactaattaggcactttctacgagctcccatgttaattagaaagatcttatcgttaattagatagatcattttatcaccaccgttagattgaatatattatattaaataaggcatacaattaaataaattatgggctcattagtttaatgtcaccaagttaatagtgttgttttataatctcacgtatttcactggtgcggctgatttgggcgccgatctcaggattcggccagaagaaaattaaaaaaaaaggaagtctaacatggatccgatctaatatatctactccgtctgttctgttcgctaatgatggaaaaaactgcgaccatggcgccaccacaccgtgatttttcacttttgtgggctgttttaaaagcctgtcaaatcttatgtccaagggcacacatcaataatctatcttagatctatcttggagagtattaaccaatcagccaggcaaataaaatatggggacacgaggccacaagtggaacgagattgatttttccgtcaatcaaagattgatttttgtctgagacgacacagatcagaattcatccaggctcgctcatatacaccaacatctatcatggcatataatttttttgaggggttgacaattgataagaaaggttcactcttagtacatatttaatttatcatctttttatcgtctcatctgtaatatatacaggtaggtagctttcttattgatgctgatctcatgttgtataaagtactgctgattttatcgacataacgatctgttcttttttcccttttttttagcatggatagttcaacgttatcaattatctaaaaaaaagttcaacgttatcaaccaatgtacctgcatctcccctgtgtgtgttttagctgaagcgttgcatgcgtgtagcataagctgtctacatgaagcagcttaacagaattcaatgacaaggtgattatggattcatggaagggtcaatgcattaagatgaacttacaagaaaaccaggtttgaacccatttttatccggttatattttaatctatttttatttgattaagtacatgcatttacgtttttaaaagaattttaatgagataaggaatttaccgctggctcgcgagcgtgagaaagagttgtgtgcgtctgtgcatttttctatgtgatgaaaaaaatatacagagattgatatgaacaatatattaatagcgcgtgcaaatacgtgcagaaagccatcagtaagaaattttatcgtcaaccaaattttaataatttgagacaccacgccaattaccaagcacaactcactattcatttgttaccgattacaaaaatatcaatcaaatagggaaaaaaatataactgagactctcttcatacttaataactcataatttctcaattaaattaaaaaaaccaaaaaaactatattgagaccttgttgtgaattaagagattagaatacaaataaaactgtaatatttataatattaataataatagcccgtgcaatgcacgggttggcggctagtaaaactaattttatataaacttagttcacctttggacaattccaaaatatattataacatgaaacagagtattatgagcactgcatcacagcacaacttaatcaaagaagcagcgagtattactcacgatgagtttgcagccttctccagcagttgccacagctcaacgacagcagccagaattaatggtcctccgggttataatagttgttgttttgaacaagagtatggtctctgaaaaaaataacttagacattattttgtattataatatgcacagaagtgttaacaaatatatgattttattaatgtactttataaaactaatctatgcatatagtcaccatatttttaaaactaatctttgcatgtagccatcatatatgaaaggcaaatattttagaaatgatttataatcaaagattctaaagtttaatctcacccttatctaaaacgacatgtattatcagtccggatagagtaattatcttattcctgagaaatatgggcaggctcgacgccacatcacagttcctaagatttggagttaagaggaatacactgtcatggccgctcaaaattggcttagacaccagccaccggtgaatctgcgggccgagtctgatcaaagtggtggctccccacgtgaaactgcacaaccacccctcgctgacattgttttcacctgtagagggcttttacagtgcttgagaggtatggaaggtaccttcctccatacttcaaatccaccattgatttataaaagggtaaattcggaatatggagaacaacgaaaacaaaggcagtttagtaattcttttagccagttcagtaattatcattcgttaactttctcttattgccgatttgatttcctcatggagtaattaagatggtaattggctgctttctcatcgctatgtgtcggcggcacttgggtacaatttcctacaaataaattgagagtagtattgtttttttcatcgcaaaagcattacttacaattggaccattcataaattctcttcgtataataatacataaagacaaaaggcatatacatgtcgattctcccctttcaaaatatttcaacaataaatactgtcaaagttgattacttggttctttgatcaaagttttgatcaagcttagttagatgagtatgtttatacttccaaataagtcttacgcaagattacaaagttcgatgtctttaattaatcgtactgctaattgttccctagttacctaatttcaagcacagttaccgagtttatctcagtagttcgttggaaacaacagttgctttctaatttgatcacaggtacaaaattacctatatgaccatctaactttttacttaatacctggcccatatttttagtaccttcatgtaactatcttttgttatatatcgttggattaccagctatcaacggctataatgtctcccaagcatcttagaaagcctctcacctgtagttcaaccatcggcccatttgggtgtccaaacagaatatctaaaactcccaaagtctctcattccaattaggcgtgatcatctccccaactgaagcaaacaatttcaccttgatctcctcacccattgtcaatcctgggatgttacaacataacatatggctcgttagtactctctcgtttgtatgaatttccttgagagaagttatattctatttatgctatggctactcatgcagcccataaatactgcaccaaccacaaacacactttgttttgttagcaatatagaaacaaaatgtatggttgtggtagggtatattcatgtgtcatatgacatgtgtaagaaaggatgagcagaaaaaataatataatgtatttaatgatcatgcaaattaaccaattgcaattttctcctgttcagcgaagcaaaatctcctgttcgaggtgaagcaattttcttcaatgtcctcactaattgtcagtactagaacttcaatgtcttgaactcggtcacacgtacttcaatgcacctttcaccaagctgttttttgagatattactgttacattgcagtagtatcttgaagtacgttacggcacggtgagttgatgacaacttgagaccacatgcagagtctgagaggacatggactgaccggacgacggctgaatctaaacatttttgaatttatctaaactttcgtatctgcatcattccaaaatgattcttccttcggcaatctatccatcaatcggatatgtgaggaaaacttgaggttcccgctgaagttacatccccaaacaaagagtcaaacctcgaccagcagaaattcctactgtctcctattcctacgagccacacatttggctgaggctatgaaaagacgaagaaatattaaatagtgctagaatttcacgataaaacatatcttgtgccttttttccatctttatctgcctcgaacagaaacatgtctctgcaatttatgaagatacctagaaggctagaagctagggaagtccacgaataaatagagcaccaccagtcacacccactttccatggccagagttaagtgcaatatcaatttcttatctgacaaggtacacaaattgaaaccaaatcttgcaaacaaaaactaacgacacaacaatttgggatgaatacattgttttttttattcataacaattaggcaaattttgttgtaggaccctgcgactttgtggttttagctctagaacacgttaaaagtcgatcattagggaaagacactgtcaaaatgtgattatttcctgatagacaccgcaagcattaaattctcggactttactcttcgagctcatatcacttttaggataggtggagaaaatagtattttcatgcctctatttctaatttctccgtgacctaagatcacgacaccgaggattgtttatttccataatataataggttcagccaaacatgactgatctgcaacactgaaataaggagaatgtaagtaaacaagtcctcactgacgtcgtctgtcttgaagctgttagctcgagcaggaaccccatgtgtccctcctcagggtcaggatcaccactaattggcgattgcttttcctcgaagaacaaggagaagaacatcatgaccgatctcatagaaccagccccaataacatatcaataatcgaactcgaaagaaacgccatagaaggtctaatactgaatataacaccaaggcacgttattatctgttaacgaggttcagccgaaacctacatccccaaggcactaattacggacactactctcttatacagcatattacagtgtatctaggtatccaccctcctagaactacttgctatagtagaatggctagaggatagttatacatgtctgcaagagctatctgtcaggctaaaggctactcatttagtagtactacagtagtgaatatagtgactgtaatgggactcttcaacctatctctaatgaccagtaaacttgtggtgctgcagtagtgaatatatgtgtttctcaatcgaaactcaaacaacttttgagaagaaagcgaacagttgaatttgttattctttgacattttcttgacaggagtgtatagcattttttggaacagtgagcattgaacacgtatgtataaccgatagcctcgcgcggcaggtgaaatcgaagatggcatcacacatcacgattcttccaaatccatggccataccgggtgtttggtagtggcacacggtatttttgggacgttaccgtgttcctgttcgtacacccgtaagctacctagtgttttgttaaactctcggtaacatttgggagcatacgggagctttccttgccctggtagtgttcgcagccagggaatcctgggactgcagagtgccaattcaatctatccaagactgcaatataattttctgccagtaataccaacaggattttgatctgtgttctgttgtatgtgacgatatgttgcaacagtatgttcgattctttgtttttgtcttcaaagttttcgaatgaattcaatctttttaatacacaaagagaggttccaattttctggctatgcaataaaccgctcaggaggagccagaattcagcgatgggagtacactatttactgtggctaattacctaattccccacttgtctccatcacttgaatcatcactgatgcatgcaggactggtaattcctggtttgccggccaatcaattttgcaagactggtatcgagtcctcaccgacggcggtgattgccgatgaccacacgcctgaatcctctaggattccggcgtttaccaataaagtacttgtttatctgggccaaattaacagaagattaaaaggtgttgtggtcacggccaatgccaagcaaatcaagcaagttgaacaaactgtgaaatgtgtagtattacctgtgcggcagcagaataagaaccaaatttcctgatgcctcctattccacacatcatatgcactgctaaaataatttctttttgatgtcatatgaaaacttgaatatcgtggagtgtgtagtgctctttccgtcgtaagatgagcctgcactatttacgcaatggaaaggtaaccacaaccataatggacaatggttgtgcaccaacagcccagcaaccttcctattaaatcacagtacatggtagtactatctttcagttactgcgtactctctcaattgcacattataaaacaatttttcatgtcatctctcgtcgagattcacacatgtaattcacatacatagatccatgcattaattaatctattaaaaaaccaaaatgtcttataatgtaatcatagatagtagctaaaaagtacacattacatatattcaagccaattctctcaataaaacgaccaagaattaatataattcgcagaaactcttgatggctttcttttcacattgtcgcacaatttacactattagccgttaacccttgcattacataatcaatcataaaaatgttacaaatgagattttgcaattattaaataatgaaagagatcttctatggtgcttggaaggcatgacagccattgattacatacaatctgacatataacaaaaggtacgtagagaaaggtactaaatatgtgggctaggtattaacttaatacattaagtaaaaggttatatcagtaattttggatgcataatcatctgatgccgttgtgagagccgatacagatacagatcgagagaacatacatgagcgatctgcagcttggatggctcaatgggaagataattatctgtcatggaggctgttgatcaggatgttcagtaaatttgattgaaggcaaggattgctccttgatcaactgtcgtacataatgaatggttacaacaaattgtggaaagaggacgggaaggtcactgcttcctgtgtctatggattaatcgaagataatagtatgatcttttcaataatcccattttagatgagaatcagtaaaggaaagaaggatatggaacaaattatagggacggacggaaaactcagtagagttctagaggtcacagctaataataattactatactacccatgtttacgtttttctattcctaaactaccctttaaggaatgaacggtagatagtttatacgagaggaggtacttggaatacctttcaagaaccgtgaaaggcctcataatgaaaatagtatacttgggatactgaactgaggacagtacggtatttattaatttcgatattcaggtactcatcaggtacaactcaatactactcctattaatttattgatgtaatgtttttgaacaaaatattgacatatttagaccacgctaaattatgcacccctaccaaaaaaattattatgaacatttgaaccggattaaaaaaaatcaaagagacataagatataccgtgttcttataatcagtgatggctttcgctagtgcaaactcatgttatatatttatgttccagatgtagatggagccgatgtttaggactgcgaaacttacctgcatccaaaagaataaatacttgtttgtcagtaaaataagttgacccattttctcgcattgatgtcgatcaacatgtcaatgaaatatgaagggttaactaaaggatcatgtgaattggtatattaatccatgatcagattgaatacaacaattagttcaatttatggtaaaatctggactaaaaaaggtatttttgagtgccaaaaaataccttacccttcatattgctagtacacgataatcataattgtacagcctgattaagtatattgtgacatgctatatatctgtatgtttacatatttctttttttctaagtgagaagtgcaaattccatatgcagcttacttttttttatgtaagtggttgttgctacactcaggttactagaaactttcatgatacaaatgctattaatggtttccttttacattctctatcttgaggaaaacaactgtacgaacgaaaattgccatatggaaataaaaccaacaagatgttgaagaatctgaaggaactttggtacgcgatgttgatcattctttaaccaaagcccttaataagaggacatgcaagcggctggacttctcgctataccctctccatttcttgttatatgtcactttaacttttttttctagttagatattttcaagtttgattaaatttataggaaaaatagcaatactttaaacacaaaacaaacatattatcaaaatataattaatatgaagataatttggtgttacagatgttgctagatttttctataatcttgatcaaactaaaaaaacaacctataaaatgaaacggattggagttagtatttgatatttctggttggactagcatggtatatctgccaacctaaaggtcactagcccaacagtagcactgtatgggcttgtgatatagacaatgagcacagcatcgaattactctgaatctgtctcgctctaaaatcaatacataatgaatcactgtcagtatgaatcatggaaagagtaccactgaaattcctagtgtctcccatcccaacgagctgcgatgtgttggccttgtttttggtttatagccaaataaattagcactgtcaaaaaaaatgacacctgtttggtttggaaccaatatatttggcatagaaacaaacatgcccaatttatatgctcaatctcacccattttcatttgtcaatcatggaatgttacaagaaaacttatgttatatatgcggtctcttctcatgagtttcccttaattagaataggtgtacgctatttatggatgctctggctatgtatctcatatatagagaatgcaccagccgcccataaattaaactacttgcagttacagtgccatatttaaaatatcaaagccatctctgcaaaatcataggaaccaatgaaacagctcattttccataatctttccctttcacattcataatatagagctatagtagcatgaaaaggctgtaacacattgtcaggatttgctccttcgttcatattataggttgttctagatttgtttcaagtcaaacttatctatgtttgaacgcgtttataaaaacattcagcatcctttcgatacaaaaccaaaatatattcagtgaaagacttaataaactattttgttttgtagatattgacaagttttctataaacttagttgccttaatacagtttaacttggccaaatccaaaatgtattataatatgaaacagcgagagtattatgagcaccgcatcacagcacaacgtaatcaaagcagcagcctagaatgaaagatcttactcatgatgagtttgcaaccttctcgagcagttgccacagctcaacgacagcagagccagaattaatggaccttcgggttgataatacttgtcgtttggacaagagcacggtcttaaaaagcaactttgaccattatttctctattataatatgtttgaaagtattaccaaatatatgattttattaaaatactttttaagactaatctatacttgtagtcatcatatttgaaatattttaaaaatgaatcataatcaaagattttaaattttgactccacccttatctaaaacaataagtattatcagcccggagggagcaattatcttattcctgaaaaatatggccaggctcgacaccacaacacagttcctaagttttggagttatgaggaatacactgccatggctgcttaaatttggcttagacaccagccaccggtgaatctgtaggtagagtatgatcaaactagtggctccccaggtgaaactgcatgaccacccctcgttgacattgttttcacctgtagaacaaccatcggcccatttgggtgtccaaatagaataactaaaactcccgaagtctctcattccaattaaggcgtgatcgtctccccaactgaaccaaacaatttctccttgatctcctcacccactgtcaatcctgggatgttgcaacagaacatgactctctttggtatgaatttccttgagagaagtatattttatttatgcaatggctactcatggagcccataaatagtgcaccaaccaccaacacattttgtttcttagcaatacagaaggaataaggttgttttttcgtacaaacaaaatgtatggttgtggtagggttcatgtgtcatatgccatgtgtaaaaaaggatgagcggaaaaaaatacccttattataattaacataatgtattaaatgatcatacaaattaaccagtagatttagatccaccaaataatatcaccagtggtaagatttgcacaacatatttttgatagttttctttgagcgaaagaatttttcttaatttaacatgaactagtcgaattttacacattgcacacataccaatgaggataattccccttccatcacatcttcaaatgttatgtcctagtgtttgatgagagcacttgatgcatccaaaacagcgtgcaagctcgaatggaaatgtcgattgggacatggatgcattcttcaatgtatcccctacttcgcaaaatgaaaaatagcaaaaagcagtgtaaactatcgtttatgggttcagttgagcagaggcttaactaggaaaaatccattagaattatttgctaggctatgttatggactgtatctcttgatgccgaggccgcaagtcctaaaatagatacattgggaaaatagtcacacaacatgtttatgttcggcatggttgtctgcattatgaagaatattttcataatattcgccatagttacgctcacaaaaatgcgtttaaacacatttattttccgtttaggtatcaaagtacctaatcctacccagaagtgccgtagagcttcgaaaaatggccatcttggccttttttctcgatgacatatccccgtacacgtgagctccgacaaaacaacacccaagcttttcctaacaacacgtatcaccttgctttcccttactgcgagaagtcctactatacccaaggtagttgttcgctcacttgctctaaaacactaagcacattctttcctttccgaaaagcggtccctacaaaaaataatatttgattttcaataatcatagtggaacatgtgagaatagtcagactcatatattgtttgttttgctacctttatttcataagcaaaagacctcttagctagccggggcaggcgtgtaacctgatgtgcccatctcatttattcactgtcgactattactctttttcatagtacagtattttaagtttcctcactccgattaattgtagaacaagaatgctcggacaaaagttcctcactgaggcgagggttgcctattagactagatgaccaatggaaagcggatccaactctctatctgcaaggctaaatcaataattcaagtcgcacactcccgtaatccgccttattttctttccatcccaaagcaggtcgagcccacttctgaaccacagccgatgggtcctccgatcctgagctggaatctacagagatttaatgagctcatcaaccaattcatatttcttgttcacagaacagatttatggtcaaagagaacaaccgcgtcagaatttagtctgttcataaatggcgacacatgcacattgcaaacaaatcagttgctcgcatgatgtgcaattgaacatttctaacggtcagaaaatttcaatctgtagtgtttagattgcagggagcatagactatcttgtttctgcacaaaagccccagcttttactgaaagcataaatgtgtactatagaccatctagtttctgtaacactaataaatcttgttgaaatggattaagctatgcgacgcacaatcctaacatcatggcgaacctcatgaattcggtaatcttacgagtgtaagccaagcttaaatgggtaaataaggctgagtacatgcaattggtatcccctctgtatcacatttcagcgcacaaatctcctgctcaggtgaagcaattttcttcaatgtcctcactcattgtcagtacaagaacttcaatgtcctcaactcggtcacacgtacttcactgcacctttcacccagcagttttacgagatattactgttacagtacagtactatcttgatgtacactacggcacggtgagttgatgataacctgagcccccaagcagagcctgagaggacatggactgaccagacgacggctgaatctaaaccattttgaatttagctcatgtttcatatctgcatcattccataacgattcttccttcggcaatctatccatcaaatggatatgtgaagaagacttaaggttcccgctgatgttagatccccaaatgaagaatcgaacatggaacagcagaaattcctaccgtctcctattcctacgtgccacacatttggctgaggctgtgaaaagacgaagaaatattagatagtactagaatttcatgataaaatatatatatcttgtgcctcttttccgtctttatctacctcgaacagaaacatgtatgtgcaatttatgtagatagctagaagctaggcaactcacgtataaatagagcaccaccagtcacccactttccatggccagagtttagtacattatcaattttttgtctaacagggtacacaaattgaaaccaaatcttggaaacaaacactaccgacacaacaatttgggatggccacattgtttttttattcataacagttaggtaaattttattgtaggacatcgtgactttgtgttttagctctagacaatgtcaaaagttgatatttggaaaaatacactcccaaaaggtggttatttgctgatggataccacaaatattaaaatattgttttctggttgtatacgagagaaaaagcgtgaaatgtcaaaaatgcccccgcgggcccacttatcgttttcttcccccacatctcagtccctctcacactttggccacagcaccatttccgcttgccgccggcgaccaccccggccctccctcttagcctcctctatggcagcgtggcttgacttccctcgtcgcgtttgggcggcagtgtggcctagctcccctcggcgcacacgtgtagtgatgcggtccgtcttccctcggcgcgcgctggcagcgacgcggccccgctccccggcgcggggctgaggcatcgagcggtgtcaaccctaagctgccttcaagtgaagaaggtggaaggggattatggcactggtgctaggggtagggagagcgaccaagagagagcggcgccggtctgacgtaggaggagggagtgtggcaccaactgacggctgagaagaggaaggagctggctgaggggattgaaaaagagagattcgaaggtgcaatttgttcacaatgcgttgaaaagtgggcctgctctcgccaagttagcactaaaacactaaataaataggtgcagtgttcgctaacaaataataaagtatcttcccctataagtgactttgtgcggtgttcctctgctagagaaagtaccgtgaaaagaggtatatatgacggtatatgagctggtataaaagcacaaaatgttattccaagtctagcctatgcaataataaacaataacattcatcattttagttgtcgttgaatagataataagatatataaagccaaaggaagaaagaaacattaagagtactgcccatgccaacttgccaacctatctggagatcttcatatttgaagccacagctttcgtacctgcagaatatgatgaattaaacaagcaacggaactggccgtcaaaacatttaccgacaccggaacttaattatatttttgatggatcagccgtacaactgtagaatggttttgtacagggacgacgccagcacaaagttgcaatacactgttcaaaatcgccaggacaatggttcaacaactcaaactccaattcttgtgatatgcatcacaaacatgccggatgagcccaatcacaatattgaagcttccgatgataacacacatcgtgttagctttcattaattgtatccgcacattgtcctcacaaacaatgatagactagcatgctcaacacgaacgtcttggatctttcgagtttttcgaccccatgtgttcacagtggcaaatttcaatgcaagctatcatgttctagctttgtgtaaccctactgccataagtaaagttcatcggccacttttcctactgcaaatgaaattcctaatgccccccatattacaacaagctcatgcagcgtgatgtacgctcaaagatgctatagggtgccaacccaagtacgcctttaagctcgtaaatttgtcattgatatcgaatgcatctcaaccaccagccaacgttttgttgtggtcgacctaacatggcatacatataccactttatttatatattcattttgatgttgttagtatggtagcactgcacaacgcgtgttggcacgtacctaaggacatctatagtttttggtttgaccagtccgatcaacaagccaaacaaaatttcagttctgtagatgcagaattaaaatctatttgtgggatccacgcaaaggaatcacccaatcaccagtccgttctccatgcatgcatgcatgacaaataatttcctattcattcgttggattacaatttagagttcgatagctgcagctggtagaataggtggtgaataacaagttctatttgattacatttggacttggagtcgtaatagctggtagctggtggagttaaagttggactctgtaatccgataactctctttaatagagaggggggcaacacaatgtaaccatagcgactacaatatagcatagacacgcagggagatgatagcggcgagaccatggactcgtagcggcttagagatatattggttggggaggaacgcccataatcagagccccggagatataggcttcggatgaacttcgttaacaaatatcgtgtgttactgtgtcttcatctgacgtgtcttgggtggtcaatggctgaagcaatttagaaggttagtcattgttccgctataacgactaaattttgtaacagcagcatggttcgattcttctggtaaaaaatcgattttgccttcaccaagtagatgctccagggattctctctacgacgtcaagtacaagtgttgtactgtttcatattggtcgagtgttgtagcaggaggcatacaacattctcctattcaaccgaaatactctcattcacttaccaaagaggcttttactcacagcaaatacttctcggcctaatgtgacaggaaaatactaaaagactgacgcacgcggtaagaagaccagtctagaaaggagtattttagactaccacaagagaaaaataccattcaactaggtagatgaagcctgaagttaaggtcgttgagagagtaatattccccaagaatatatagtggggagcattccaaccacccccaaagctagcacaaggtgtttcgagggaccacacacatgtgcaaccatacccctttggatttctaactttacatgggtattgtagtatcttcctgtgtatccttggggtaggattgtaatatcacatgttccttggaaggctatataagctggtctcaatataatcagacacgagatgagagatatcagaataccataagacacatgagactccatgtcgacaaatattggaccccatgtcgacaaacctgcaagcctcgtccatccgcacactactcggcccagcctgctgctcggcaggatgtgtaagcatggcgtctagagtggcgtggctaattcgcgtgcacgcgccagcaacgttgctggcgcgcgtgccaggtggcaggattgccccctccccgcctcgtgatttttttcgctttctcacgatttttttcgttcccttttacgattttttctgattatttttttaaatctccagtacacgtgttttcaaatattttgtgttgaaagtttttaaatcttaacttaaaaattttcaaatctggacttcaaagttttcgaatctcgagttgaaagttttcaaatctgagttgaaagattttaaatctcgagttgaaagtttttcaaatctcgagatggatgttttcaaatcgagttgaaagttttcaaaatttgtcttgcaaatttatattttgagttgaaaattaagttttcaaagtttgagttcaaaattttaaaaattgacttcaaagtttaaatcttaagtcgaaagttatcaaatataatttaaaagtttccaatctgttagtaaaaaaatttcgaaaaaaaagaaaatctttttcttaattactgtcattatcttaactaaatgggttagttacagtaacacccgcggaaagctccgttagcggcgcgcacacgccagctagctttcgcgcagcccgcatggcatggatgagtgccgctgaatgtacaagtcagggcagtaattaatggactgcccagtccagtgtggctttcccgtgtgtctcgtgaggtcatgagttcacgtcttcccgaggcaacatggctaattttacaaacagggaaactttattaggtgaaccaggaaaaaactgttttttgtaaataatttttacgatatgtagctgatgattagtccactgtggcatgaacatcggcttaatttgagccagggtgggcagctgctgttcatagtaggtccatagtttttttttctagttgttatcatagattctgaagatataatcaacacttaattattttaatgactattttttggacggcaaaatttgctacaggacatctaaaaaacgggtaattagctgggagacatcgcaagatcgcgtatttgctaaagggcaccacaaaaaaaggtaattagctgctggacacccgtgcgattattttattattttcggaggaatagtagagagaaacaatcattaaagacaagtttgccctttgctcaaatgaatccaacgtgggtcccacatgtaaatccctctctctttttgtagatggggtggcggagcggcgacacaccggagccgacgaagggtggcaggcggtggtgttgctgatcccatccgtttctccacccagacgcatcgcccaccctgactctccactccaacaccatccaaaccgaggagaggacccctgctgctctctcccatctcaaattcgccgctagctgtgaggaacacgaaggccgccattgcggacaagccatcgccatcgccaactctttcctattctatattcccctcaccatgctgagaatatttctttttgacgccactctatttcatccattgcaatgacaggaacgctgtcgtgtcatcgccgactctagagcgagcaccgagtgccaccgccgcatctctgtcattgcgccggccaccgtggacaaaccaagccaagccaccgcgccagcatattctcctcggcatcctcttcagaagcccccaagaatccccgagaaccgagcgtcgagcagggagaacggacgttttcttcccaagcaccgaccaccgtctccatctcagattccgtcgcctccgatgagccaagtttcaattcctcgcatgaatagcttcttagggacctctctaaccctttggggagatttaaccgtcgctgttttccagagatgaagcgccgccgccaagctactacacgtgctgctgctggatagggatttcaggtatggggtgaacaacgagtgccctgccaggctgccaccaccaccgtcgttgcttcccagcgccgcttggccgccgctgcaaccagccgaagccgtcgtcgttgccagaagaaggcaagaggaaaggaaggagtagagaatgatagagaaaactgaaaaaaaaatcatacttactcatgtgttcgaagggtagaatcgtacttacatatgtgtttctctctctaattccttcggatataataaaataatcccacgagtgtccagtagctaattaccagctttttacggtgccctatagcagatacgcgttcctgcgatgtctcctagctaattacgtgtttttttgaatgtcctatagcaaattttgccttttttgacaaccctgaatgatggttaaaaatggtctgtggctttctattcctgcagcgctgttaattttttattagaaacacagtacaaacacatgcgcacacgatgcgcgattgcactaattctgaaatgttagttttatttcataaacagctgtactactacttatttgacatatattgccaatatcacttcactataaaaatatttatacaccggaccatatgatttactgcctccgtgtctatatatttgatgccgttgacttttttaaacatgtttaactattcgtcttattcaaaaacttctgtgaaatatgtaaaactatatgtatacataaaagtatatttaacaatgaatcaaatgaaaagaaaagaattaataattacttaaactagccgtcaacccgtgcgttgcacgggctattgttattaatattaacacatatcaaaatatattaattatatgttgagtacattagttattaaatttaattgaaagttatatgtaaactttttgttgaagtatccgttgtaatttttcataacacaataattctaaaattcagaatgaataaatagaacaaagtagaatttgtatggagcagaaattaataaatatataagagtcatacttagagtggatttatggatgaaatattttttttcgtcataaaataattcaaaaatccagagttgacaaataaaagcaccctacatggcaatacaatttaaatttctcatgatttgatatttcgagacacataattcataaacatgtcaaattgtaataaaaatctctaaattctgaattttaacatttcctctaatttctaaattttaatatccattatttaataacatggaaatttaaatttagaattagctaatcgttgttcttttctaagctgagtttataatttgctgtcgcctagatagatgaagtatttaaattaaaaatgttattttttggcatttagtcgaaaatggaaatttagctcactataagaaagtactatatctctttcaaagctctgctgctccaggaatatcagatgaatataataaggactgtacacataatcttttcaatcaattataatgcatactggttataaaatccaattataaattttatgatttcataattatgaaaataatgaataatacattggagttgtacttggtttggagttcacataatttacaacttgctaagtatgcatttaaaacattgcaattaaattaacaaatttatatcccatgctacttttcatgtcatattttaatttacatgaatcataatagatcgaagatcatagtaatgcgatccacctaatcaacggtggtaagtaagatctttttgtctaatgtgcgagcatcctcgaagtgtccaattaatattggttttcatacaaattcttgattgatcaaagggcattggtaatacgatcgacctaataaactaccagatctttagatagttatcgttatagtaaacatgagagctctctcggaatgcctataaatatgaacattatttgtgaggggaatatttataccgacctcttttgttaataattatcatgtcggttacgatttatgccataacaaagtctgattatcctgaccttgactttggacgcttccttcgcatcatcaacagcttgaacaatgtcatatgctactgtagttttggtagaagaaaaggtaagctgcagactacatgcagtgcatacgaacgtacataccgacaggaaatatggaaaattaaatattatttgctagtttatatttagagaaaaaacatagataagggttctgtgatctgtcgactgacctggttaccggattattagcacggctcatcaataggttaagatcaacagctgtgtcattatttcagtcaaaatcagtaatcgataattagttcttaaacagattgcaacatgtatattcaacgaataccgtacagctcgctgggaaacgatgctcagtaattcattactcaaaagtccaaacaaatcaaaaatcaattaatttgactgtatacttagcaaggtttgattatttgtttaacatgcaagtttgactgtaccagcgtgaattggggagcggtgcagatgtgctcgatttttcgatcggcatctggacttctcaaatttattgggttggatgatgatgtttcagatgagtctgaatcaaaatcaataaaaaaccaatctgtcaaagattgaggtaaaatagtagctgagttagagaggttttgagattcaaaattgtcacaaatcgtgcggagtatctcgtggtcgctggagtcctctctcccacatctctgtcgttaattgctatcggagagatgagatcgatatgtatctccctagattactgccgatcagtgagtggtagagaaaaaatagatgggctgaaagagcccatgaagatagaaggcaaattatagcccaccacgttagatttgtacgtacggccatgatattaaaattaatttaatcaacggtgatttctccagttaacgtggaagcttgtagaaagtgcctaattagtagaggtatagatttttttgaataagacgaatgatcaaacatgtttaaaaaaattaacagcgtcaaatatttagggacggagggagtataatctagcaacaagattggactacaattaactccaaagcgtccaaggccaccatgtgaacacttctttttcgctggactggtggatggacgctggtcaatttttgttgagcataaaagagggcaaccaagcagttttacaccaacggggttattagggagcaccgcagcacagcacttgagcaacgttggaggcttggagcacccaaggaacagctactgcaacagctggaaacactgcaaacagcgaactacagatacatcttggttatcaactcctgaagaaaaggcaatgtgtaaagccacagcagaaattccaagtgcctcacattcctgacaagaatttctcatggttaactgatacgatttcctctcctctcctctcccattcttacactacttaaaaagccattctttgtgacaccactcttttattttctagcggttttattaaacacacgcttgtaaaaatatattgggggtattttggtcacgaatcactagtgaaaatcgacatcacttcataggcccgcttgtaaagatagggttacttttacaagcgggtggcttaaatgacagccagcaaaaatcttatttgtgctgacggctgattaagagcaccgcttgaaaaaaaatattatggtattaaaagagagactccgaggcgcatctcttttttttttgtcctgtcaccactcccccttttacctctcattcctccctctctctttctactccctccagtgggccacgaccacggcagccgccgagtgctctcagcgatggccaagacggcgacgaccacgcagtgtgcgggcagcagcaaggttggtgggtggtgcacaggcaatgccgaggctggtcagtggcagatccggtggtgggaggcacatgggcagtgggtccagcgataaagaggattgcgggcagcggatctggcggcgggaagggccgaggctggtgaacagcggatccgtctgtgggaggagagtggtgtgggcggtggcgaggttggtgggtagcagatctggctgcaggaggcgcatgggcagcagatcttgtgacgaagaggcttgtgggtggcgggaaggcttgaaggcgtggattcggcagcccagtggagcacggataatggccaagaggccaaaacagggttacgggcacggtggggtgtcctagagggggttcaggtccaccgccagccagccacggcctccctcgccgaatctatccttcctcatccctccctcgatgacggcaaattggctccattcctcaccgacagcaacttggtgatagcataggccaccaacgacgcgtgcgaggactgtaattggggatttggaacaatgatttgcgatttgggaatttgtgattttctgtcggctgttttggacctggatttttatttttcttctccaaaaagtattttttgtggcgggtctcttaacattgccgccaactaaaatcgattttcgttggtagacatcctagcttggccacaagtgaaaattgatttttgccggcagccgactgcccatcactatagggttgaaactggtacatatagtttcggtctatccggactatttttcggattcggataggttcggttggaattatccagaaattctcgggttcggaaatgaatttggatttttcttggaaacaaaaacgaatatagtaagggtactatccgtctgaatcagaaaatggtcggatttcgcatacatggattaaattttagacacaacacgtatatacacattactttttcatacaaagtcagatgaagtcaaactttatattaaaattgtagtgctcgatgagatctacaacattcttgttgactatgttattatttgagatcatttaagggtctaaataccatatatgtttttacaaagtctcagatatacaattcaaatgacatttgatggagatgtgttccatatcaaagttgtagagctaaatgggatcttccgctttgtagtttataatatttgtatttgaaaatatttaaagtataaaacaaactctacaagtttcgaagatgtgaaataaaataaataatatatccaatttatacagcaagaacttgataagtgatatgataagtaagctatacatgtagtaaaagattttgggattattcatatttacatgtcggtctcttggaggaacgtgcatgaaaatcgattttcacatatggttgtgggaccacctacaatatcgaggatataaatattggagacgttgatcaaaaaaaataagcgatatctcttccttgattaaggaaactcaatttgaggggatttttatataccaataaatattcgttgccgtagtcgttccgtatctatattcgataatattcgattcgattttatttctgtatccgggttttagattccaattttgatcccagaaaaatgaaaacaaatatgataaagctagtttccacctgtttccaatctattttcatccctgcccaccagcacaaatgtattattttcattggccttatgtcgctggaggactgccagcgaaaatctattttgtccttcagcgaaaattattttgtaagtactgacagtcgttttatagtgttttaaacggtccatactattgattcatatgaagtatcttattaatgctgatcttatatcaccaaccatcccattgttcctttccgtattgtaaacatcttcaaccaattaattagcataagtgaattattttttgtggtttaccctgaaaggggttaataagcctcagtcagtttacctaaaaaaattgctggataccatggatgagcctggtacaaatgatattaagaagaaattaatatgaccatgatctagagtcgagcacgggcagagtggtaacaacagcccatgattcatctgcgctatcatagttttattatcagccaatttacatcgatttgaagtcttttttataataaactacaacacttctacatggtcagattgaagtaattatcgacaagaatgagatttgctccggtctttaaaaaaaaaatacctcaaggttacggtacctcacggtaccaaattatttccgatcgattggaactaaaatacccatacccatcctggaacggagcaaatcttgacaagaatatttgaacggcatgatttgatttgatttatgttcgaggcattgcctcgatcgggagcacatacttggatgggtgacgtttctggtctttccccttgaaggactgcgtcctcatctcgctttgaagtgaagacattagccagagcagagaatggaagacaggtcaacatcactaacacctaacaaatcatgtcagttaaccttcaattgtaaacaatggctaacttgctgttagcgtcatggaacaattgatattcctgctgtctctcactccgatggacaacaataatgtcctctgcaaccgaagcaagttctcttccctgtcctcacccatttacattcaaacaggctgatttgctgtgcagctcaagttcaatttggcgtgctgacacgcgcgttacttatatacgcaatatgtacggaactcagttataaacagtaccatccacccatggagtgattctccaagggaattcatatcaagcaatgcacacatttcgggagatagctctttcatgtcagtattaagaaatcactcccataatctgtcctgataataatgacatttttcgactcccataacttcttgcaatatgttcaaagacatagtacatctcaacattttttttttttacgaaagagccaaaatctgttgatacaacttaaagagatgaacccaaactgcattcttacacatagacgtagactcaacaatcaatccaacaacaggaatagcacaaatcaaatctaaacaaaacaataatttcactacaacgcaaagaatctattatatactaaaagtccattaagcttcctcaaaacgctctcaagccgctacgtggcgctctaataaattagagaaaattctaaaaaatatgagaaaaaagtaaaacatctatcactcgattttcactgaaatcggtgggtccaatgttataaaccgttagattaggtttatctcaagactactcctctgttccgttctatatataggtacgtattgccggcctccatccttgtgttgatccgatccatatagttacggtactgcttgcatgcgttccgttaaaggagtgtacgtacataaactttcttttttttttccaggtacgtacgttactattctttctttttttttcaggcatataattgagataataataataataataataataataataataataattattagtgataataaattttgaataaaaatactttataaatatagaatatacagcatataaatctcttcaagtagacataaataaattagctctacaatgtttgaaaacaaagttccacaattatgttatattatgtacccattattttaggttattttgtaacaaaaacatttgtccatcgatattcacttaaatcggtcctaagttgccacgtggcaccactacaaacaaaactaagctaccacgtggcgctctcataaataataaaaaaatttaaaaaagcaaaatatcggaccttaaaatattcacttaaattagtgtgcctgataattttaggtaagtccgtacttatgaacgtacgaaaccgctcaccctgatcacgtccgtatttctcttctttcccttttataatttctgaggataattgaaataacattaattattagaataaaacaattataactttgcaaacgtagactgcatcgtcataaacgtctataatgtttgaagaaagtttactgtattatattctttacacatctatctatatattatatactgaaaatccattaaacatctgttatatactaaaagttcatttaactccctataaatgctctcaaactgtcacgtgacattttacaaatattcttaagatgccacgtgacgatctaataaattagaaaaaaaatcctaaaagttttgataaaaaagaaaaaaatataaccattgatattcctttaaataggtggacccactaattttaaccattagatctctaaaaagatacagtatccccaactccaccgtataggggcacacacgtaagtacgtagtccctcaaccctccaactctcctcggagatcccactctcctctcctattttcgagccaacatttcctattttctaactaacacataatatatatatagatgataataatcagatagttaaatgatcatgactctcaaagttacatgcacttttctcaatttatttgcattttatcatgctatttatagttaaatacataattcaaaatccatttacccatatttcctatataaaatttagataatgtagttctttctgactacaaatatttgagtctaaattccagattcaatcagcaccaaagagcttggaaccatgatgcataccctggggcctgaacttaatggaggcggagttgcaagatattattaggttgtattcattagatgggtttgggagctaatctctcttacacacataaaacaaagcggctcattacattagagtattattaattaaggattagttattttttataaaatggattaatatattttttaaagcaatttttctatagcaaacttttagaaaaaacaccgtttagttgtttggaaagtgtgcgcacgaaaaacgagggagctaagtttggaaaggagggggaagaatacaaccttagcgaggtggacaccgatggaaacaccaacatcgactttccatgacttccagaagctcatagcacgctagatgattatatcaaggacaaagaactgagatgaggtggctagatgattatatcaaggacaaagaactgagatgaggtgcagagggagatgttccgcatcttcgacaaggactagaaaacaacttcatatctatcgctgaggagttcataattaaattcagaaaaaaaacaatttgattaaaatgcacattcaaaaatttagaaaacccattaaaactatacaaaatgtataataaaataactattaaaagatgagtccctatacaacacgatacgagattaagtacaatttaaaatccttaaaaagaaaatctagaataaaacaataatttgatttgaaaacaaattcgaaattagattcactcaatcactaaattcaaaatataacaaatattttttaaagaacttatcactattgattcagatggataaagaattgcgtatatatgaatcaattagaggattgacagggtggtaaaaaaacatttattgcccatagaagtttatcgagatttctcaaaaaagagatacaatgaacacccagttaaatatagaaaacacattactttaatttcagtttattttattataactatttttagaataaactaacatgcatgcccgcgtgaatgcgcgggctgtcatcctagtttaccaaatatgttagatgggtccatcacgcattgttttacgggccggtgtgccgcatatcaatcaaaacatggaagacgcagcagtcagctatacaacgttacaatggctgtgttctctccgaatagatcatacgagtctatctgcttgagctgtaccattaccagctccatgcagggtagttgatgccttgaaccagtccttacaaaataacaatattaactgacagcccggcagctttcatctaaaatattttaaatttcgctaaagctgtctgtcagcatggttaaaaaagaactgtagtttttaccccgactccaaaaatcctattgctgaggaaaacaaaacgttcccacagtacagcgatagaacagaacagaggtaattcctagtgcttcccatttccaagatccacaactatttgagaccagctgtgcagttacagacggggcatttgtaattccaagaatttcacaataaaactaccatctggtctttctcctggatgaatatttctcgaaaaggaaccgatgcctgctatttatgcaaatagctcggtcataaaccacacaccaacctgccataaacttagaccttgctgaatatttcaaagagattaaacacacaaaaatttgggaggatcacgtttgattgttttatttatatatttattatagtttttgaaacaatacacgcaagatagtgcgacgtttcgtattagtagagcagaaaaaaaatacaagattatagctctgaaagacaatagctaggaaaaaagactacaccacgtgtctacaaccagagacgcgctacgaaagagacatgaacatgacatctcgaagaaaaagaatcttctaaataacgccttcaggaagggaacaacaccgagggtgccaccgctgccggtcctggaattcaggacgtggttttcacctagtggaatccatcacggcacatgagagatcactcaacaatgcccaagtggaaatcggcgcacataggaatcaacgtttctggcttatgcccgtaatcttcctgtactcctgtgtctaggtctcctacttgatatagaagccaccatcagctgcattccttcgattcgcagccaccataccggcgccttaccgctctccccgccgtccttctatcgccgtcaggcttaccaagctctgcatcacactggcctctgccgaccacgacttccttccatcgtctaccacatctgtcagcctctcgttggccatcccgtagcatggacacgtcgactccctactcgatccatgcaccgtcgtcatagctgactgctcactgcaatcgctgcctcagctaccaccaccctcccgtccacttctgccaccccgccgctatgactgccagaaccgtcctatttccgtcgatgctgctagcaccgtcgtcctatagccatcactcccaactcccgcagcaggtatcgacctcctaatgccgacggcgtcacccgccgtgtgccaaccgtcggacgtcgtccgcggggcacaaccgctcctgcgacgtctcgcgtcgcccgccacgacggagtcacctcctcccactgccgccgcgccaggtactcgaccccagccaaatccgggtgaggatgccagctctggctcaagggaactagatccagtcggagtggcaccagatccgccgccaccatgttggagctcgctggtgaattcccaagctccacgtcgcccccgcccttgtgctggagacagacggtcatcggtttttggccctaggttgccgcccagttttccaggaagcaagctccagcggtagcaaggcggggatgagggtgggggtggtggtggcgggcgtctagggtttctccccgagccacccgagcatgggcgacgtggagcaggtctatttttattatagttggaccatattgtttccaccaataataattaaaatgaactagaaagatagcccgcgcacatgcgcgggcacattatataatgcgactgaaattttattatgaatatttatgtgtggctgactatatattaaaatattttttcctatattctaaaccaaaattaagcttatttagtgtgctttgaatgttcgttattttcttacaattacacttgcaacatataaattctaaaataaaattacttgagatcatgcagtgttgaaattatcagaaaacattatgtcaaaataatggaggtggttactatgagaaaatttagggtattttgactccccagaaggatacctcacaacccaaaataaatctaacaatatcattttttgtttgattttattttaagttttatatattttcattctatctgtcctcataaaatgtttattttttctatttagaatgggttttaaatccagcaatatcttttcagttttcaatttatttcatgtcctatttttttttggagatttccattctatgaatcatccttaaaacgctttgatctttgcaatctagggtgaaaatataaatgcatttattgcatgggtaaaggcatatgttctaaattttaatggtcatagtattttttgtgaattatcactaaattgaagtgtcttataacaaatacacgtttctagattacacgtttctagattgttctacatcaggactcaggatttaaaatgttagcatgttttaccaaaaaaataaaaaaatggacattgtctttaattcctatatggaattgacttgatatatatctaaggccacctcaaggttgtatcattgctaagattcctaggtgcaatcgacatgcttatcagtatgatctttaaccgaccacacctttattttcaacttgttgtttataatgctagatgagtacagttatgattaaaaaattgtgtcacttaaatttttttctctaatttattagtgcctttgtagatcatatgtgtaatttggatgctatgatcatcattattaagaacatttatttatctccaaaaaagattgttttaaaagtatcaaggtcaatttgtataagtacatagcccaatatgtatgttaagaaaaattaattaagtcagtagaaagtcgttatatgtctaacgggatataagtaatagatggatccatctatgtttttttttgcccatatagataattaaatttgaattgttaaggagataaacaaaacaaagagaaagaatggtgcatgccatacatgggcaaggagagagggaggcttgtgatgtttttctaaatgattaatctaaccacctaaaatgatgcattggatgtttaagtcaaaaatcaatggtcggatgttttgttttcttgtcaaattttttaggattttatctgctctacgagagcgacgtaacatcttaaaagggtttataggtagacttttaacaccgcatgccgcaacggagtaggagggatgcaaggaggtttgtggtattttaaaaaaaatagatctaatgacccaaaataatgtgtcaatcgattgaaaataatgtttccatagatttaaatcacaaccaatggttggattattttttttcaaaaattctaagaactctctgatttaagaatatcatatagtatcttagaagcatttataagatgtttaatggatttgattgccgcataggggtggggagaggatagaggtttgtgtttttctatttaataatactaacaatccaaaataatgtatccgtcaattaagtagaaattgatagtcggacacttcgttttttttaagattttatagtattttgtctaattcaatagcaccacgtagcggtttaaaagtgtttctagaatatttaaagttactgagggagagttaatagacctagtaggtgaaggtctatttgtgcgtttttttctgtaaaaatgattttggttttaattaatttctcatgaagaaaaaaaaaccgtatagaggaaggaacgggagagggaagtacgtacgtacattacataggtacgttctttgtttgtaaaaaggggaggttccggatgtggtttttattaccaaatagatctaatgatataaaataatgggtccatcaatttaaatgtaaatcaatggtcggatttctcttatttattagaatgccacttggcgactcgagagtgtttataggataccacttgacaacttgagagcgtttataggaagtttaatggacttttagtatataatagatagattaccaacatatatttttctcaatatgactttgacatctccacgatgacacatattgtacaaagttgcaaggcacaacgctatgacaactcaagcttgaattttcttaaatgcatgagaagcgtccacgatgaacctaaatatgtacaactaatgtggtgattgaatctcatgaagataaagattaagtatattatgcaaatcgaggtagtaataacgtgtgattaattgagtttatattattacaaacttaaaaaatggattaatctgatattttagaacaattttcatatagaaatttttcgtacgaaagacaccgtgttcccagtaatagcaaaagtttatccaacttttgttggagattcgaaaagggcctaagttcccggcaatagcatatcacggttatcttcgttgtgtgagttgtgtcagcacattcttctcacaacacatggaccagcgtcttcattatgaatggctcagagcttgcaactcaagctttcgcgcgccccttgcacagttgcatattcacagtggcaaatctcaattcaagctatcatgttctgaaattcctaatgcccccattcgaacaagttcccagtgtcatctgcacatcagaagcaatttgtcattgggagctcctcagatatttcactccaagctagtcttacaagacaacatgtgactgatttcaactgcaccgctgcacacactgttcatacacaatgcttacttttctgaagggtaccaagccaagcagatattataagctatctagtaagtttatcatttttattgaacacatctcgaccaccagcgtgtgttttgctgttgatgacctaccatggcatacatataccagttaatttatatattcattttaatgttttttttaacattcattttaatgttggtgatacggtagcactgtactgcgtaatagcacctgatcaggttatcttactacggtgacaacaagtgttgtactttttaatattgaccaacgccggattagttcaaacacagaaacaatcaggaaagccagcagccacacatcttcaacatgacattccctgtggcatggcccactagtgcagatctggtcatctgtgttaggggaaccttcatttgtgtcggcgaacggtttggtcatggattattggtcaatgatatgaaaactcatatgtgttaggccgggagccaccaccgattgcggtcatctttgtcaggcccaaataaaagaccatcgctaatgactctcatctgtgacgggtggtagttatgatccatcacggataagagtcatccgtgacggtttgtaattacaaacattcatggatgagaatttactttttttgaattttaaatgcatcaaaaaaccttaaaaatattcaaaatattattatgatattccaagtttccaaccatgctcacacatcactagctagaaattcatgaactttcaagtgatatgtgtatgcatatgatacgtgcgattcaaacctaaaacctttgaacacatgcaaatcaatcttactatctcacatatagatcacaggacaatcggtcatcagatattattcttttaacttttcctctccaaatataaaacacaaatttgaaactccagatttttcatatgagaacgtaactacaaagttgcagatctcatcgatttctacaactttagtgtagggtatatctctatgcagggttgtttgagaaattcagaaatattttagaattagatcacatcacatataacacatattcgggtatttcaaatttttgattttttttctcatccgtgacggttcgtaactaccacccttcacggataacgttatccgtgaagggtggtaattaagacccgtcacggcttagtgctatcatctttgacgggtcatctcattacatccgtcacaagtgatttgttagctttgacggggtattgttgtgaccctttatagtttatctgtgacgtgttagaactacgacccgataaagatgaacttatatcggtaatgggtcattcccggtagttatattttaaaagggaaacttattgagccattagagatgagtcatccgagcgagtttgctacatctcagagcaagatgtgggagtctgggtgcagccggcttgccccgccagcccgctgtgcttgcccctgaaccccgggtggatcatgagctcacgtggcgacttggcaaactggttgcaagttcataaaaacatgggaatctaggagaactaggaaaaatattatgacatgtgtctgatcaggaatctactgtaacttcaacaccgacttcaagtaggtggcagcggttgttcatggttagggcctcggtttttttctgatgggtattgtatatatgtatggcgaagatataattaatcaatgtttaattattgactgtttcgggaacaatcctgtgtgatggttaagaatggtaattcctccgtttcatattataagactttctagcattgtccatattcatattgatgttaataaatctagccacatatatatgtctagattaattaacatacatatgaatgtgggcaatgctagaaagtcttataatatgaaacagatggagtatgtaggtttctttttcggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagccgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacatcgtcttatctccaagctgactcccgatccatcaccggcagtactctcccgaggcatgaagtcacctacacatgaatcaaacaaataaactatattccgagaccaagctatctccaacttgactcattagtagcaaacaacagtattacatacacatagtatccatctagaagctataaatataaaacaatcatagatatccaaacaaacaacccgaaaccgaaactgacacagaatcggccggtcagacctcgggctgggccggtttgactgcgcgatacacgccggtctgaccggcagcacatgcccggtctgactggaccaaatcaacagcagtagttcctattcacctgcaaattccaatcatctctaaaaccacttcgtaaataaattccaaatatcaaaaccaataatcttatatgccaattgttcatcacagaataataatccaaaacacctttggttttacaacaagctgaggcatgaacatgtagctgagtacttagctggtttcaacaccggccacttgtccatggtggatgtgtcaatgagggcgactttatatgaatttcttaattcttcagtgatggtctcatgtaaaaataaataaatttctacataattgatttttggaatattttttgacgaaaagaaataagcataattagattgtgcaaaatttttatatttcgtttctatgagaatgtatttagctagtgattgatgaaattcttcatcctttgaataaaaatgtgaaaattagggaacatctaagtacaatcccagaagaagtctatgaaaccacccaaccagacctaaaactgcaatcacagaacgattggacttattttttttaactagttatgatgttttgactatgcatcattttcagacggtgtatgtatgaatagatttcaagttaaaaggggctaagagcataatgttttcttctaagagactaagaacccatttcaagaccactgtttccatcgttccagagttgatggtgccaacccaacaaccccataaaaatagagggtgaatggactcctatccaaggcctaggtttgctagtacattgataaacgtgaagacatatttctgtcatttgaaataagagaacctcgttgtgaaatcaaagtgtgttttgattattatttatgataaataattggtatttgagataactgcttttgttatttgaagattattggcgatgtgctttttggatcggtcagactggcaaatattgtgaatagtttctgacgatgaactgggattttgtctggtggttgcagtcagaatattttagaataccatgaaaatccgtatcatgaatatttctgaccactgattgtatatgcttcaagtatgtctgtacgagcaaatataaaagcagaaatgttgttgttactcatgtgattcagccttttagtcctcttggaatcaataaaagcaaatagaaaaataaagatgaatagtgtgacagtgcccctgccaacttgccaagctgacgagtgacggagggagattttgtatttgaaaccacaggctgaatacaaccatgatgaatcaaaacaagcaactgaacttggctgtcaatatgtttattcaaatcggaatgtgcatttcttcatagacgagctgtaaaaaataaggcatcttattttcagcctgcaaataatcttgctcgtatggtcggagaacttgggtcttaggtccagcggctcaaaggtttcacgtctttagaacccttgcattcatggcgccaagtctaagcgcaatgtatcaaggtctatctttgagtaaccaaactaaagcttcaggtgctgcaattagaattcctaatgcccctcattccaacaagatgccaacatcatcatctgcgcaacacaagcaattgctcactggtatctcccttcaatctttattcctagcaacttctacaagaaaaacatgtgactgactccaagagcactagctagctgctgcacacactgtccatgcacaatggggtttcttttttgactcgtacatagtaccaagcaagcagacacttaataactctctcattgttcttgaacacatctcaaccaccagacagctgttttgctacggagggcctaccatggtgtacatttttttagagaatagtatttttttatccggcctctacatacaaccagatatatacagtcctttaaaatttagcccctcaaataacccaatttgaaattcgctcctatggagatttgaactcacacacaagttgtgctctatatagtcattttgccgttggtataacaattagcacagtagcaccacactacatcatggcacctgagattatgttagatttctcaatatcaaaaacaagtgcaacatgagcacaacttctcacagccacagtgtaatcagagcacaggcccaaacaagctgaggcatgaacatgtagcagagtacctagctgctttcaacaccggccacttgtccatgatggttgtgtcaatgagggcgattttatatgaatttattaggtcttcagtgatggtctcatataaaaataaataaatttgtacatagtacattgtacgaatattttcatcgacgaaaagaaatataattagattatgcaatatttttatatttcgtttcaaagagcatgtatttagctagtgattgacgaaaattcttcatccttttgaaaataatgtgcaaactagggatagggaacacctaagtacaatccctgatgaagtctatgaaaccacccaagcaattcttctaacagactaagaatcggtttcaagactattttatcaatcgttacataagaagttgatggtgccaagataacaaccccataaaaatggatggtgtaatggactcatgtccaagtcctacgtttgctagtactttgattaacgtgatgacaccttttcgtcagttgaaacaagagatcgcatgtgtatgatcagttgaaacgtagagaaccttgttttttttttcttttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgccatctaaaaaagccagntntcaaaagacac

SEQ ID NO: 18330 - DNA, 10191 bp, Oryza sativa
  unsure (1)..(10191): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtttttctcaacgtccgcgccgaaattcgtgcctgcaaagagcgtggaattcagcgtatttctccaactcgtcatgtctattgtcttattcacaagacaaagaatcacaacctctcaagctgcaaggtctttctcagcaccacaaagacgtcatctcctaaggtccagcagtcaggcatatcccttagagatgaagacaaggaacaaggaacgctggtctcagatcggttcgttggcgttatcgacatcgattcccacgtaccatcagttctacatctactcgaggactacggctcatcaccaatgagtacgtcaagcgagctattagctatcaacgggaccagcaagtcagcacacgctaatgcggaagcggaaaatcaagtgactacaccggcccaacacatcaggacccttaacacaatactgagggagactccttacgatcccgttctgaacgatgatctcgcgcggtggcaggaacggctacgggaatcagtaaccaacctcagccacgcgtttgaagaggccgctgctgctacgcaccaggaacagccaccaactggcggcgtcaatggcaaaaatcccgaacagcgggagtcaccccctcgagctacccctccacctcgcggcaccggcgatctctgtgaccacctcaatggtcgccgagaggcacgacgcacacgagacgatgggaatcgctcccgacatcgcgtctcttcacgacatcgcgataatgaagaccgagaccgtactaatcgccacaatcgccacgatcatgatgattgcgagaggcggacgcaaggcgatactggtcgaggatgccgctataacgacgaggacgacagagatcggcgccgggacaacaacggagggcgacgacaggattctcgagaacccagccgacgacctcgtaatcccacaccggaaccaagcgatccatcgtcatcgtcatcttcttcttcatcctcatcgtcagacagacatccacgaaggacacatgatcgctgacaacccactgcccccagcactgggtgtagagctttcggtcgttccctgcgtgatgtccgatggcctgagagattccgacccagagcaatagagaagtacgatgggagtactgacccagaagaattccttcaagtctactccacagtactctacgctgccggagcggacgacaacgcgttggcaaattatttgccaactgcattaaaaggctctgcacgctcatggctgatgcatctcccgccctactcgatttcttcgtgggcaaacctgtggcagcagttcgtcgccaatttctaaggaacttacaagcgccacgcgatcgaagacgatctacatgcgttgacacagaactcgggtgaatccttgagggaatatgtttggcgctttaacgagtgcagaaatacaatccccgaaatcaccgatgcttctgtaattcgcgccttcaagtccggtgtccgagatcactatactacccaggagttggcgacaagacgcataagaactactcggagattattcgaaattgttgagcgatgtgcccacgttgacgatgcgttgagacgcaagaacgacaagccgaagaccgggggagaaaagaaaccagccacggacgcacctgagtcaagcaagaagaaaaatcgcaagagtgggaaaaggaaggctcaagcagaagttctcgcagcagaatacgcgaacccacccaaacgctgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttagacaagagtaccgacccaatcctacctacggccgggatacccgggacaggcaggtagaactgagcccctagcattgggcaccaaccctccgccgtatgacatctcgactaccgggccgcagctcgtgtagccttcatttgccctggagaatgtccatcgaagcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccataactggcatgcacccaaaccccaccgaaaacaggttttaggggttttgaaagaggaagagaggtgtatgtccaattccatcataatccaacaattccacagtgtccaaatgatatgagaatttcccaagtctaaagttgtaaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaagataaataggcatggctaaataaaacagtgacaacgcgggaatttaaataaagcgataatgcaataatttaaatcaacataattttataaaatgggattcaatatgatcaagatgatgtgtcttgccttgctcgctttcccaaacgacggcttcaacttccacgaagagcggatcttccgaagctgcggcgtctacacgaccaacggaaaaagaaaaagacttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaaaaacggattattgcgtcagccgagggaggggacgcgcggaccgggtccacggggagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcgacgcgcccgcgccccgatggtcaccgccggcgaccatcggcgcggcggagcggcgcccgagagagaggagggaagggggaaggcgaacggcggtcctcggctcaccccgggacaacgacgacgacgagaacggcggccggagcggagggagacggcggcgcggctcgggatgacgatgacgacggtgctccgacggtcggcgagcgaaacggaggcgcggacgaggtcgacggcgatgcggcgatgccgagggaggtgtcgccgagtcgggaggaggagcggagcggcggcggcggctaaccgaagcacggcggcgacggcggagagaaggtgctacggcgcgagcacgattccgacggcgagagtgagcggcgagcggcggaaacgaaagagcggagctcggggagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagtccagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttctgctatgcgatgcgagggtcaaccactctaactataagttatgcttcccaagagaaccaatttatcccacttgacatactttgacgtctccccaaatagtcttactgctggacttcttattgtctgatcgtgatcctgccagatctgaagcttcgttgttagaggtgatcttaatctgacctctgtagactatcttcgaacatatcacttggttcataactgggaatagctcccacaaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgcttctgtttatcaatcacctttcggcctacttctttcatgctagagagcatctttgccaatcccttttatcaatcttctttcggcttatctctaacaggtggtattctttaatgtggattgcggacgcttctggggacgatgaggtcctttggcttgctgcctttcggtgaaaccttgatgtggttcgtcaaaaagctgcactgactaccttcagggaaatacattgcctgctatctgtatctataccactagggtttaattgccgatggtcatctttagtgcttcctcgagatggggagcatccaaattgttcttctgccacatcacctttgaccttgttctgataccaggtaaactaattaccaaccatcgactattatgttctcaaatattgatgtctcctggatctccttatctgttggcaggtatatccgatcttatcaacgtagaggcatgacgagtacccttcggggtttcctccaacaatccttatcttgatctgtaaaaggcgtatccgaactcctatcctcaactactgtctcgttggctttttaacccaacacagtttaattggttttcttttccatcaacaggttggttattaactcgaggttggaacacagttcctctgaaatgagaccctaggtctcctatgtcagtaaacaattatacacatgatcacatatccgcatctttcaaacgaatcctcatggaacttgtctgtattacacatttctccctcattacatgaatacgaggcactgccttaaacgaaaagggacggtgcttaacatcggtacattgtatcctcaacatgaatcatctctaaacatagcaagctcactgtttacagacatgattatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagaggcacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacctgaggttgcatctgactcgggttcaaaattggcatccgatgctgctgtagtatctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagagggaaaacgaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcatgntgnncgnctgcgtagnaacaatntcaaanntcaaanncccg

SEQ ID NO: 18331 - DNA, 829 bp, Oryza sativa
gtgggctttatgtcctatcactggtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcaccttctattttcttaagggtgaggaaatgaagtccatgtacaccacctacaatccggaat

SEQ ID NO: 18332 - DNA, 765 bp, Oryza sativa
aaccctctgccgagatcaatgtcctgaagctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtcgaatgcgaatctaaggcccgc

SEQ ID NO: 18333 - DNA, 817 bp, Oryza sativa
  unsure (1)..(817): unsure at all n locations
ccggtgttactcttatgcagtgttcanactattataggcttggattagagagatcggactccaaacgagaggatttgagccgaaaaatccgagggttagttggagagataaactcgaaaacgaattcgattccacgttgatttcttcgggataaagtgcgacgacgggaagcggcggcgactgcgaacgcgacggcgcggcgcggctggacgtcggccagcggcggcggtggcttggacggcgtggcggcggcgctacgggggacgagaaggctcgggagttggtgcaaacgaaagaggacgccaaggggatgctatttataggcttggattagagagatcggactccaaacgagaggatttgagccgaaaaatccgagggttagttggagagataaactcgaaaacgaattcgattccgcgttgatttcttcgggataaagtgcgattcttggggggaaggatagaggaggataagaggaatatttcccctcaactaattttgcaaacggagcacgggatgcggcggatttggtggaggaagcggcggctgcacaggtacaggacggcagctcgggcttctgtccaagcttgaagatgagcagtacaggggacgcaaattagactttcggctgggcttctacttccaaggactgattaaaggagggacaaaaagcagacgtcgggaaagagagcgaaaggactgcaggctgagaggagactgggccgagagtgagaggacttttcctaaattcgcccgaaaaggaaaaggtgaattttaattactttttccaattaantaatcacttgaatgatct

SEQ ID NO: 18334 - DNA, 28117 bp, Oryza sativa
  unsure (1)..(28117): unsure at all n locations
gcgatgtatcctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacaattatttcaccggcaattttggcttctccaaagtttctcaagtatcaagtccaagatttaatctaaatgtctgggagtttggagtcatcaaccaatcaactcagattcaatgagttgaacaacagtattttcctccaagtgaagatcttctacagctacaacaccaagttctaccgtcatcttgataaatcaagaggcgttgcatcaatctacattacgcacacgctagcatcaaggaaactacttgagctttgatatcttctcaacggtttgctggattactgtctctgacatcatcaccagtacctctaattcatcggctttgatgtctccgccgtcgctattgggagactatgtctttgtcttcggtgcttccgtcattgtccacttgttatttcgctttcacagttggcctactacgcatttactgaaggatgaccttgccgttatcatcggctgctacactgctattgactggatcattgacatcgtcatcttcataaacatcctgtcaagcctcttcggctatgcctactctgctgccgttggtgggcaacttcgtcatcataactggctgtctccgttgccaccaattgtcattatcgccgattgcgtttgctgtcggcaattgttttcttcttttgcatgattcatggatttcgccattgccattgataagcgtctacattttcaccatcggcttgactccgccgttgcccatggtgtcttcgctttcacggctgacttattatgccttaactgatgggcgtcttcgtcttcttcaccgggcgcctcgtttgttatcgactgattatttcgctgccatggctgcacaactctgttgctgttgctgggcgccttcgtctttactgctgactgacttgtctgctgccgactggtttcgtcgcctccatggttatgcgacttcatcacctttaattggtgtcattgtctttaccaccagtaacatcttcgtcagctttgacgggtgatatcatcttcatgttggtcatttcgtctccatgccaactgtgtcagttgccttcaatggacaattttgactacaacagaaggacaagctacatcctcggtggcttattatctcaaacacaaggatcataccttcaatttggacttgtcacggatacatgcaacgtgaattcatgttcctgagactatttcctacgctcaaagactgaatcatttattatttcccgtgagggctatcacctaagtacttgtgccagtcgggattcaattatcacatctactttggtacaacccatgagggagaattactcaaattagaagccactcatatgagttacactcgatctacatcaaccgggaaatttatcactcgggatcatattaattggcgtgctctatttcttcatattttaagggtatcggtagacatatttgaggtctaggcctaatatgtctgcaacctatatttttaggtgtggcatgtcacgttcttttagggacttaggcattttttgcttaggcaaaagtgtgcgtgattatgtgcccaatacctcaaaatccttttataccgtagttactcaattttttaggagttggtataatgcattttaaaaggtgccgaatagtgaagtttttcattgctgcccctctgacttttttatatagtcaaagcgctgtttgggtttgtaaagcaattgattggacacaatatcattgttttttgccacgtatgtgtgcatttttattgaccaatattatggcttaggctaattatatattttggtctttttctaggcggttggtaaatgctttatgagtttatttactcgaattttacaccacatatgccgtatatttccaggtgtagtgaaaccatgtgtcttttagggacttaagcacatctgttaaagcaatgtgcgcatggtgtgtgtccaatacttttgaaatttctttattcacagcatataagcttctttatagctgttttgctatgtgaattttcaatgatgcacgcatcatattttacaaagcagtcggtatatcactcggatcatgttattcggagattcacaccgcatatactatatattgatatcaagtcactcggttgactataattatcaaaaccactcaattgggtggggtatgtactccttgactatatgctcagtttgttcaactaaccacatagttgggggctacacctattaggtgcatctagtcgatgcacctaagtttatatttaattattttttcagccctccacagtcttctgatttggtaaaaagtactcgtgagaccatggcaaagatgattgaagcactcggctttggagtaatctaattcaagagaagattatcttttcgactgtgaaggtctcagccgatgctagtagtgagcaaggggttggagcgggaggcgcggctgatgcagtacaaggagagcccaccggatgttgctctgccaaccagacctcgcagccgcgttgtccctttacactgacagcgcaccgtccctccacgccaaccggggagaagaagaaaaggaaagaaggaagaagcagcatgatgacgagaacgtgatggcgatgacaagtagacggcagtggcacgaatcgaattttagaaaatttcagtggcattcagccgatattgcaaatattaatgatatttttttaatttgacatatttatagtgggatggatcaaattaacccatcaaaatatggaaaattgctaagatttgggaaatctgtcggtttcctccacaggacaggtcagaacgcgtcctgagggctgtttagactagcggcatgtggccggtcagaccggcggagtctgagacaggctatgttttggttttcctttggttttgatctcgagttggacatggaggagggcctgtaaagggcaagaccaacccctatataagggataaggccatttgaaaccatgtaacatacaatctacacaatcaatcgaatcgttgttttcaatattacttctacttttcatatagcctagttttagttcatccatctttgtcaatttgtgtcataaatcgtccgccttcgttgcgagagtacgaattcctctgtaggtttgtcctgaaaaccttccatttgcccatgagacgggtagttatccatcgttctatctaaatcggctcagctagccggtttaatctatcaaaacccattttggtctagctttttgctagattggggtggttggagactctatatcaccgcaaggcgtttaggtgtcacgatcgtgcttgtctacttgccaaaaaagttgccaacacaatttttggcgactccgctggggacgtcttcatcatgaccaagccggaggttgatccatctaatgtcctccccatctcattggaggatctagatgaggagcaatgtcgggagattgaacaacacctcaaggagacgcaagaggcgcttttggcaaggtgctttatcaagactcgtcaaggagctattcgtcagaccagtttcacatcgaaaaacaccatcaatgtggtaagtggtgatgaggtatctcttccacttcaaaagctcgtagcaagttccatagattagactattaatactacttttaataataaacttgagcatgatatgagttcttattttgataagcgaattgatgcttttatgagttgcaaattcagttctaatatgaccgatttgccgcctaattctgttgcaagtactagtcaaggtcctgttcaccaaatatttagtaaaaccgatggggcgaccatgcaactgactaggggagaaaaccctaacttccccgccggtctgaccggcggttcctacaccggtgttggccggtccaactgcactgcctcacggtctgaccggcagccctatggccggtcagaccgcaccccctatactggtcaggccggtccgactacacctctgtctatcggtaagaccgggctctgggccagtcagacctacacaattcttccagtacaggaagttgatcctattttatatcatatttttttacatgatcctcgtgtagctactattaatcctcaagttcccccacatatacctaatgcttacaatgattctaataggggatatcctgaagatgttaggtatggccaatataacaatattgtgccaccgcaccacttattaggccaccaaacccaccaacgcctgaaaatatggaggaacgtcttaggaacatgattagagaagcctttggaattgagccaaggaatcgcactagggtttatcaaaagccgtatcctgattattttgataatatcccatatcctcgtggttttagggttcctgagtttactaagtttagtggtaaggataatatgactacatgggaatatataggccaattctcagcacaatggggtgaggctagtaacagggatgcttttaaattacgcttgttttctttatctttatctggtactgcttttacatggtttacttctttaccggtaaattctattcatacttgggctcaattagaacaaaaattccatgattacttttacactggtaaaactgagcttagattatgtcatttgacatcggttagacaaaagtataatgaatctgtaattgattacattaaaaggtttagggatgttagaaaccggtgttttagtttgaatataattgatagagatttggctaatcttgcttttaatggtttacttgctcctattatagaaatattagatggccaacaattgcttgatgttagtcacctcatgcaaaaagctctagctcaagaaagccgggttagggagagtaagaaattttttaggtccaatgacaaaaagcctaatgctagtattgttgattgccctgagtatagtgattctgataatgatgatggtgatcatgatatatatattgccgagtggtcatggactaacaagaataagccatttatatgttctacttaatgccgactcctcgtaaagatcggcaaagtgaggttaagtatagctttgatgtggccaagtgtgataagatttttgattatcttttgcaagaaaaacaaattagattacctaaaggccatgtcattccatctcaagaagatttgaaacgccgtgcttattgtaagtggcatgattctcattctcattctactaatgattgcaatgtgtttcgacgacaggttcaattggccatagaggaaggatgattgaaatttactgagggctccaagatgaagctatatcatgattcttttcttgtaatactattgatttcaatgacaagaaagtgttgattcggccggagcaagccgtatctactaaggggaaggaagtagtagttggagagcctagatcgaagatgattgtgccaacaaaaatcaagaagttggtgtatggaaggagaataaggatgaagcttcaagctctaagactccacggaagccaaggtgtcttttgatatgctcttgaacaagtatgagaagaaaagtgttgaacaaagttgtaacaagggcaaaaaagcaagatcaccttctagggagcgatttggtcattcaccaagaccattggagccgccttttactcatcatcctcaagtcatgccatggggaccttgtccaatgccactgccgggttatccttttccttacttcatgccatttggacatcaccaccaatgtatgatcatatgcctcctatgcaatttcatcaaagttggggagaaccaagaaggtcagcacatgagcgtttgtcttcaccaaacaaatgccggtttccatctagaaatcgggttgatgaaggaagcagggaagaaaagcgtgtcaaggtggaggcgaggacttcaaggtgattactattaaagtggagtctcatgatgtgccaataccttctgaagatggagccaaggtgattccaatcgatgaaatcgaagccgagaccagctgtgcgcaggtggccggtttgaccgaagccttaatgccggtttgaccgggcctactggccggtctgaccgacggccgcatgctggtctatttgggccgtctagccggtccgactaggctgcaatgctggtttgataagagatttgcaaggggtagttcaggggcttcgttgtcttcaagcaaaatcaataggggggcattatattcctcctggagcagagccaaaatcaaggtggatgcctaataatttaacggctacacaaaagagaaggttgcaacgtcttcgggctcaagaattaatagagagagaagccgaagagtagacagatagaagattcaatgagttgcgaccgccgccaatgaaggagtggatgcctaagcctatagagattgaggagccggttgttgttcaagcggagaaggaaaagcaagtagagaaggatgaacacgggttgttcaaggatgatttgctgccaaaggaagacatggacatcaacatggtgtgtatgttacctatggagttttgtgctatggatgaggttgaagttgctcaactttcactaggtccaagagatgcggtttttgagaaggccgatgaatctaatcgtcatatgaagtctctttatcttaatggtcatattgatgggaagccgatctcttgtatgttagtggatggtggtgccgccatgaatttgatgtcgtattcgttattgaagaagttgggcgtggagatgatgagttgaagaagaccaacatgactctcaacagctttaatggtgaaccaatggaggcgaaaggtatcttttcagtggagcttaccagggggaacaagacgttgccaactgctttcttcatcgtcgatgtgcaaggtaactatagtgttattctgggtcgttgttggattcatgccagttgttgtgttccctccaccttgcagcaatgtttaattcaatgggacggcgatgatattgagatttttcaagtggatatatcgtctgaggttgcaatggccgatgcttcaattgaatggcaacatgggaatattcaatgcttatcggggttagatctttctagctatgattacattagtgtctctaaggatggttttgtacttattttctataaattcggctagtttagtatagctaggcaatattactttgtatcatgagtaaagatgctaatctagagtagttacaaaagagggttgttggtaattcttatcctcacagataaaattcgcaagtgcacggaatataccgatgtagtacttcacccgggagtattctcaggttcgatttccacaaggaacatgtgtgtcagctcttcaccaagttcgtccaaggacacgaagctaaagtgatgtgaccatggctactacagatacaaccattgctcacatcatggatgaacaagatgacatcaagatcaagtcctccaagtgctagaatccgattcggccacctactacattgctgaattcaatcagccgccgaatctgcatacaacctccgtttttgacccgtgagtacttggtggaaagctcttggagtcctctttccagcggatccggcctcaactccaaattccatcccagtcgtccacaaatgaagaaacaaggtgttgcatcaccagtcatgggcctttgggcttgtaactttgtttgggaccccggcccaagtggggcccaaggggggctgcgccccaaacagagggaggacgcccttctgacctcctccatcccttaaatagctagtaacccctccaaggttagtcgggttttgtttagatgaaagtttagccattgctacttccttgcagcgtgtgtgtcggctagaccgtccgtctgcttttattcgaaaccccaacttatcgtgtgtattcattcctatttgcaattcagattgcttttatcttgttcttgcttgtttcttcgatttgcttgcaagaataaggttgatctgcatcggcaagatcaacaacccacggagaggtgtatcgatcactaaggcgcaacacaacgtctcgtacggttgtagccggatcgtcaacgtttctcccaaatcatagttacctacaactcaccgaaagatcgggccaacaatagccttgagtgtcgaggggaactcagggttcatcaggtggtatcagagctttcgttgctcggtgagtttttatctacctataaccagaaaatttcccaacaaaaaaaattgtatcctatacctagccatctttgtgcctttgcattgttcttttcagtttttacgttgttgagttttgtgttgcattgtcgagtcgtgttgctggtattagcgtctagttcgtttagagtttcgagttctggtcacgttttgtaccacagtcatcgccgcccccgtgtctctgttgttgtcgggacctacgaaaacagaatcggctcgctgccacagttctattttcgtagttttcagaagtttctgttggttagtatttgagttcttgagttgcatagcttctgtttggtggttgtgccgtgatggtgtgtgccgtgatggtgcgcctgtgcatgcgcgcgtgagaaagatgaaaggagaagattagattagattgactggtttggtttatatttagtgccaagtctgtttctatttatcacctggtacctttccaaaccaaggccgagtgggattccttcccttgcgtcatctcgtagccgagacttgtgagtccgactcacactccctcatgattgtttctgtccgagttggttaaaaacttcgatgaaattttattttggtgtcgattcaagatccgtttgcaaaaacggaaccgacataacttgagcattccatttttgtataatttttaattttggtttggacttctacagttgagtccctgtaattttcatatttacatttgagtccctttgaccttacattgaggtccttgagtcggtttttggtaaaaaatcaaaaaaaagagaaaaaaaaggcagaaaggtgctaaaaaaaagagagaaaacaaaagccgccccaaaaaaaagagaaaggaaaaataaagaaaataaagaaaaataaagaagaaaaagaaaagaaagaaagaaaagtgaaaaatcagttgaatcattgagatttcttttatatatcagagcatgcttgagttgtttctagtgctatcttgtggtatcgtttgtgtctaggctcgcgtctctagtacgttctagcctaggaccagcacggtacttgactttgaacaattattcaactttgtattctctgatttgagcatttgctattgctttgctacatatttaagcctacccagagctccacagatttgattgcagccgtacagcaagtgtttgccaaggcatcgatacatccaaactccattggggtgcttggttgagtcagtgtacattatcattccgcttgctttggtaagaacttataagagcttggtgaaaagcttgagtatgtgtaatatttcagctgccactacctagtagttgataggagcgtgcatattcttgtgtatgtttcttgtttgctactaaccatggcaggattacacaaggggaaacgagatggtcatgctcaacctcgacttcttcaccatcaacgagatatagcgacttcttcacgcattgcatatgaggtacatgataatgatcttgcaatggtagaatctaaattgccagtttttgatggtaagtatgattccgccgcttatgttaattgggagctagcagtaaacaaacaatttgatgagtatgatttctctaatgctcaaatgattaaggttgctagtaataaatgtaccggttctgcatctttttggtggtacattgttggcaacaagcttgaaacttgggatgaatgcaaaacaatgatgaggaaaaattttgtgttttcatattataaacgtactctcgttgagaaattagaacatctaaaacaaggtgacaaaaccgtgcaggagtactttcataactttaaaatttgtatcacttatagtggtttaaaagaaagcaatgagaacacaatgactagattttttagagggcttaattctgatattcaggctgggcttataaatgtgacatataatcatataggccacttgttcatgctttcttgcagcgttgagagcaatattttaaagaacccaagggagaaacaagctatgcttgtgcctcatattactgacattttgtagggagctcagaacattcaccatgaggagaagagcgatatgctcgagatgtcatctccatcgctcacgaaggaagaagagaagactgatgcacctacattatctgaagagggcataaaaggtaaattaaatggtgctgatattactcaaggtgagtgtgcttctgatgagtcacatttgtccactatccatgctaatctagagcaaattttggtggaaactacttttgatttgcctttgtcacaagttgatttacttgctattccttgtgataaagaagagttgtgtaataatgcttcacttatatccctaccacaactagtgaatgaacatgctatttctagtgtttcattgtgtgctgattttaagcatgatgttcacattgctaatgatgttgaggaacgtaaattgataacttctttaaatacttttagctatgttcaatttgatgatttttgtgagctcaataatttggaggagaaattagttgcttagtctgatttgccatgtccaactaatgctatttttcatatctttggcaaatataatgatagaggaatatatttggtgcatagagatttcagttgttcggattttgagaaacatgttattgctactcacacaacatcgagtttctctagttttgattggatgaaacaggttattttgaatggactatgtgacgagcaccgtatagaaaaatcgaggacggttttccgtgaagaaggggaggatgatgtgaccatggctactacggatacaaccattgctcacatcatggaagaacaagataacatcaagatcaagtcctccaagtgctggaatccgattcggccacctactacactgctaaattcaatcggccgccgaatctgcatacaacctccgtttttgacccgtgagtacttggtagaaagctctcggagtcctctttccagcagatctggcctcatatccaaattccatcccagtcatccacaaatgaagaaacaaggtgctgcatcgctagtcatgggcctttgggcttgtaactttgtttgggaccccggcccaagtggggcccaaggggggctgcgccccaaacagagggaggacacccttctgatctcctccatcccttaaatagctagtaatccctccaaggttagtcgggttttgtttagatgaaagtttagccattgctacttccttgcagcgctcgtgtcgactagaccgtctgtctgcttgtattcaaaaccccaacttatcgtgtgtattcattcctatttgcaattcagattgcttttatcttgttcttgcttgtttcttcaatttgcttgtaggaataaggttgatctgcatcggcaagatcaacaacccacggagaggtgtatcgatcactaaggcgcaacacaacatctcatacggttgtagtcagatcgtcatgtttctcccaaatcgtagttacctacaactcaccgaaagatcgggccaacaacagctcagggttcatcataaagataggctaaggattcaccggtgagaaacagtatctatggaaagcttaactttaatcctaacgcgatactttgggcactggttagctcgctgctcccagatatcgctttactacgcacccggacaggaagaacttcagtgatcttgagggttgtcaccacctcatacctactgtgggatgcggagaaaacaccggaaatcaactaccgagacactgcgtctaagcagttaataacatacttgaatgttagctacgcactaaagcaatccctatattttagtggattatagtgaacgatgatcccgtatgctaattaggaactaaccaagaaataaatctcaccaagcaaaactaaattactcaaaagatatttctattataattagagtaattaacatagcagaaaataagaagagttttaccgacaactctggcactcctctgacttcttctaatctactctatgatgaggacacgactagcctagttggatataaccatgactaccttatgtattaatgaaccaaaggcgcatatgttctacattagatttacttcttatatatttgaacaaacgttgctacacaatgagttttgtgtgttttcgtttgtctgaggtactttacttggatgaaggaaaagacgccgagcataacgaatgcatggaatatcaaagaagttgattgggaccaaaccaagatcttctccaagtcgacttcgagtgcaattcggaatccaggactagtctgcactaaaaggggcgcccgagtcgcatacgtgctcggattggggcgttctttatatggatggaaagctaacaaaataacctttccaatgcttttggtcccacatccaaattctttctgtgtaaacggaaattgaccaaacaagttgatatccggaatctgtcttggtgctgcgtcaccgtatttgggcccttgggccgtgtatcgtgttggaacccatcagggttgcgtcaaggattggttgcacgaccctaaactctatatatcagtaccccctgtcatctttagtgtttgggttttgcttagattattctgtcgagaacaatttcaccgttagatcggtttgtaagaccccaacttgtgagcttaatcattcatctgcaattttggtgtattctaccttgttcttgtttgtgttcttcgattggcaaatagggattagccttctcggcgaggtcatccactttttgacatgggtgataaccagaggtgacggtgtgctgcgattgcggggctcaagagcgtgttcgttcaagaagccggatcgatttgtgtcgcgactctgcccaaatcgttgtttatcagaaccttttagaagatcgggaaccctagtccacatcacaaagactttatcattgccaaggccatgcttgctcccatattgccagcttatcaaagatttccatggcgtccaaggagcttgtgccgctgttgcaatgatacatggcttggattataggagtggcaatattagcaacttcgtctctagccttctcagcaatttcaactttgtttatcaacaagtcgaattgcgcctttgttttccccatatgatctgcatataacatcattcaaggattcaagatataatgatagttgatcaagtttcattcacaaagaatcaaaagagttaccttcaaattccttgacaacaagatctctttccttggacagagcagctttgtcattctctaaggctttaattcgtctctccaaatcttcaattttggcaacttggactgctagacacagaaaaattatacaactgctggaattgaatatggaaagccaagcaggaataacattaacctttggaggagccgctcaattcgaagttggtatcctggaactcgacaatccgattcctgagttcatgttctgtcttcctggcttattctttggtttcatagagttttgctctggtttcttccaaagtgccaagatgaggaaccagcttctcaagggtagcggttttagcctcgttctgaaggtggattctctgcacaatatcgtattcaacttagtaaattcattggatgactaaacatgtgaggggcagtatacttacatttacaagacgagtagcctgattgagagtctttgctagcagaactacttcatcttcttccttctgccaatttatcacaatgccttgcggttgcatttcatcatcccaccatttgaccaggataggcggctaggagtcttcagctgatttagtacgaagaatttcttcttcgtcaccaaccattgggccttcatttatataagaacaatgagataacatgaattcactggagagagcattacctgtgataattataggcggtggccgagcaggtccttccaccttgtcaaaagtgctggcttcaggtccaacatctgtatcttggttcagaggaggactgctagcttgctcctccgtttcagggatattgcttcccccatccatatttggttactgggagtcttctttatcttcacccgactggtttccagtcaagggctcctggtttgtgctcgcttcagcggatgccgactggtttccagtcggtggttctttgttggcatcagcttcgcctgtcgttggcttttcgccagtcggggtttctactcggaaggtcccagtcccggttgcgggtgaagtttttccttcttcaattgctttcgagctagcgggtgggtcagtgctcttactagacggaccaatgtccggcggtttcctaagaaataaaaagatattgcaagatgatttcagcaaacacaattgtgaatgttaagaaaacaaaatggacaaatcttatacctagaagttcttcggatttttggcatcggacgactggttgttttcttcttcgacggagtagcctgtttaagctgtttgccgatcgattcatcatcgctgtcatcatcatcatctatgatcatcttcctcttccaagagcccgcttgtttagccagattagcactacttttctggccgccgggctggatctttggacccccggtagcttggccctggtgacgccgcaaagaacgacattgaacaatcggaggatcagatttcatcaaggcattttcctaaggataataattcaaggtttattttcaataacaacaagcataatagaaattcaagcgacttgtcacttactgctggaggtggattgaaggcattgaacggcacgaccgggagcagatgtgtgaagtcaaccacgatactagatgataaaatcttatacatcctctccttcatgattttgaattcgagggagtcgggatcctctcagttagggccggtcttcccatcatactcaaatgtcgtgcgtgatctttctttgattggagacagtcggcacattatgaaatgccgagtgatttgctccccttgaaggccctgttcctttatcttcaacattatattcagcagttcaagggcttgagacgctttctcacgcatgggaagggagttccagacatcccgatacttaggcggacagcacgagtactcaggcagggcagggtctgggttttggatataaaaccagttagcatgtcagcccttgttagaggttttgaagggatgagaaaaatatttcttgtgcagggttccatggagttggaagtcagatcccccaacaatgcaaggcttatttttgtcgggctggggttttaaaaaaaagattcggcgaaacaaggcaaagtgaggccgaatgccaagaaaagcttcgtagaggtggacaaaaatcgcaatatgaacaatggaattggggttgagatggtagatattaatcccataaaattcaagaattccccaaaagaatttagaggtttgaagtacaaagcctccataaaagaagtgggtgaataccacgatctcatgggtgtcaggagttggaaatggctcaccaaatacaggacgccacccgatgatctccttgcttggcagtaccccatgcgccaccatttccttgagagtttcttccttgacatcggaaggtgcccattggctctggaagttttctctattgagggcggaggttgcgtggagggtttcggttgaagggagacggtttggaagaggcggattgcggtgcagctgcgaaccctagcttttggcggcacaagtttgttactgtagcatgaaatggggaacgagcagctgttgcggcgaagaagacaaagtggtttccttcgacgtgattttatcgttgggtatcggaaaatgctaatgggcatgggcccatacagtgttttcagcccaaatataccttcggtgtggctgaatgtggtctcttgggacttaggcgtatttttgcttaggcaaaattgcccacacaaattaaagcctgataccgttaaaatccttttttcgcagttagtaaattccttggaattactacgatgcatacaaaaaggtgcccaactgtcaaaaacatcatgctatttttgttgactttctctataaggtcacaaagctgttagggtttaatcaagacgactagtttataaagttgttgttctattgatgcgaaaacacgaggccttgaagatctgcttaacttcagtgcaggtccaaaaatcttgcctttaggttcgtgagcgtgccagttaatttaatcctgcaatcaacaagaaataaagataaagaaaccgcggttaaatccataaatgattgccgatcgactagttgccgatgacatatcatttatctctgagccgatgtcatgtttgaatcgatcggcagatataaataagtaagaaaagactaaatctactcgatcagctgtagatattaacaacctataatctttatatcgatatatacttaaatcaagtgattgggatagatcggtcgccatgccgagacagtataaatcacttagattgaaatatatattaacaatgagattatagatgctcatagcattgccgatcagatagatctagcatgtatcggctaatactccgatactacaatatattaagatattaaagcaatcaaaaatatatcaaacggaagcctaacatactttgttgtactaagatcataatataaagggcagatctagcatgtcaattaaacatgaaatataaggctaaatcaggtaagatcggctgaaaccccgatactaccctaatcggcaaccaaaagcatgctagaggttgagattctaatcatgacttataaggtcaaactcaactgatgcagctataattatgaaaaggacaatatctagacaatcaagccgttgggtatttcatagatggtggatatcctgtacaatctaagccaacatagatatttaacctaatcggctgccttccaatgatagatgttatccgattgaaggttagataacaatattgtcaaagattatacagaatatatgataactcgacgaattacataaacaagattagactatcataaagatggaagcactaatcccgagaacgcaagccgccatagcaagttttacctctagttgaagatcgaaaccgatgcagctcaacccaaaagcaagaactcgtcgaaacaaaacgaaagtaaaagggtggcgatgcgccaagattgtattgaacgtgtgttagattgattacatgaggctcggggtctatttatacccgagattacaaaatatgtccgtgtcggacacgaaacaaactctaagacaccataaatctttgcggcagacttttgcccaaacatatctctaaggaaattacataaaataacctaattaatagatacaattgccttctcaggacccaatccgtgcgtggcaattctcatgaagcacattagctcaacccgacaacgtgtaccatgtcacattgtcggattcggctcaatcggctatccttgtccaactcggactctgccgatcacaatcgcagtcgattcggactttagccgatccttgccctgtttccgaaatgatttccaccttagactccgcctcagttttatctttgtcttcgatactgaaattactaaatttggttgttagcatgttccttctgagcatttatatgcttcattctcttaataacagactaaagttacggcttaggctgattaaacttgtaagtcgttatttatttagcggttaaactggtttttactcgaattttaatacaaatgatgtattatgccccaaaatagatgatagatctgtagagtgctcttatcactcggatctttatatatcatctatgtttcatagtgagctcaataatcttatttaagcagtcggcaaattcctcagatgaagtcgaatatgctttaatattaaattacttcggtagtaccattcataaaaccactcacctagttatttattttaaccttgactatatgtttagttttttccaactaatcacatagtcgggggctacacctattaggtgcatctagtcgatgcacctaaaattttttagcccttcacagcatttgattcaaccactagggaggccaaggcagagataattgaagcactcgggattttcgtttaatgactcgggagaagattatttcgtcgattgtttaggtctcaggggctactgtggagattatggataccccatacctacacgcatgtgtatccgactaggtatagggataccaaatatactgatagaatatatttagtaaaggactcagttgttatgttaacttatatatcaaggaaacatccgatagtcctagtcggttacgattataatttatctttacatgcctagtcgttaggaacatgggctgtatcttgtaattctggctcctccccctatataaggaggatccaggtgcctccaggggcataacctttctctctgattatacgatcaacaatacactcggcggatcaatccccggacaggagtagggtattacttctcattgagaagacctaaacctatataaacactacaggagttcagacttcttgtgtccaaaaaatgtgacgaagttttatttcaccactatttattacaattgtagtgaccaaaaaagttttcgccactgcgatactgatcattagtgagaatatgttaagtcgccacaatatatagcattagtgtcaaatctttagtgagaaattaatattttgccactgtcgttgtattattagtgggagaacactgtgtcagcacaagaggccttatcagtggcgaatttattgtggtgaaccatcctgttgccactgtttaatttttaattagtgaccaattgttatattgtcacaggagtccctagttgtagcaaactcattcgcaactaatatttttttattagtgggaaaccttcatatcgtcacaggatactataattgtgatgaatttgtaaaatatcatccatatctggtggcatactatttttttcatagaaattcaaattagcgaaaaaaatgtgttctcactattcatttataattgtttggatatgccatgtacaatttatctaaaatctattttttaaatttgtatttcttccaaaaattttattcaccgcatatactaactataataagtggcaaagcaacaaattttggacaaaactttttttacaaaggaattaaagagcaacataataatttattctccatatattttccatacatgttttttttaagcaccacactcacatgtagaaaatggaataaacatgtttactatccgctcaagaacagaataaaggaggtttagagggcttgtcggctgggaggccgaccaccgcgccgagtctgccatttaatttcgatggcaactagagaggtggtgaggacagaaaattaatgggtctgtttggttcttacagctgtagccacagccaaaaaatgctgtaccgaacaagccaaatgattttctacatataaattgtcactgggtggctgacaggtggtctactatcatataaatataaattgttccataagcatttgcatttaataaagaaaaaatacacgcttcgatcattctatgacccagatattctgacatttgtattacatttataaagtccatgggtccaaaagattgtttttagtatcacaaaaatttaatttatgcctccaaatggacacaatcgtgaacacgcgcacacccattttctatgagcactcaaatagcactaggtcataactctagtttgagcatcatcgtgatgtcggcttgctgctcatcatctgcatcggtttactcgcgcactaaggccctttttagatcccacccaaaatttttcaacatgtcacatcgaacgtttgaacacatgtatgaagtattaaacatagactaaaaaataactaatcgcacatattacgactaatttgcgagataaatcttttaagcctaattgcaccatgatttgataatgtggtgctacagtaaacatttgccaataacggattaattagacttaataaattcgactcgcgatttactgacggattctgtaattattttttttattgaactacgtttaatactttaaatgtgtgtccgtagatccgatgtgacacgcaaaactttttaccctggatctaaacacagcctaaaccattagtaattaattaattggccattatttttaatttaccgtcattacctatccattaaaatagtatgcgagattaaatttttgacactggcatggatgcaaaattaaattggacccatcggtcaatcaatggttttattatgctaaaacgtaatgtaactagcttgtattaatccaatatgtacactcgtactgttgcttaaaaaagtactatgtaggagtactactctttatatagtagctttgaactcctccttatcctcctgtctaggagtattaaagccagcagcatttagagcgtcctagaggcacctacagcagcaacctgcatattctcgatctggatctaggcagctgcttgcaaaattcgggtggcagcgtgaaaatttctcctgaggatttttgggttagcaccggccggtgagaagttcacgggatggccaggtatgagtcgttgaggtgcagagattttgttgggatattttctgtagtatggggatttctgtggtttcttgagatatttgctcattctcaagttcgttaggataacgcgtgttcttcttcggagggattgtttctgctactagcggactaataggcaaccaaaaccatggtgaggcaaaccggcctccttctccattgccgcagggtgtttagattgagaaccatcttcctaattcccttcaaagatttggcgtcaaattatttctcccgccaaaaacgatgggtctatatatacagcctcatttcccaaaccaatcttttcaacatccagagtcaaacagaaacagaaccttgaggtttctacggtaggtttcccggagagaagctgcaagcgaaggtaaagtgctaaacgattcaattcgatctgggaatactatttgttagtcagccttgcgcacaaacacaccaccatgtttgtccatcactgcctctattgctgcaatcgccgcaaacgatgacaccgccgctgccgatgtccatcgtgtccatttgttatgtcttcttctcaattatcattctttcggtttaatttgctattcatatctttttcgtcccctgctcttattgtctagacgcagtaaatatttcttttttcaatgttacagaaaaaatgagttcccggctgcgtcagggaaatcaacgagtggatactgcagatcaaccggccacacgtcaacgatctcgtcaagtggggactgtgggtgaacaaatggcatcgatcatgccattgatagaagcgaacaagacataggtaaaatttctattaaacacaagcactttgatgcattaggtgaaataattcgttagctagagcctgtacaatatatatctctacaactgaattatttatattgtggggataaatattgtttaaagtccatctgtactgttatgtctcaattcaacatgtgcattgccaaattcagatgatcagcaggcctctgatgttgccatggatgatgcagaacaaattgcctctacactgctaaactcaagatgtatgatttgtttcaaataatatttttgccatggtttaattgaactatttacattgaaatgtctattttgactgctcctgtttttactgacataggtcgtgctccaaggaggggggggggggggcgaaaagtcaccatcaataccaaacttgttaagaaaagggcaagaagagaaaggctagatatttcttttcctcaaccatttggaaaagtgtgtggaaagcatgcaaaattatttaaaagtgaggttaccgttattgtaagaaatcatgtgcctctgaaagccaaaaaatggaagaccattgaaaagcaacatcctggtacaatggctaatgtttggaagaagttgaaggttgttaaatattcttatgtcaacatattttacatatttattttttttagttgccaacatggaacttttgctgacaggatgcatttcctgagctacgcaacgaagatgaagattgtgctatgaagcaggttgaagagtagtatagtaatcgacgttatcgtctccactgcttgcaccataacaagaaaccaaggccaacccatgtttcaccagaagattgggcttggctgataaagcatgtgtggaccgatgaggattttcaggtgcttattttttttaatataattgtgccatgttccatgcataataattgatatgcctgaaattttattatatagaaaagaagcaaccagaatgcagctaacagggcaaagcaggagatgggctctaaagtgggaactaaatcaattgctcaaattgcacatgaactggtgagaacaatatagccatttgtctttcactttctccgtatttttgttaactgtacagctcattttctcatttacatgcagagaaacaaagagacaggtgaatggcctacaacaatgcaagtttggaaagcaacctatcaaaaggctgatggaacatggtctgttcctaatggtgaacgagttctggtatatatctttacttatgacaacttgtttttttagatttcagcctaaactatatgatatgtgtcaatgtaccttctgagtagtactattttaccattggaaacgcttccatctgccctatctgtatgattcttttgcttactgttgttttcacattacaaatgcttctattactctaaaatttcaccttaacaagtccacctcacaagaagtgcatactaaatgggctaggtgaactactgaactgtgttgttgctaaataatcagtaagtgatatcattcattttatattaggccctgtttgatctaatacttgcaaaaaaaactagaatagtaagtgattaaaaatcatatttgttgtaccttgaaaccttgtatgaggtgttagtttgtttatgcttatacattttctttttataatctgtgtcaacagtctaaactaaatgaagttgctcaatcacaacaagaaaatatatgttctgcagcagtaccactagtagagcattttgccttggtccttgggaaaaaagcgaaccattcacgtggtataggcttacgtgcaattaatagagtggctgaagaaaggctaaggtaacttgcacaagttgaggctgctgaaaagcatgcagctactgcccaggagcgtgttgatgctgcggaacagcgagcagtagctatggaagaccaagtccgcaaattggatgaaacaaatgcccagttgcaagtagagcaacaatctcaacgtgatgagttgaactcccagagaaggacagtagagggacaagctacagatgttgaaagaatggtacaacaaaaacttgatgagcaaatggccatatatttctcacgcttcgcttcttccaatggtgtttcatcctcacgatctccatcagatgtaagaaacaataaaatatgactaatgttttgtttttcatgcaatggctttttaagtactgaaagctaaaaatatatttgctcatatttacaggaccattagaatgcatgaagttgatctccagaagtctatttaatcaagctgaagacatcctaagtctatttcaccgaataatttagtattagtcccatttaagtttctactggttgctttagttctcatcatgatgtttatgtcagcatttcgtgagaaattttgagcttcttgttgagtgcaacatttgtttggttgtaagacttctgaataaatatttcaatatcattgttccttaatttggtttaattgagatgttattttttttaatggtgttcgatgcaaaataaaatttatatttcattaatacaattgtcacggtgaaaaatagtagtggtcctgggagtataagttcttgtgatgaaaaattgtcacacatcttacgtggcctcacaaaaaaaagattatttgtgataaaaaattaacacgaactattcatttgtggcggtaaacacatcactattaatcgtcctaatcaacggaaatggtatagaggtgagaagaaatttcaccacataaaacatcaaaagtgacagtaacgctgccacagatctaacggaagtagtgcccatataaataatcacatttgtaaattacaatagtgacaattttatagtcataattatatactaaacgtgccaatttttggggccacaataaaaatcttaagtgatgaaactatccccactattctaaacatatttgtggcggcgtatgtcgtctctgatgtaactattatcagtgataaattttaccatcactaatatttatgaatatttgtggcgaacacaaaatcatcactatgttatttgtgatgattaccagtggcgactagtgacaaacttcagaattggccacagtcgcttgcttgtgatgaataaaacattttgtgtcaaaattaatcatcacaaaaaccaatttctcttgtagtgaaaccttgtgtctcctagcccatccacttttccagcttgatagccctttttgtattgtcgaaatcttgttttgtcatgcccggaaattcactagtaatttccgaactaatttgtacataaaatcctcgtccaggaatcagccaaggtacacaaactgacaatttaatatacaaatccatcataataataacgttacatacttacaaaagaaaagaaaacagcagcggaattaacggtctagcgatggcttcagctccactcccacaggcagctcaactggtgtataagccaaatgtcttctccttttggatcatttttcttcaactaaggttgattgattattgcaagaatgagcatatgacatactcaacaagccacacagcaaatatgcaagtgcacaaggataccaaaggatggcataatataggctcatttgcaaaagcagcatttagcaaatatttaagaatagtaaaacagtagagtaatcatcaattttaatcaacactgaacagcacacccatgctgctcaggcccaaccattctgaacaaccaaacccggctgcacagatctaactccaaaccaggagctaaacaaattattaccaattatagcatcaataattattgtgagaggtttgagactaatcacgaaaaacattgctcaacccgcccatgaccgcgggcacggctattcgaatagttttactctggccagaggtgtaccactgtacccacaagacacagccttgacatcatgtctaacatgcgtcgcgatactggaaagtacccgaatagaggctgtgacaataccctctgcacaacacaactcaccagagtgcaccattcctggatcataatcaccccctctataaatataaccagaggcatggactccccagggacccccacggacttctcgccgcttctcagtctggcaccccgcaatgaatcatgctatacaaaaggtaaagccgttgcccacgctggcttgtggttgatacggttaatgtctcacaacagtagctagcgaaccggtccttaattgtcatgagcacgaccttcaaaaccatgtgctcacaacccaccattgtcaagttttaattatcaattaattatcataacacgattaaccatcgtgagctaccattaaatataacttttggtgtaccttgcctcctggtcgtcaccatctgaaaatcccacacagaaccagcaaacagagagagctgacaattaaagctaaccacccacgactaccataattcttgaatttattactgctattaaattggttcattaaggttcaagtttcttaagcaaataaaataaagacaggctccaacacagttataccacacaccggcataaccatgccccatacgactctagcagaaaaacaaacgagaagaacacacgtgcaagcctactaactgctcgtctactgctgcgatgagccagggcggaaggtgagcagcagcgcatcctccgtgctgccaacgccagaggctccctcctcctgaggaaccacgggggcgggctcggcacgaggggtctcgacgaagcaggtccacgctagggactgacgaacaagctcgggcctggaggtactcttgcgggcggtgatcttcaggctgtggcagacgcggcgacgcttggggcgacagacctctccctgggcgatcttgagctgacgcagctgcgcctccactgcgtctaggtccttcttcagctgcagattctcctgacgtagctccaggatcttcatgttgttctcaaccaaccctcgacgcatcatctgatggaagtcgatatgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgcagagtgccgatggcgaggagtgcggcgttctggcaagcggcggagaaggaatctccacccgcggtgactgccaacgaaatcctctcgggtgagccagtgaggatcactgcagtaacctcccaagcagcgtggggctctgcatcgtcaccctcctgctccgggagctgcttgccctggtagtccactccatgcagataccccaggacaacgcacatgccccgcagctccaaaacgaagccagtcaggtgcagaccatgacggttgatgctgccggccatctccaaacaaaaacaaaagagaaaagcaacattttaaaggtcagattttgacgataaatgaagcagcaggacagagagagactagaggattttcacaaataagaaaggatttttattttgaaaatattgctaaggcttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgagaatttaaataaagcgataatgcaataatttaaatcaacataattttataaactgggattcaatatgttccaggatgatgtgacttgccttgctcgcttttccaaacgtcggctttaactttcacgaagagcggatctttcgaagttgcagcgttn

SEQ ID NO: 18335 - DNA, 22239 bp, Oryza sativa
  unsure (1)..(22239): unsure at all n locations
cagtttcccaggggcaaatccgccggtttgagcccaaaaacacagcaaaaaatgggggaaaaggcagaggggttcacggggagtgatttccccctctttattgcacgcgggcccgccggaagacgtcggaattcacgacgacgtcggcgctagggctcggaaaagccggcggaagaaagggtatgacaggtgggccccacccgtcagcgagggtgccgggcgggcccgcccgtcagcggcgcgcgcgcggggaaaggctgtatggcccgcgggaagaggagagggaggggaagggagatgggccgagccggcccaagagggaaaggggactttttagagtttttgtttttataaaatcattttaactttgtttatttcttaataattattatttgtgctctgaaaattccactaaaattatttacgcattttaggcttttaggaaatatacaaaaatcctccaagccttatttgacttttaaatttgcacattttaattgttggaggctttcacacggattttaattattctaggcataatttagaggatgtattttagagtcgttttgggacgtgacattacttgaccattcaggggcccgaacctgtataaaatttctgtctcgatctgttttacctcaatctcgcatatatcctagtaccaacaatccccatactacgcaaatactggaattacgacatcaaatgtcgacaattgtagcatttcaccaggaaatattctaaggtatcatatttatttaatcccaagggaagatatgataagggagaactatgctaatcatttatatattacttgtatatatcaaggtctatgtaggggttaagtagttcaaagggtaggataaaggtgacacacggaagaaagaactaagatattctcactaaaatataacctaggctaactggggatatgaaaagaaaagaatcaatcctatacttctagtatgcaaacatccttagtttacactcgctggtatacaatcatggaaccaataccccctaacagtgctctcctggtgtttcgagagatcacccttgattgcggagttccatatgacaacctgtcatggccatccaaccggggctaaatacggaggagtaccctccctaggaatgtgccttaggaatatatactaacatggaggaatacccgtaccgagctatcgccatcagcggcccatctctattgtctgcagcatatatgcccagataataatacttaataatccaagcaccatgcttagattactaaatactactctacatccatgaatccgacatagagcaaccgagttctcggacattaaaccctcaccaatgcacctctctgataagttagttacacaactatatcgacagaagtataaaataaagtcggtactcagataatataaagggaataaaataccgaagatgtataaagaaaaatattctattaattaaataagtcttagaaaaaaagagaggaaagttactagagccatacccgaaatctcttgaagactcgaggactaagaaaactattatatttcctactccactagcagtagagctctactaaacttgagtgagctctttgatcttcttcttgagtgtgtgttgtgaagcgagaatgagagcttcttaaataggcaggtatgacggttgtagagcatgcgaattgtcagaaatgtcgcgcaactgccataggacgtcatccggagcgtccacgccaaaccccagcctgaacggctaagacgggggttcaaccgaaccatgggctggcccaatcggccaaaattttgctccttacttcagtgacgtggtgtcttgggatttttgagattgtttcactggatttgtaagcccatttacctataagtctaactctcgacgatgtttgattgattattcaattattttccattgattctcctacattttatgtagaagtgaaatggatattatttgcttgcagagcaatggcaagcagagtgcaagcaaataatatccaagtacaagtggaaatagattattctaaagcgaatatgcattgcaagcatagctagttctcctttattttagttatattgacggtagaaattggcctataacgactgtcaaaagttatacaacatacccattgcatagacccaaccaaaccacctgaactaaactagtttgtcaagtcaaattattatggtgaggcaaatcacggtgaatctggttgacctcccataaccgagggcacggctatttgaatagttttactctgatcagaggtgtacaactgtactcacaagacacaatctcacaacacgttaccgtgttccgacatgccaccacgacataccggattgtgactatgacaggacccttcgcacacccccctaaccaatcgaatcacaccgtaggtttcgcccccactcctcaacaggcagtgggcagcaccctctcgtgcctaggtaaatccgaaagcagcttagaccatcgcagggcccatccatactccatcacgcccacccttgcccgggtacgtcgactaggtcaaaccacactgcaagtccagccgttgcccacgctaacttgtagtaagtatgggtaattcttccagtgtttcccatgaaccggtactttatcgtcatgagcacgagtgcacgaccatcaagaccatgtgctcacaaccgaccattatcaaatttcagttgacaaattatttaattaaccaaacacgattggccatcgtgagctaccattaaatgtccatcattaagtaatagtgaagcattaaatatcccaatagtgtgctaatgtttctaatcatgactaagcaattatatctaatatctagctgaaccaatatataaggcctaagctagtcaaattataacccataggaaaatataggaaaaagactcacaccacccaataacattcgaaaataaatgcacatttgaaataaatagagaatttaaatataggatcaacatgctcaaaggattgtggttgggatatatgtgacttgccttgcaaacaagcatcttcaattcgtctttaggaacttcccacgaacgagcaatccttcaaaacgactacaaactaaacctagaacacaaaatgaggaagaacactaataaaaccaaataaacagtataattaaaagtagagatgaatttagatgaattatgatacttgaacgacctcattccgagttcatatgaattagttatgaattaatgaagttttaatcaattaaaacctataaagaaaacaacctaaatgatttatggcatcatatagaattatttttgtactgataaaggaggaatatgacatcagcgaggagtgagaatggactgatgttgctgacaagcgggacccgcatgtcatagagacaagcggtagaccgggtctaatacgaactcggttcacagagaggtccacgggtccacgggatggatggctaggatttcattgatcagactttgatcatgatccgacggatgagatcgatccgatctagggttttgaggtggacgccacgcgagacaggcgatgaagtggctctgacgtggcatgccacgcgggatggacgccggcggctctagatgttggcgacagctgcgacttcagcgcggcggcagacacagagggcacggcgaggaagaggagaccgaggtaaaccttaccagcacttacgcgacattgaacggagaagtacggcgactggcgacgagcttcgagcggcagtgagatcgagatgatggtggcggcgccaccccagtgaacaccggcagaagagaaggggtggacggccttcccaaggtccttgcgaaaccaacggaggagacagcaaggtccggcgatgacgggtggtgaagcggcaaggcttcgccggagatcaaaacaaggcggcgagctcggccttcatggtgagggtggcttgcggggttcggcgcaggggagcgaatgtcaggggtggagcttggccttgcggagccgaggaaggtggcggcgcaggttggtgacggccgaggcgacggcgaacgacggctggagttggtggcggcgacggagagagacggagctcgcttggagaggtggctaaggcatgggaggctcgggtaaaagagggaaaagggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggccggcgggagagagaggaaggagaagaggattttctttactttttaatttataagtaaatgctgaaatgattttttattccgggaaaaatccagaaaatacttggaaactcatagtatttataagaattttatctagcccaatttgatgctcaaatatttcatagattttattcaaacacttactttaattattacataatttgtaaaatttcctttctcacaacaatttataatttagcaatttttagggtgtgacatgcacctcctatgtctattactctttgcctggtgatctccccctctccctgcgatcatctcactcacccatacttcagtgattgaacctaggattattaactctaactcaaactcgaacccaggattctaaactctaactccaactctttgtaggggtcattggagcaggagaagaagatgtcactggagctagagaagaacgaatcgcgaagcaaatcctaaagttctaagggtgtgtttagttcacgctaaaattagaagtttaattgaaattgaaacaatgtgacggaaaagttgaaagttatgtgtgtagaaaagttttgatgtaatagaaaagttggaagtctgaagaaaaagttagaaaataaaccaggcctaaatcctctcgtgtttctcttgtggaaccaagtactacctccgtctcaatttaagtgcattgctaagtttccgcgtccaatgtttgatcgtctgtcttatttgaaaattttataaaaaaattaaaaataattagtcacacataaaatactatttatattttatcatctaacaacaataaaaatactaatcataaaaatttttcaaataaaacggacggtcaaacgttgaacatgaacagtacaaaactacactctctcttttttaggatgggtagcaacatatactccacgtcgcattcaaccgtatttaattcacaaacggatgggcagtagttgttgttgtcatgaatactcggagaaaacaagccatcacaatcacgaattgaagaaagtccttcatttcacatcaacttcttgctaataccttagctcttaagcaacgcggtcctttaaaagactttggccatctatccaggaatcatcaacacaaataatacaagcaatcatcagaagatatctgcataaaaatggtggcactagacttgagaaatcctcccttcgccgccacgaccgtcaaggaggaccagcagttcaccatcttcatcgacggcgtggagacagccctccacgagggtgtgatccagtggaacggcggcacggtcactttggtcagcacgggtgtcctcgcggtcgaccgtcttcagcacgtcctggtgcgcggcgggggcagtggtgacgtgagctttacccggtgcggcttcgcggccgcggaggcctgcggggtcgcgtcgttccatcggtgcgacgccgtgcgggcggacggggcgcgggaggtggccgtgcgccgatgcaggtccgcggacgtggagcgcgccggcgtggtggccatccgccggtgcaagggcgccgcgcgcgtgcgcggcgcggtggaacttcacgtcgggcggtgccacgaggccaacgtgggcgggtgcgcggacgtcgcggtaggccggtgtcgcgccgcgcgcgccgactggtgcggcgcgatcggcatcgagcggtgcgggtcggcggacgtgagtcggtgcggcgccgtccgcgtggatcgatgccgcgccgcgtccgtgtcgggctgcggcagcgtaacggtgcgccgtggcaaggtgaacgtgatcgaacagccgccggtttgtcaagagaagccgatgtaccacctcgtccacgctgagccagtctacgcgatccctttggaaatatcgagcgagattaaattgcagtagaccgggcagtgccagcgggctaaaggtctgatatgctgatgatatatatgcgtgtcggtgtgataagtatacgtaatatactattgtaatataatgtgtggtttgtacggagtatatatgcacaaggattatacttttaaataaagggacaacgttgacaaatgtaagggtggattgaaaaatgaacgaatcgaaaagaccaagaccaccgaaactgaaaagacaagatcgataaatttggtcgggcattttgttcgtcaattcggttagtcttctcggttaaccgaaaagatctaattaaaaaaaattcaaatgcaaccaacaatccactaagtttaatagaattaaaacctaatattcacatcctactccttttagccataaaacccaataaaagtctttactaagacgtgcttgcgaattctttttgtgtgatttttgtgttaaaatttttttatgatttctttgcatatactacctccgttttttataatatggcaccgctaactttttgttaaacgtttaactattcgtcttattcaattttttttgcgcaaatataaaaaatttgaagtcatgcttaaaacaacatttgatgataaaataaatataatgaatggttaaatgtattttgaaaagtcaatggcgtcatatagtaaaaaacggatgtagtgtttaactttttgtttaatctcggtttggaccgagaccgaatttaccgatcctgatatttttcaattaaaattcggtcctcactttttaatgactgaactgagaggaagactgaagaccaggaccaaaattttcagtctgaccgaatgcccatccatagacaaatagaatacagataaaaaaaaacaaagtcatctattaactttgagttcttctgtcaatttgcatacgtaacatttgctgcaactcttttacaacaatggtcaaaattaatttcgctcactaaaagaatcgcaaaagaaatgtgatgaggactgaagtcccgatcgtccattatgtactgataagtccattgtggagactgaaccaagatgaccgaaccactcacaatcacaaccccaccccttcgttggttatcaactgtgccaaagcgcggtcgacctcaccgataaagctatctcctacaaatgaatcgagaacaaaaacaagagagaagaagaaataatataaatatattgcatatatacaatgaagctcacaaattggggttccacaaaccgaactaagcggcgaaactgcaacagcagaataatctaagcaaaaccgcactctaaataatgatagttattgaataaatatgattagggttagctgtagggcatccacccctcgtgcttaagatgtgaccatggatgctattgagacaaccgctgctcacatcaagaacaaattaaacaagttctggaatccaattcaactgcctgcaacaatgttgatttcaaacgactgccagatgtgcatacgaccttcgttttgggtccattagtacttagtggaaagctttcggagtccgctttccaacggattcagcctcatctttgaattccgtctcgtttggccggaatcataggaacaaggtgacgcatcacctataataggcctatgggtttgtaactttgtctgggaccccggcccaagtagggcccatgtggggtgcaccccaaccaggtggagcacaaccctagggacaccaaggtcgtccttccaccttcttgaataactaggtacccgttaaggttttcttgggttttgtttagattgaagtttagccattgctacttgcttgtagcgcgcgtactaaactgtctgtctgcatgtctttggaacccaacttatcttgtgtattcaattcctatttgcaatatcggattactttgatcttgttcttacttgtttctcgatttgcttgcaataataaggttgacctacactggtgtcgacgtttgatatcgcgactacgtatttagatggtatggggattgttggtaccaggctatatgcgagattgaggtaaaagagatggagacagggatttttatacaggttcgagcctcttatcttacaggtaatagccctacatcctgttggccgaagccgatgttgctctttattcatctggatcacacaaataaaatatttgggataacatatctggctgtcgtcgacttgacggatagataaccaagtcgtagtcgacgatagggtagtctatctcctcgaatttgtactcggcgggatcagagatggcgctagatccctcttgccagcttccgtaggcaccggatggggtatggctaggctaatctttgatgtcgatatccggcgacgtgtgttggcttgtggctttgtggctttgtggctttgtggcctatcccctctcctcctagggggtttgtatttatacccatagataaccccttgtccaagtaagtatagggagataaatatggatatgatctgagtagtccttgtcgttttcatgtagaactcttcttgtccttccttatcccgaactccttctatatacgaggtttgtttccgtataagacatggtatgtggtgggccttgccgagcttagtcgattactattgggtatgtggtatccataaccctgacagtagccccgacttcaatgcaaatgaacgagttcatgttctcaaccgaagactttggaataactgttgtcatgctcgcttgaccgttctcggtgagatcagagatagtgctagattcctcttattggcctttgtaggcactatattggttttgtctaggttaatctctgatgtcgtccgagaagatacggaacatgcgactaagtctcccgtcgtgctgtaatcgagaatttggattgaagtcaagaaattccatctcggcgagtacacctttgcttcattccatattccttgtcgaactccagtagtcgttctcggataatcgagaaggtgcaaagtctgcgacaaagccttgaaatctgacttgactattctgatgtctgacttccctaatcaacattcgtcgtactcgcttaatcgatcccgctgtaagaccgtagagacatggagtcctcaacagcgttgaatggaattatcttgaaatcaattctcaaaacaaaatattaaatagagatagccctcaagcgaacgctcaagggtaacatgttctaatatgtatggaaaaattgaaaatcaattgaatctacgtgtaacaataaaagagtatgctggctagagttgccctcagcaaacggagtttggtactcctcctagcccctagccctatcctcggggaagtctgttctcggaggggaaggcccaatgacacgtaacttgcctagctgaaaatgcaattacctagcccccagccgtgaagttggaaaaaccaatttccaattacacggcttggttaatacgcattatggagcactcttacatgaccaggttttacatggtcgtttggctctttaggatctgacaagagcttatctgctctgggtgtccccagccgaaattcccttaggtttctcggaggcttgtcagactggcgtaaagggacaataatttcgatgtcaagagtaggtgttatcgtggttagggatctctggacaaatattgcacatataaacacttacagaagatgacgtagatgatgagataaccaccacactaggcaaagcccaggcgtatagttgtacccaataaatcgcataggtagtgggagaatcgctacatcgttggcagaaaaccagttgtagtcatatctcgaccactacgacctactggttcaagaaccaggagtaggagtctctcaaccgtttgaaattgaggtgcgaggactactacgctactggtcgaggaccagttatagtcgtaactcgacctttggaagtcgtggtacgaggaccgctacgctgccgatcgaagaccagtcgtagtcgtacatcgaccatcagaagtcgtggtgcgaggaccgctacgttgccgatcgaagactagtcgtagtcgtacctcgaccataagaagtcatggtgggaggaccgcaacgttgctggtcaaagactagtcgtaatcgtaccttgaccaccagaagtcgtggtgcgaggacctctacattgccggtcaaagactagtcgtagtcgtacctcgaccatcagaagtcgtggttcgaggaccgctacgttgccgattaaagactagtcgtagtcgtacctcgaccatttgaagggaatcagagtaatgtatggacgacattcccgtgacttgcgagaacaacctcctgatgaagacgaagacaatgaggaattatcgtagtcggaggttcggctcctgtacctactacctcatcctcggaccctctagaagtctggggatctcgagtttcgtcgtcgtcgtgtgatgtagttaaccgtgtccgttgtcgtcctgatgtcattagtcctcgacattgtcgtcctagtgacaacggcgatctagtcagtcttggttgtcgttatcacgacaatgctgattgtcccgttagatgtcgagagcttgctaaccgattagtcgaggaccaggagtaggcgtatcttgatcacctgaatatgaatttttaggtggtgagagatcgctacgatctactggccaaggaccaggcgaaggcgtatctcgatcacctaaagacgaattttcaggtggtgagaaatcgctacgatctactggtcgagaaccaggtgtatgcatatctcgatcaccttaagacgagattttaggtggtgagagatcgctacgatctactggtcgagaaccaggtgtaagcgtatctcggtcacccgaagacgaagttttaggtggtgagagattgctacgatctactggtcgagaaccaggtgtaggcatatctcgttcacccgaagacgaatttttaggtggtgagagatcgctacaatctactggtcgaggaccaggtgtaggcgtatctcgatcacctggagacaaattttcaggtggtgagagatcgctacaatctaccggtcgagaaccaagtgtaggcatatctcgatcacctggagttttaggtggtgagagatcgctacgatctaccggtcgataaccaggtgtaggcgtatctcgatcacctggagatgaatttttaggtggtgagagatcactacgatctactggtcgagaaccaggtgtaggcatatctcgatcaccaggagttttaggtggtgagagatcgctacgatctaccggtcgagaaccaggtgtaggcgtatctcgatcacttggagttttaggtggtgagagatcgctacgatctaccggtcgagaaccaggtgtaggcatatgtcgatcacctatgaatttttaggtggtgagaggtcgctacgatctactggtcaagaaccaggtgtaagcgtatctcgatcacctatgaatttttaggtggtaagagatcgctacgatcgactagtcgagaactaagtgtaggcatatctcgatcacctggaggggcgctagagttggtgattacatgcatctcatgtggccagcatgactcacatacccaacatatagcatatccggatgtctatttgcaatcatgtcgggtgatcaaaccgacgttatttgtgagggattatccgttaacgacatattctccaatagtccgggcgtggccggcgctatacatgagataagtcgtcagtcttcgttggtaggttgggtacgacgacttagcctttatcgagaaagttctcgacaatggggtgtactcgaccacaacctactcgagtgctcaattgtttctgaaaaatattttctagaagacaagatatataacagagaatatcgagtatgtactcaaaaaaactgcatgactcttctagtattattaggatataacgagcagattaaatattaggtattacgtaaaccgtaaacaagtatgatttatactaaagaaaatagagcgagccccagcattaaaccgtagttggccaatcatcggaaacattcgcacaatagatatgtataaaaaacatgctctaggtaaatataataaattattggtctcaatattatatgatctgatcgtggatagatgtgatttatctgaatagtcaacgcattgcactttaggcagccatattggtcttctctgcaggtacacgtgcacgcctgggcacgtactgagtccatgcatatgcacgtgtacatgtcaggagtaagcacgttgactcgttgtcttgttgttcagtagattacgccgtggtgattttgggcagcaatatatccggcctgagtagattaacacatggtttcctatcacgtggagtgacaggcacctgtcattcacctatccgtccggcctgttattgtgtccgaccaaagcacgcgttagccaggaaatcgatcagtgtagtagtcaattccggtctcccatggtgtcagcaacatcctcgagatcaccgatggtcgataatactgaacagatgtcttcagctgcggcgacgatggttccgatctcgtcggaagacatacttcggtcggattagatctccccagtcccccataaccgaagttgtcgagtagtttggtgttagagaatccatctcttgaaccaatttcatcgaaaccttgaagcaccaaactccccctacctggcgcgccactatcgatgtttgatatcgcgactacggtatttagatggtatagggatcactccacctacctggcgcgccactgtcgacatttgatatcgcgattacggtatttagatggtatagggatcgttggtaccagggtatatgcgagattgaggtaaaagagatggagacagggatttttatacaggttcgggcccttatcttacaggtaatagccctacatcctgttggccgaagccggtgttgctctttattcatctggatcacacagatacaatatttaggataatatatctagctgtcgtcgacttgacggatagatcaccaactcgtagtcgacgatagggtagtcttccttattgaatctatactcgacgagatcagagatggcgctagatccctcttgtcggcttccgtaggcaccaaatggggtatggctaggctaatctttgatgtcaatatccgacgacttgtgttggtgtcgtaggctctccagaccttccattataattaagagatgaagtgaataattcaagtcattaaacaagcataatgaagtagccgacgcctcgagaaaggaatattgaagacattgctgggctttaagcctgccagtgaacttcagtctgagtcaacttcagtctgagatgtgcccgtcaaaccactcgaaggcggtgacaagatgtgttacacattcaggagacttgataaaaatggctaaatatctacaacatctcaaatattctgaactcatactcatgtgaatctagttctgaggatgtgcactagattcacactttcatcttaagcatggacatacatagcaaacacaaataagatgaaagcgattaaaattacatctaacttagagatacataggccgaccgaccaaataaatatatagaacagcggaagcttatctacccaatccataaacacaccgactaggggtttaccccattaagttcaaatcctagaagaagcagtcgattacccgcatcactcaaatattaaatctaaaacctgcaagcaaaaggttaattcaatggcaagagtcagtacattattagaaataatgcactggcaagtaccaagacaaacctaacaccctacttgcaaggcatataatcaaggatggttctttttagcataaagcaagttttatttgcataaaacacattcaaatcagattttctttcaaataaatttcagcaagctagtacttaacatatgggcatcaaagtaggcattaatcatgtataaatatgcacctcattgccatccatggcagcaaggagatcattctgaaatctcaacataatttgaaggtaaattcaacatttagaagaataaacacaagtctatactcaatacatatccacacgctgttcatgaccgcgagcacggctaatcgattagtttttactctgcagagtttgtacactttacccacatgatgcgaaataataatcatgcaagagcatggcacgcgattcataagtatccgatttattactcacaacaaagcttttccaaaattcatgatttagccttacaccaacacgatacgtgttactccatcctaagccatacacgttatatgacctagaaccgttaagtggtgggcccacatcttaaacttaacaccgtggtggcggacataacgggaacccacccacgtggcacaatatggttgtattggatagacttagtcacctaaactaccacgtcggggtaaataggaagtttctctgagttatccgaactcatacacaccggcctactagaatgtaaggctgaaccataaataatttactaagcttgggctatcccatactagcacatgtggttgtactgtatacgaaatgaactgacattgagtgaagcccttaggtcggtttgggcacactctccccctatcggtactcaactaatcaccatatgtgcaccacttgaggcccaaacctaaaatccatgttttccatcattttatttatcaaaatcacaagtattaaagttctgtccagattatttaaaaatcaattttcatgtttgtaatgagcccataatgacaaggaagaccattctaagcatggctaagcattatagtaatctagtgactccaaaactcatatataaagtggtatagtcatattgttccaaaggttacgaatgagggatatggttatatgtggagttaaggtgataatgcaactagtaggggtttgtctaacaagtttaacaagattttagtttattagtgtacaatcgacatgcaagattttcaaacattttcaataacctccaaaacataggttcaatgtgatcaaagagagggaggtgggacttgccttgtaactggaaaatgtcagcacctaattcacttcttcaccgtttgagcaatcatctatacaaagtacacgttatgtaattaaacaccgaaatatgtgaaaaattcaaaatgctctaaaatgcatgatttgtgcacagtaaataggtactggtctaaaatgaatttaggtgaaagaatttctattttatctcatttcatttgagagttatgaattttagaagttttcgtcggtatagtataggatttacttaggtactattgtgaaatgctcttgtaaggtgattcttattaagtttatgtttgctagggtgaagatatatgttttctaagactaacacatttgatttcacaatttttagagttaatgtgaattctttatgtattttacaggttataacgtgttataggtgtatataggtgtatagtgttatataggttcatggctttagaggtttaggtccataacttgcctcatctagctagtgatgtacaaaatgagtattttagttaactaatctaaccttagttcataagcttatggtctttattatcatggttcatattcttataaactaggggagctctagtctatgctagcaatatattatatcaatctagaaattattatagaaattattatatgagctaagttcttctaagttatggtggatggggatggaactatggatccactggtcctaacaagttttatttggaattatttggagctaccatgcatatatatacttattgatatgtattgtttaaccactattatgtgttaagtacctatactaccaaattaaggtttagagctatggtatgaacagagggtgccatattccactctactaggttgaagtacattactttctggtcctatagaaatttggttcacttcatttaaaataaagatgaattttctacaaattttacaaattaaaggttgctctacgttggttattaattacataaatatttagaggcttttattacaaagtaagtatatgattttattttacaaattagaagtatatgttttggtgactctacataagttgggtttactcaaaaacgatctaacatgaattttatataaacttctaaagttcagcttatatatctaaaactattcattttaaagataatagttttagaggcattaggtacaaagtaagtatattattttatttcactttacagtggacaacaaattgatgattccgtgaaatgtgaatttaccctaaaatgagttgagatgaattttgtatgcattttataagtttgtgcatgctttatgtatattttttcttaaataaattttagaggtgaaatttgtactgcaagtgtaagttttcatttcataacattaaagttcatccttatatgagttcacagaaacttgaatcatctcaaaatgagttatatttgattttatatggatttttacaagttttaggtacttttcttatataatctcagattttgtttctaggggtccgctaacagtcatacggccaatatgcaaaaaagcccttgagatttctagaaaccaacccgcagtcttaggcccatatgtcagtgtttagtatgttttcatattgaaccttatgtttgtttaaattctcaacacgaagtcctgcgacctggacagaacagagcgccatggccgagctcgatctcgagctcgccggcgacaaacgatggctcgtttgggggtgcgaccaatacacaaaatgaagatcatgttattgcgatttcattcctatacatttctcagatagcggacattgaagcagcgccagcggtgagtccgagcagaggatgttttcgggtggtggtgcatgtcgtgctatcgactggatgtgttagtgatatgccctagaggcaatcatagagatgattgtatcacatactatgtttacatatttattcgatattattccttaaaatagataactcattattggttaatgaatatgtgattctttcatgacactatttatgttgtttgttactatttttaaaggatccctgatcaaatatcatatatggaacaaatatgtttatatgatcagcacatgtattaattgatgatcatgtctcatggatcatggtatagagataccaaattaataatgtggacacatgttgctgaacatgttgttggatagacccaacatgagacactggaagagccatatgtgttgtgtcatcagtgatctcatttagtgttggtgttgaatttttagacctgagattatcatggttcccaacatgtatagtagcttacttagggactgctaaacgctactccgtaattgggtaattataaaagtagtttccgggtatgctatgaaacatgtagtgggatatgaataatcaagatgggatttgctcctcctatggagagatatctctggacccctcgatgttgtagattatggaagtgcatggccatgccaaagatgattgaggagtcaatcacaagttatataatctatcaacaggttcgaatgaatgattgagctattagaggatggcacatatctagccttaagcttaatccatatcgtgaggcaaaggggttcatacaagtatacactagaggttcagccgatatgatctttatttatacccggtgggtcaatacgttctgctaggggccgctgttgacgcgtggaccgaaaaggagttttcgggttaaagccgagtatatatgaacctacagagttgcacgcttaatgggccggaataaggggattggatggagatccaatatgtgcttaattcggatagggatccgaataggagtcctacgggccttggaggcccgagtgatggatcctatatattcgtgaggggtgtgaccggcggaggcattgcatcacgtgagaaaccctagccgtcacttccctccccgagcaaaaccctagccgcgcgctagtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactactttctctacatcgacgcgctaattcgcgagaattccttcgacttctcagcgtcttttccgctgtgcagcgcatcgaatggtaacgatctatgatctaatacctgcatggttcctggtttacgcgatagaaaattttgatttatgctatcgtagcctacgcgtatcccaataggatgtacccaaagggatgcatgcatgtatgttctataggctgcaggttgctcaccgaagctcggatgcgctacgggtaggcctggacagcgacgatgatgtagaggatgtcccggcggcggcggaaatcagcatagcaacggtgacaaccaccatccgaactccgggttgccaaaaaaaagagtggaacggctcaaagaccaactaaagatgctacacgagtcaggaattgcgccgaagctcacccgggatcaaggaatcgaagatcgacgccggcggccggagttggagaagatgacgccgatctccctcctcgattcaccgatccatgaggttctaggagtatcttgaagaggacgtctaggcgattctggtggcgcaagggttcggcttggggtggttcagtttggtcggaacgacgacaagaacccgacagcggtcatcgttgtgcgctccaaggcgtttgtgggcacggtggcattcccgctcaaccactgcatagaatgggatgaaattagatgaaatagagatggcattgagagtaggttttggaacgcaaaagaagaggaaacgaccgcggctcattaacgaatgtggctatcgtcttcttcgcggccggcgatggagaaacggtggagaagggcagcaaggatgctctccctcggttggatctgccctggaatggtgggtgaagagtggcgacgcgtctgggagaggcagagatggagctcggcgtttttagggcgtcgacacgtcgtggccacgcatcgaacgtgcccgagggctgtcggctcggtctctttctcagttctggtcggctagagaagttgcacagaggaagggcaagccaaggaggctgtcaggtgggtccaggtcggtgtaagctaggtgggggtgtgagggatgggtagataattgggtgcaagcgattttggacaaattttcaggattatttctcttacccatctttgttaattcatatattaatttgtggtacagatcaattcatgtggattttactgaagtagatgaatgtacctagtttccattttctttgattgcactcacgaattatggatagattgcacacagaaattaaaagaagataggctcaatggaaactgtttgaattttcaggagacataaacagagaagataaattctggaaaaattatatatattcataataaatggcctagtatttgaataaattgtttcccctatacactcccatgaagttaaatgcacttttaaacaaagtatggttttagccaattaggaattttaattagtctattatttaactgggttgacttatttatttgatgtaccaaatttagttattaaatcttaccaaaattacaatgagttgtatatgttaaatagagccttcatgaattttcccatggttttatcttgcacgaattattttagataattagcaagacttatctcttatatgtgtttccctttcctaaatgcatctaaatgtttataaaagttatatttggactcttcttaacctgaggtgatgttgatatgttagaattgcagtttaccttacatatgtcacaaactccttaccaatttatgtataagtttactttagtattaaattaagagaatgcttatcgagatgattaagatagaatataccctatatgagttaatttatttgttcacttccatgtacatgacttgtcttcagatggatgaccaaattagttttgtggggcttgacattggcctggttgatatattttaaggtgtatggtttctattttaacttcctctagctagcactaggccttaatggtttggttgtttatctagatcttagttatcattcatgagatctattatgaaatgcaaaacaaacatccaaatgcataagaaggacttaagtcaaaacatgatgtaagcgagtatgcatgctttcacttgtttttgcatctatggtataggttaaagatgaaaatgttttaatttgttctcaaattttacttcagtataagttagatcaacttcacctaggttttaaaatggaaatttttggttcacaaaattgaagaactttcctttcaactagttttgaagaaaattccttaatcctagaatttgggtatgttacagttggcttgtggctttgtggctttgtggctttgtgcccttgtggcctctcccctatcctcctagggtggcttgtatttatacccatagataaccccttgtccaagtaagaatacggagataaatatggatatgatctgagtagtccttgtcgtttccatgtagaactcttcttgtccttccttattcggaactccttctatatacgaggtttgtttccgtataagacatggtatgtggtgagccttgccgagcttagtcgattactattggtatgtggtatccataaccctgacaaccgtcaatatcaacaacccacgaagaggtgtatcgatctctaaggcgcaacaaaacaacgtcttgtacggttttagtcggatcatcaacatttacccaaatcgtagttatcaccaactcactgaatgatcaggccaatcatagccatgagtgtcttgagtggaactcatggtttatcaagtggtatttgcttggtgagttttttttatccacctataaccagaatatagccataaaaaatattggatccattacctagccatctttgtgcccgctgcattgttttttttagtttttgctttgttgagttttgtgttgcatcgtcgtgtcatgtttgttggtatttcttaacgctcacggataaaatctacaagcgcatggagatactgatgtagcacttcacccgggagtattccaaggtatcgatttctaaagctaatgtgtgtgcttaactcttctctagtttcatccaaggacacaaggcagatataggaaaagggtagagaggatttcctattgaggaacatggtctatacttcaggcactggcttactcactactgttggctgctgttaaatgccaattctatgccgccaatacctagataaaacatagttaataagacatccaacatagtggtagggtttaattctaacatattccatgagtgttgatacatatttggatgaaatccaaagttgggatgaaatcaagacttaagtgaaggaagaattgtcacgaccggaattaaccaaacgggcgttccttacgtgcgtgtattattccttgtcccaggaggcaaggtacaccaaaagttgatacatttcagagtttatcaagtggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgagtttgggaaaaattgagcaagactagtacaaccactatanctactgcgtgnngcgatgacatcaggntacacagg

SEQ ID NO: 18336 - DNA, 1921 bp, Oryza sativa
  unsure (1)..(1921): unsure at all n locations
cgaggatatttttaatgttcttcctatagttctcacacgcttacgatgtttnatatatcatgtcattatttntccccctccccccagggntttgatttcgttgacncacgcctctgaaaacagcannaaaagacacgnagaagcacaaagccaccccgggaacacaannccagagctatacaaaattattaggcaaggccgtgaattctaactaacctaccttaacccagggcctacgatgagtgagaccgaactggcaacctgaccctgggtcccagctcggccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccataagacacatcttcctcacgtgtaaccacgtgccacataccaccacggtatacggacggaagacatgacatagtttccaacccatcctagccatagacaagagtaccgacccaaccccacctatggccggaacccccgggacaggtaggcaggactgagcccctagcagcaggacaccggccctgtgccatgacatctcgactaccgggccgcagctcgtgtagccttcatttgtcctagagatgtccatcgaccaccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaactattttgaggattttgaatagagggggaggtgtgaatccaatttccacaataatcaaaccattccatagtgtccaggtgatatgaatatcccaaagtctagagttgtaaaaccacccaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgtttaaggatgatgtgacttgccttgctcgctttcccaaacgtcggcttcaacttcaacgaagagcggatcttctgaagctgcagcgtctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaattttaattttaaaagggtttattgcgtcagccgaggggagggggcgcgcggacctggtccacgggagtggggcccacactggagcctcacggtccacggtggaccgggtgcactcaggctcacaccggtcggcgccgtgggttccacgcgtcaaccgcacccgagggcgcgggcggttgacggtcggtccccacgcggtaaccgctcggtgcgccccgaggtcgacacttcctgctcgttcggcatgaggcggcgcgcccccacccctattgtccctgggggcggccatggccacattttagcgttggccgttagaagggagggaaaagggggaaatgaggtggctgattctagtgttcacccttttcctaacagtaacggactaaatag

SEQ ID NO: 18337 - DNA, 23648 bp, Oryza sativa
  unsure (1)..(23648): unsure at all n locations
cgtgtggtgatgtaggctgctgcagnagcnatcattgaagggggagaagagcggccggtggggaaagaataggcgcgggaggtccggccgccatcaatggcgccggcgagatttgcggnggcaaatccgcccgtttgaacgcgagagagagagggaaaaatggggagaaagggagaggggatcacggggagtgatttcccccctctttattgcacgcggggacggcgggaggcggcgggattcgcggcggcggcggcgctagggcgcgggcgaggtggcgggagcggcgggaggaaggggatgacgggtgggccccacccgtcagcgagggtggcgggcgggcccgcccgtcagcggcgcgcgcgcggggagaggccggatgggccgcggggaaaggagagggagagggagggaaaggggactttttagagtttttttttttataaaatcattttaactttggttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgtgacaaacctaccccccttaaacggaatctcgaccccgagattcggaagaactggcgaagagatcgggatgggctgctttcatctcgtcttcacgctcccaagtagcttcttcctcagcgtggttgctccattggaccttgcaaaaacggattacctggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccaaggtgcgagcttccctttcgtctgaaacctgtgtacacctcgcaatggcgtgacccgaaggtacacaaaatcgtccactgcgaattccagattacggcgtcggttatctgcataactcttctgccgggactgtgccacctttagattatcctgaatggttctgactttagcttcagcttctgtcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcacatcttctaggatctgatttagacgctcggtctgtccatctgtctgcgggtgatacgcggtgctgaaatttaatcgggtacccagctcttcttggagcttcttccaaaagtgagaagtgaattggcttcccctatcagatacaattttcttaggaacgccatggagactcacgatcctagcgaagtagagctcggctagtttgttccctccataggtggtcttcacaggaataaaccgagctaccttggttagtcggtccacaattacccatatagaatcatatccgccttgggtttttggaagtccggtgatgaaatccatcccaatttcatcccatttccattctggtacttggagaggttggagaagaccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcgtgagcttcctgaagtatcaactgtttaagttctctgtcgtctagaaggcatacccgatttccgttccatagggttccgtgttcatcctctgtgaaaccagcggctttaccctgtttcatattcttgaggagtccacgcatatccggatcattcttctgagcctcgcagatttgatcgagcaaggtaggcttggcttccagcgtagccaagaatccacgactaactatgcttaggttcagggcttccatctgttgattaagttcgggtggaatgccacggacgtcaagagtgttgcaatggctctttcgacttagagcgtcggcgaccacgttggccttaccaggatgatagtgaattcccacatcataatccttgatgagttctaaccatctcctctgccgaagattcagatccgactgagtgaagatgtatttaaaactcttatgatcagtatatatttcgcagcgattcccaatgagataatgccgccagatttttagagcatgaaccacagcggctaactccaaatcatgggtagggtagttgccttcatgaggccgaagctgccgggaggcataggctaccacatgaccttcctgcatgagcacacaccccaatccttggcgcgaagcgtcacagtacaccaggaagtccttgcgagtattcggtaagattaacactggcgaggaaaccagcttttctttgagagtttggaacgctttctcacattgcgggctccacacaaatttttcttccttcttcagcaactgcgtcatgggtctggcaattttggagaaattctcgatgaatcttcggtagtacccggccaaacccaaaaagctgcgaatttgagtgactgtcttgggttgcttccaatcagtgacggcggtcactgtttcggggtccacagcgactcctttagcagatatcacgtgccctaagaatttgacttcggaaaaccagaactcacacttgctaagcttggcatacaattgatgttcccgcaactttcccaacaccagacggagatggtgctgatggtcttcctctgattgtgagtacaccagaatgtcgtcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttagggatatcttcttcacgaatacgtaattggtgatatccggaacgaagatcaatattggagaatacagtggcacctttaagctgatcgaacagatcatcgatccagggaagagggtacttgtttttgatggtaacttcattgagagctctgtagtcaatgcacatcctctttgtcttgtctttcttctccacaaaaatcacaggagcaccctagggggaagtactcggccgtatataccccttttctttcaactcttccaactgtttcttgacttcggccagttcatttgatgccatacggtagggtcgcttgtacaggggagtggttcctggagcaagatctatccggaactcaatctctcgcttcggcgtcataccgggtagttcttccggaaacacgtctccgaactctctgacgatggggatttctgacagtcctatctgatgaagttctgaactaccgacagaggttgggggagcaaagaaaacaaccggttgttccggccctcggtaccgagtgacagtgcgtcttgcacaatccactactccttggaattgagccaaccaattcatcccaaggatcacatccaagttcttggtgtctagaagaatcagatccgagggaaaaggaattccctgaatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtgccaacgatgacgtctggagttgtcagcacatcctcggccgtcacgtggttcacccgaccccgaatgacatccttaccaccgttgttggggcggggaggcgcttggccttgctggcgcctcggctttgggcatttatccgcaaagtgcccatgctcgaagaagttgaagcacagacgctgctgaccttgaacgtccttgcggccttgaccaggctgcacggctggcgtaggaggatggggcgcacgagtcccttgctgactctgctgttgctgcggctgtgggacgcgcaccacgaattgaggtcggggcgcggagcgaggttgctgctgctgttgctgctgcgaggacgatccccctggatagggattggtgtagcggaccctttggttaggcccctgttgattgcggaaattcgccaagcgacgcttgtgcgactccagttccttgtgcttggcttccaagcggatgctcttgtcaaccaaacgctggaaatccggatagtccccggagaccagacgcacggacagctcagggtccattcctgccaagaacttctcttgcttctcctcatcttcacgaacatcctccggggcgtatcgggccaggttgttaaactcatgcaaatactccatcacagagcggttgccttgtttcaactctcggaattcccttttcttaagggccatgactccggcgggcacatgggttctccggaaagcggcggtgaagcgggcccaagtaataggctgcccttctggctgcgtagcctggaaatggtcccaccatagagatacgggcccctgcagttggtgagcggcaaagatgactttctcctcatcgttgcactgcacggtgtctaactttttccccacagcatgcaaccaatccaaagcatccacggggttattggagctagagaaggtaggcggacggatgcggaggaactcggcgagtttagagagttgtgggggcggtggtggagcattatattgtggcggattttggatgtggaggaaagcagccatcatgttggcctgctgggcgaggatttgggtggggatggcgttggtgtctcgtggtggtggtgaagccgaagaagaaggtgaaggtgggctgccatggttgttgtggttgctaccttcgggttggttgccatcaccggtattagcacttctcctggtcgtcaccatctgaaaatcccacacagaaccagcaaacagagagagctgacaattaaagctaaccacccacgactaccataattcttgaatttattactgctattaaattggttcattaaggttcaagttgcttaagcaaataaaataaagacaggctccgacacagttataccacacaccggcataaccatgccccatacgactctagcagaaaaacaaacgagaagaacacacgcgcaagcctactaactgctcgatcacccatcccaaattgctccaggccaagcacgcttaaccctagagttctttggagattggcttccggaaaagaaattgcagcttgttgatatgagtattctattaatcctattaagccctaggccaggatgttacaccctcacccccttaagagagatcgacgcccccgtcgatcaaccctaggccaggaacgtcctctcttggccacgtccatgtgtccagtgctagcgcatgtgccatgctgtgtaaccactcccggtctacaccagccatgcgcaccatgcctgcgcaactgcgacacacgtgcccgtgaaaccgcgagaaatacatcctctaaattatgcctagaataattaaaatccgtgtgaaagcctccaacaattaaaatgtgcaaagttaaaagtcaaataaggcttgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagttccctttcccttcctctccctcttgggccggctccctccccctccctctcctctccccgcggcccatccagcctctccccgcgcgcgcgccgctgacgggcgggcccgcccgccaccctcgctgacgggtggggcccacctgtcatccccttcctcccgccgcctctcccgcgccctagcgccgccgccgccgtgaatcccgccgcctcccgccgtccccgcgtgcaataaagagggggaaatcactccccgtgatcccctctccctttccccccatttttccctctctctctcgcgttcaaacgggcggatttgcccccgcaaatctcgccggcgccattgatggcggccggacctcccgcgcctattccttccccgccggccgctctctcccccccttccaaccctatttaaaccctccccgcacctcctccgtccatttccgcctctcgccgcccttcctcctcgccggaatcgagctcgcgccgtcgctctctctccgccgtcgccgccgagctccggtccaccaccgtcgtcgccccagaccacctcccacctcggcgccacctccttcggcttcgccgcatcctcaccgacctcgtccacccctccgtttcgctcgtcgaccaccggagcgccgccgtccccatcgacccgagccgcgccgccgccttcctccgctccggctgccttttcgtcgtcgccgtcgacctagggtgagccgtggaccaccgcctcgtttccccctttccctcccctctctcggccgccgctccgatgtgcccatggccaccgccggcgaccataggggcgcgggcgcgccgcctcccgccggccgcgccgacgtggccgccttcgggcgcaccgagcggctgccgcgtggggcccggccgtcagccgcccgcgccctcgggtgcggctcatgcgtgggacccacggcgccggccggtgtgagcccgagtgcacccggtccaccgtggaccgtgaggctgccgcgtgggccccactcccgtggacccggtccgcgcgccccctcccctcggctgacgtaataaacccttttaaaattaaaatttaaatgaagaaattcgcaaatattcatttaaagagcatataaacttcaaatggccataacttggccattcgaactcggaattagaccgttcaagtctctaatttttccttaagaagtcaagaacctttttttgtgctttgttcctgcttgttatatggagtttattagagtaaaagccttttcttttccgttggtcgtgtagacgctgcagcttcggaagatccgctcttcgtggaagttgaagtcacatcatccttgaacatattgaatcccagtttataaaattatgttgatttaaattattgcattatcgctttatttaaattcccgcgttatcactattttatctagccatgcctatttacctttgttatgaccttattattgttattgctattatttccttgttcaccctagaataaacaaaaccccaattagtggacactctactcatggtaccactactatgattttaggtagatgcttcgctggttaattaggcaatattaggtggttttacaactctagactttgggatattcgtatcacctagacactatggaatggtttgattattgtggaaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgccgtaggtggggttgggtcggtactcttgtctatggctaggatgggttggaaactatgtcacgtcttccgtccgtatactgtggtggtatgtggcacgtggttacacgtgaggaagatgtgtcttgtgggtaaagatgtacacctctgatcagagtataatctatttgaatagccgcgccctcggttatgggcaagccgagcaatgtacccaagttagtgttttaattcttaaaacatgcttaacaactaaaatgtggaatggttggcctgggtttgcttgggacgagctgggacccagggtcgggttgctagttcggtctgaatcatcgtaggccttgggttaaggcaggttcgtgtgggttcacggccttgactaataatattgtatagctctggaatcgtgtttacaaaatagctttgagcaactaagtgtcttttaatgctgtttactacaaaccctaaccctttatattataatccccttgtactcccttgcatttatcctgcacttgtgggtgtgtcttgttgagtacggtggttgtactcagtcttgctcaatttttcccaaacccagaagaggagcccctagaagatgaaggctttggtgtctagctcgtgcctaccgtcaagcgcctgtggtcgtcgccctagtattccgctgtttcccgtttgtctttgtgtgtgctgggccttcgccgcccatgtaataaattaactatttacgcttccacttgataaactctgaaatgtatcaacttttggtgtaccttgcctcctgggacaaggaataatacacgcacgtaaggaacgcccgttgggttaattccggtcatgacaagaattctatccatacaagagtgggccttaaacttcatcgaaacatcagaaaataggcccaactacctgagaaatggataaggcaagctgagagagagaacaggccaagttctggtcctgttgggcccagccagggttcggccggactccaatctcgaccgttcagtctagggttttcatggacgctccagatgctctccggatggtggttgcgggacattttcaataattcgcatagcagtaaccgccatacttgcctataaaaggagttaatcacttcacttctcagacacactccaagcttgagctgagttataagaggttctattgtactatattgtatactagaattagggagagagtaaagtagaagaagttggcggaattccggagttgtcggtaatcctctcttatttcttatactttgttaattactctgttttaatagaattatcattctgagtaattaagatttactcggtgagaattaattcttggttagtttctaattagcgtgcgggatcattgttcactatagtcctttaaaatatagtgattgctttagtgtttagctagcgctaaagtaattaattgtgtagacgtggtgccagggtaattaatttccggtggttgcttcgtatcccacagtaggtttgaggtgggtgtagaggtggtgacatccctcaattacactaaagtcctccttgtccgggtacgcagtagagtgacatctaggagcagcgagctggccagtgcctgaagtactaggattaaactgagctttctgtagacactatttctcactagtaaatcctctctatcctttgcttacctttgcttcgtgtccttggatgaacctgacaaggagctgagcacacacgttccctagggaaatcgataccttggaatacttccaggtgaagtgctacatcggtatcttccgtgtgcttgcggattttatctatgacgttaaaaaataccaacaaacatttctggcgccgttgccggggaatggttgatgttcatctccgaaccttgttcatcttcgtatcatttttacttttcattcttcaaccttcacccctgctatccccaataagtattcttgtaaaactcttctcacccatggagccacaatctatctttcaactatctgctccacggggcaaatcttttgagccacctccttcatcggggccaatttttacaactggctatgaaagtcgccccgaattaataaggagtctgcattctatctaggcatcactaccggaggatcattcatgcaataaactccatctgaaggaaaagtaagtctagatcggattctagaaaatacttccttcatggatcaatgtaatgaactcctcccggaagcatcagtgtctaggattgaggaacctccgacacccgaatcttagtctgaaccatctacctcaaccgattcggccgaggaaccttccgccgagccattgcctgttgagaacgaagaaattcaaactccgggatgtgctccaacgttcagggatgatctttatgaagattatggaaacaccttgaactattttagtaaaaagaaaccacctattcccttgccacctcctgatccgatagaatatcaatatctgaaagaaacggtcgggagctgacatccatcatgagtgacgaatggttaaaggaggaaaatgttgatgcaaaaaacacacactagcctaggagatctgcttagctccagtgcaggtcctaagaattgctttagggttttgagcatgccagctggtttgatcatgcaaccaacaagaaataaaagaagaacaattaagtccgcaaatgatagccgatcggctgtgttgccgatgatgtttcatttgatatcaggccgatgtgatgtgaaccagatcggcaataaaatactaaacaagatagaattaaatctacttgattggctgcagatatcaatgatatataatctttttctaaaaatatgtctaaactaagcgattgggatagatcggacagtgagccgagacagtataaatcacttatgtttaaaagtactttaagacaaagattatatatatttatagcttagccaatgaggtaaatctaagatatatcggctaatactctgataccatctatactaagatattaaaacagacaaaatataccaaacaacaagcttaatatatttctaagcaataagatcttaatataaagggcaagtttagcatgtcaaacaaataaaacaactaaaccaggtaagatcggctgaaaccccgatactatctctatcaataatcatagaacaagttagatattataattctagatattacttaatagatcgaacctaaccgatgcagcattaagtacaaaaagaagcataagatctagacaaaccgatgaaaatctctttgagatggtagatatactatataaactagatcaacgttgatatctaaccctatcggccgccttcttattaatagatattaaccgatctagggttagatagcaatattgattgagattttatagcgtatatgataactcgacgattcacataaacaagattagagtatcatgaagatgtaagcactaatcccgagaacgcaagccgccatgacaagttttacctctcatcggagatcgaaaccgatgcagcccaactcgaaagcaagaactcgtcgaaatagtgaaagtagaaaagggtggcaatgcgccgaaagtgttattgaattgtttttgtcattatacatggtcttgggttatatttacacccaaaatacataatgtatccttgccggacacgactctaaatctgttacaaccgtaagatacggacaagtcttttaggcagactcttgccggtaaatatctctaaggaaactacccacaatatcctaattaatagatacaattgcctatccgtgagctcatctcaatcatggcaatacttgtgcagcacgtcgatcaatcccaaagatgattgtagagccaccttagcgagatcggctccatcggctatcctctatctgattgtcacgcccagaaattcccgaatagaattccaagcaaaatgtacattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaacagaaagtgaaagatttaaacagttgtaataattaattaacatcaactatccactgtccaacgctaacccatgttgcgacaggcccaaccatccacctaaactatccaaattaaaagattgcactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggaccctttgcataaccccctctagcaaagcacaccacacctcaggtttcacccccgtccccagcgggcaacgggcagtcccctctcgtgcctaggtgaatccggaagcgacagaggtcgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaacagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatatatgatcaatatgttcaagtgacaagcatgacttgccttgctctgctgctggaggaacctcggcgactatctcgaagtaccccggagcgtcggaggaatcggaatctagcgacatacaaagcaaacattgcaaacaggctataagactactgaaacagggaacaaaaccatttttaatggattctgcacagttttcttgatttactgagacttgaatgggcttaaacggagctcggatgaattagttatggattttagaagattcactgtgtttattactataacagaaatccttaaataatttattgcgcaatattttccagggctgacgtcagcacaggggaagcggcgccgacatgcggggcccaccggtcagcggctcgggagagggaggaaagggcaccggcacgcgggcccactggtcagcggctcgggaggaaaggggcggcggcacccggctcggcttggctcaaggccggccgaccggccgcggcgacggcgacggcgcgcgcgcgaacgcgttgccggcgacggcaaccggcggcgaaggcgacggcgcaaaaggcgacgcgaaggcggctgcgctaagtggcggctaggaaggggagggaacgggcggcgataaaggcggccgccggctcggctcggcatcaaagccgacctgccggccaggtctagcggcgacggcatgcggccgacgacggcggcgaccggcggcacggaaggcgccggtgacggccgaaggcgacggtgcgcaacttgaagcggcggcgcggcactaggaggagaggaaggggaaaagaggggagggatgcctcaccgagggtggccggcgcggaggaagacgatggcgaacggcgacggcaagccacgggaggatacggcaaccggcggacgagcttccgggtgccctaaggaaggagaagagagggattagatagagggagatgaaccacggcgaccggtattcacggccgaaagcggcggtagcggttgaactcaccgcagcgcgaggggaggcgaatttcggcgacgaaactcgacggggaaggggcggccggggtggagcttagccttgcgaacccgacggcgaagacggcgtggtgcggcggcgaccctagcggcggctaatggcggccggagtagcggaaacagcggcggcaagaggttgcacggcgcgggagcgatgggaggctcgggagaggtcggcgaaatggggaaaaagcgagagggggcgacggagaagattaaattgggagagagagaaccggacgtggccgggagaggcgggaatcgccggccgacgtggggagtgggggaggagagagaggcgggattcgaaaatcgaatcccggccatctcggacgcgggcgcgggcgggagagagaggggagtgggcgcgggagacgcggcgcaagcgcggacgtggtcgacgtggcccgaaggaggcggagacgtgggcgcggcagcggttgcgggcgcggtggcgcgccgggagcggcgggaggtgggggaaggacccgacaggtgggccccacctgtcggcgaccccgagagaggagggcggcggggcggcctggctgggcctcggcctgcggccggcccagcagggagggggggagaaaggagagaatgggccggcggcccattcgggaaaaaaaagaggaaaagagaggaaaaagaaaagaaaaaaaaagaaaaaggaaaaaggattttccctagaattaaaatattgcttgctcaattttaattggttaaaattatttctagagctctgaaaattccactaaaaatcctgttaatgaatttcgacatgtataactcaagaaaaattccacatgtcaaatccgattattatttgcattactttcttagggttttctcttgatttctcctgcattttcttggggtcgttttaaaaattaaattttaggcttgggaggagaacttcggggtgtgacaaacctaccccccctttaaacggaatctcggccccgagattcggaggagctgctgaagaggtgcggatgggcggctttcaactcatcttccctttcccaggttgcttcctcttctgaatgatgactccactgaactcggcaaaacctggtgaccttatttctggttcttctttcgctggtatcaagtatacgaaccggcttctccacatatgttaggtcctcctggatatcaatgtgctccgaatcagcctgttcttcaggtacccttaagcacttctttaattgggacacatggaacacgtcatgggtgccgatcatattggatggaagttctaactgataagcaacttctccccttcgttccaagattttgtatagtcccacgaagcgtggtgccaacttgcctttcgtctgaaaccagtgtactccccggagcggagtgacacgaagatacacgtaatctcctgcctcaaaagtgagctcccttcgacggttatccgcgtagctcttctgtcgagactgagcaatcctcaatctttccctgatgattctgactttctcttctgcttccgctaatacttctgttccgaacagttgacgttcgcctgtctgatcccagaagagaggtgtgcgacacttccggccgtataaagcttcaaacggtgccatctgtagactggcctggtagctgttgttgtacgagaattccgcatatggcaagcttttgtcccaagctccaccaaaatcaagagcacaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacaactacccagatcgattcgtgacccgatgatgtccggggcagtcctgttataaagtccattccaatctcctcccatttccattccgggatttgaagaggttgaagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcagttccttgtcgtcaggtacacacaatctttctcccaaccagattgtgccatgctcatcttcgtggaaatcccgggcttttccgacactcatgttctttttcagctctgctatttcagaatcatttgcttgagcgtaggccgtgcctccagagcggctacgaacccgagttcaacaattcccacgttgagatgctcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaagtcatgagttggataattcccttcgtgtggacgcaactgccgtgaggcatacgcaaccactctgccctcttgcattaggacacatccaagtccgtgacgggatgcatcacaatagacttggaagtctttcatcgggtcgggcagaatcaaaacgggtgcggatactaatttcttcttgagctcctcgaagctcttatcgcactcggctgtccatttaaacttctcatccttcttaagcaactgagtcatgggtcgggcgattctggagaaattttcgatgaatcgacggtaataaccttcaagtccaagaaaacttcgaatctacgacacggtcttcggtggggtccatttggtaactgactccacgttcgatgggtcgactgccacaccctgagctgtaatgacatggcccaaaaatttgacttccgtcaaccagaagtcacacttgctgaacttggcatatagctggtgctccctcaacttctcgagtaccagacggaaatgttgttcatgtttttcttcggactttgaatagataagaatgtcgtcgatgaacaccacaacaaacttgtccagaaattccatgaacactttgttcatcagattcatgaagaatgcgggtgcgttggtgagtccgaaagacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgtggtaatcaacgcacatcctcttcgtcttatcctttttctccacaaaaatgaccggagcacccaaaggtgaagtacttggtcgaatgtaccctttctgcagctgctcatcaacctgtttcttgacctctgctagttcgttggccgccatcctgtatggtctcttatagattggagcagttcccggtgccaagtcaatccggaattcaatctctctcttgggtggcatggtagtgaggtcttcggggaacacttctggatactcgcagactatgggtatatcttccaattttctcgagttcttctctacggtgtccactgggatttccgcttcaatctgattcaaagagacccctttctttggcgagactagagatttgtacaccacggtttctcccttctcgttgatcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcattggtgtgctaagttcctctcttattaacagatgcatcccgacaaatttctttgaaatgaaagaatgcgtcgcaccagaatcaaaaagtactgttgcagggattgagttaacagggaacgtacccagtacgacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtcttcttcttggcttgcgcgggcgggcctgactgtgccggtgccattggtgggcgtgaagctgcaccgcggttggactgacctccatggtggttctgactgccactggcgccctggggaaagttgctagggttgaacgggcggtgctgacgaacgatcatggtggtaggtccaccctgctgcccaggagcgaagcgcggcctctggtgacttccctgaggtgccctgaactgtgcggccttcctcttcctgtccatcttgttgcgttgatcctcctggcggattgccttgtcaaccaacctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactctgtcacagtcctgttgccctgatggagtgcccggaattccctcttcttttgtgccacgaccccgtctggcacctgcgccttccagaagctacggcagaactctgcccatgtgacttcagtacctggtgggcgggtggccatgtgattgtcccaccaagctgacgcgggaccctgaagctggtgtgtggcgaaagcgaccttctcctgatcattgcactgcaggcgattcagcttcttctctatggcatggagccagtcattcgcctccatggggttggtggtgcttgagaaggtgggtggcctgacgcgtagaaactctggcaacttggactgagggggagggggaccaaactgctggtgctgctgttcgacgtgctgcatcatcctctggtgcatctgctggtgctgctgctgcatctgctgcatcatggctgccatcatctgagtctgatgtgccataacttgggcaagggtcggattctcgggaagtggtggcggaccattgccggaatcactgctggggtgcacaccatcagcgcgttcttcgccgttgctgccctcgcctgttgcgcggctaccattcctggtgtagaccatctggagggaaaagcagacggggaaaagaagaaaaacagatgctcaggaactaagctttattacaaaggaattaaaactgcaattgttctgatctgaattaaaacacttaaagagcaagcaaaaatccttattaagacagccatatcataggcacatgatatcgactgtcgactaaccccaaacaagcaacctaaacacacaaattaacaagcagaagctagacagtcgataaactaatggaaaacgagcctaatgctcggaacggctcctgcggtcggtggagtcgaagacgtcctcctgctcgtcaccaagtccctctgagcgactcccggagcctggcagataagtctcgccactgcctgactctgagccactgggagtagcagacaaccaacctccattgccactggctggacccctggcggctgatgcgggagcgaaggagagagcggacgcaggagctggagctgcaggaactgccggagctgcgggcggaactggaggtgctgcgggagctgcggatggaggtgggttcctgggcgcaagctggatgcgcacgggtgccgtcgtcgtcttgcggggcgtagtgcggatccggactcctcctggcgctggaagaccctttagctgagcgttctccctcttcaggcgcgctatcttgtccttcagagcgacgatcctcatgagcttcccatcgttcaaggccttggtcgccttgtgcaggtctgagtgcatcctgtccaatcccctcatcacagcacacatgtgaccaaaggtggtgtcgttctcgccagctgtcggatggaaggagctgacgtcatcaccgttggctcgacgggggtggaagcggtacgccgtgtcgtggaagatgtagttgtggcactcccgtagtctggccatcatcaagtaggctgcctcctgacaggcgtgatctgctgtgcctccagatgcctcgaccaccatgttagctaggcaggtacccacgtagccgtggacctccaagcgaacacggtgaggaagctcgccactgagcggtggaatcgtcgtatactctggcgcgttggggtagcccaccaccaatgtcatgcgtgccaactctgccacaaagtcgatcatgccttctccgcggtggttgggtgggtggccggccatctagagaagacagaggagtaggatcaatgcatgctcaaatccaagtttaaataaagcaataaaagactcaaataagagaatcgaatgaaagcgaaatttttatgcatagatcattttgcatgagagcgaataaataagacagactcacataacgataaaataatgagaaattagatacatactaataataacaaataaagcataaataccttgcaacccatgttcctgagctaggacctaatgcatttcacccatcaaatcccaactgactgacgaataaatctcaacagttttactaaaaccctggactgacttgttttgacaaatctcactttaaacgagcgaccaagatttttcccttgaaccacaaaaactgatcccaattttcccggaataaaatccaattgcaaggaacatatgcaatgaaaaggattcagagggctcttaggtttttccatttggcttgtcctacggtcaatgtcggatctgataccaacttgtcacgcccagaaattcccgaatagaattccaagcaaaatgtgcattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaacagaaagtgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggaccctttgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaactgatagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatataggatcaacatgttcaagtgacaagcatgacttgccttgctctgctgctggaggaacctcggcgactatctcgaagtaccccggagcgtcggaggaatcggaatctagcgacatacaaagcaaacattgcaaacaggctataagactactgaaacagggaacaaaaccatttttaatggattctgcacagttttcttgatttactgagacttgaatgggcttaaacggagctcggatgaattagttatggattttagaagattcactgtgtttattactataacagaaatccttaaataatttattgcgcaatattttccagggctgacgtcagcacaggggaagcggcgccgacatgcggggcccaccggtcagcggctcgggagagggaggaaagggcgccggcacgcgggcccactggtcagcggctcgggaggaaaggggcggcggcacccggctcggcttggctcaaggccggccgaccggccgcggcgacggcgacggcgcgcgcgcgaacgcattgccggcgacggcaaccggcggcgaaggcgacggcgcaaaaggcgacgcgaaggcggctgcgctaagtggcggctaggaaggggaggatacggcaaccggcggacgagcttccgggtgccctaaggaaggagaagagagggattagatagagggagatgaaccacggcgaccggtattcacggccgaaagcggcggtagcggttgaactcaccggagcgcgaggggaggcgaatttcctcgactaaaacttacggggaagggggcggccggggtggaacttaaccttctgaacctcacgtcgagaccgtgtggtgcgtcggcgaccctatcggtggcttatggcggccgaagtaccggaaacaaggtcgtccagaagttccaccggcccgttacctattgggaagttcttgaaaaggtctcccaaaattggaaataagccatagggcgtcn

SEQ ID NO: 18338 - DNA, 27770 bp, Oryza sativa
  unsure (1)..(27770): unsure at all n locations
aaaaggaaaagaaaaaaagaanaaaggganaagggattttccctggaattaaaatattgcttgctaaattttaattggtgaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttaaaaattaaattttaggcttgggaggagaacttcggggtgtgacactgatccatcattagccgatgcagtcacttagctgatgcctttcgtagctgatgcgtactctgtttctgagaaacgatcctccgccaaatccgattcgattttgatgcatgtcctaccaaatttggtcatcaacagcagagctttcttccagagtaattcggatcattaccactcctcgaaccattccatgttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaggatgtgcccatcattcatgacgacaaagaggcaatcttgaaatcatgtctttgaaatccatgaaattgatgttctaatcaggcatcccatcgagaaacttcttatcaacaccctcgattaggcagcctcaaattctctttaggagggaatgagttttcaatcccattcaagcaatcaaggttcgccttgactgactccattcctgaagatgaatatgcggaggaagtaacggttgttctaccatctgagtcccctgaaccatgtcttgagaatgatgtcccagacttctgttgatgcgaaaaacacacactggcctgagaaatttgctttactctagtgcaggttcaaagatttgctttcgggtttaggtcgtgccagttggtttgatcctgcaaccaacaagaaacaaagaatccaaagttaaatctataaacgatagccgatcggctggattgccgatgacgtatcgtttaacactggaccaatgtaacatggatcagatcagcagtgaaatatataataatgaaagaattagatctactcgatcggctgtagatatcaataatatataatcaatgcttcgaaaatatatttaaactaagtgattgggatagatcggacagcatgccgagacagtataaatcacttatgtctaaaactacttcagagcaaagattatatatattcatagcatagccgataggataaatctaatatgtatcggctagtactctgataccactttgtactaagatatcaatatagattcaatataccaaacagaaatcaatctaacatcgggataacttaaaaggttgataacaagtttaatatattttatccaagtgagatcttaatataaatggtagatttagtatagcaagttaacatatatgaaacaaaataactaaatcaggtaagatcggctgaaaccctgatactatctctattgaaaatcataaaacaagtgtaacataccaggaatttcacctagggaaaattttttgtggaaaatttaaaactttctgaattctaaagttttcggtgaacatagaagcatactagagcatataactcccttaaataaaataaacacatagtctagttgggaaaaatcaaaccaaagaccaaaataaaagtttacaaatcttgtggtaataaatttcaaaataaaatattttgctttgaccttaaactggaaacctaatcttcttggttttgaattgctaacctaactaaaaataattaagtcatatataaaacaaatggaaaggtaggtttcaaaataagcacatctgaattgagataaaatgaacttgcttggttgtgcatattattgttttaagattgtttttggatcttcttggtgcatctcataatagattgcatatgcatgtcatgtctaaagaaaattcttaaaaatagatgaatcaacaattaatcccacaaaaattctcataaatactacacaacaccctaatctcccagtaattttagtttgaatttatcacatcaactagtaccacaaataaattcttcaactcagcaataaatctgaaaccagcataccaattagcctactttgcataatcatcaaattttaaccataacttatttatcaaagccccttgtcagaatgttaattatacattactctacaacctgatgcaatggcttcgtctaattcgaaatataaccaaaggaattgagagccaaaagttaggtaaacagtattctaaaatgcaatcaacaatccacctagtcaactttactaaattactatggtaaaagcaaaagtaattaaatcttggaacttggcacatttgatacatcacatacttgtctagctttctgtctccttgtcccccccttaattaaaaattgaatggatgggaggatgagagtaatctagtaaaatgaaatagtgccaacacttgggaaaatttagagcttctagttctctctttctacatctctcccttacatgtgggaccaagtccttgcggggcccactcatcatacaatcacagccaacacatcatctactcttcactcttttaaatcttcttttttttctcaaaaggtgagagaagggtttaaaatcaattttcacttaaagtaccaccttacgtctcgtacatttctaggaaatcacttcatagggcccaattgtcatttacatcacagccacaacatctcttcacctctctttgtttatgtgattaaataccatgaagggggagaaaagtagtccgaaggagtagttgctaatttctatttgatggtagtttaccctagttttctagggtttcttttttcctcaggcggcgcccccgtctgagttctatcgttcaaaacaatctggtgtaaggtgttttctccttctcgcgaagtgagagatcgttaaacccttcgctgagaaagttttctcggggatcaaggtagtatggcagatactcgatcatctgccgaggatgaaaccaagcgccctacggaggaggagactgggcgtgatggagagatgggatccgaaccaaatctggaagagagattgaagaggttgaatatgcatggggaggaggaaactgacctagatttctcggaggaattggaagggctgatcaaggacgtacgctggctcgctctttttagggtttatactacaaaaccctttagccactcagcgctgttgaatgctatgagaaacgcctggtcttcggcacaggatatctcgtttaaggtaatggattcaaatctctttatggtacaatttcaatgccttggtgattggaacagagtcatggaaggaggtccatggatctttagaggagctcctgtagtccttaaagaatatgatggcttcactaatgtgtttgattataagttggataaaattccagtttggacgcgcattcatggggtgcctgatgggttgatgaagaagagagaactagcagagagggttgctaagaaggttggtgaacaaccattcacagttatagtagatgaggggagaatcaatcctgttaaatacctcagagctagggttttcttagatttgagtaaacccctcgtgcggtttgtcccaatcacgatcaaggaaagaatattgtatccagtaacttatgaaaggatgccaacgttctgttacttctgtggaatgattggatgagcaaaaagagattttgttacgcattgaactcattctagagcaagaggaaatctactggattcagagagcgagagcaaattggttgaaacatggtgaccgtaacaccagtttctttcaacaatttgctgcacagagaagaagaagaaagaaaattaagggacttattgatgagaatggatgttttcaaaccgatgaagacagaatgagtaacatagtttatgggtacttccaaaatctcttctcggctgaggttacacaaatagatggatcttctttgctggatgtacagagaaaagtaacgggagatatgaattttggattactagcaccgtatacagctgaagaggtgaaaaatgctctgttcagtataggtgatctgaaagctccgggaccagatgggctgcacgctgttttctataaaagattctgggatatgttggagagtgatctggttaaagaagttcttgatgcaataaatacaatgaaaattccagatggatggaatgacacaactgttgtcatgattccaaaggttgataaaccagacagagtaactcaatttagacccattagcttatgtaatgtggtctataaaataatttctaagatgttagcaaaccggctaaagtgtcttctccctgaaataataagtgatcagcagagtgcttttgtcccgggcaggttgatcacggataatgttttggtagcttatgagtgcttacacacaatgaaaaagaagaaaggaagaaaaggtctgtgtgcagtgaagctagatatgcacaaagcatatgatcgggttgaatggatgtacctggaacaaatcatgttgaaattaggctttgatagccgctgggttcagttaataatgtcttgtgtttcttcagttcagtacagggtgaatttcaatggtgtattgacagaggttattaagccttctcgaggcttaaggcagggggatcccttatccccatacctttttttgcttgttgctgagggtctatcgagtatgctgcaaggagctgaaaatagaggagacttagtgggaatcagagtgtgtcgtgaagcaccgatgatatcacacttgttatttgcggatgattctctaatattgatgcaagcagacaagaataatgctgatcatctgaaagcaattttggatatttactgtcaaaattctggacagaaaatcagtgaagcgaagtcgagtattttcttcagtagaaatactgcagtcgaagataaagctgctgtctgtggatctctagatattatgactgaagctttaaacgacaaatatcttggactcccagcgatgataggtgttgataagagtgattgttttcgacacctgattgatagagtcaacaaccggataaatggacggaaggagaagatgttgagtacaggggggaaggaagtgcttataaaatcaatcgctcaggctataccagtttttgcgatgtctgttttcaggataccgaaaaaaatatgtgactgtatctctgaagcaatcgcgcgattctggtggggtgatgatgaaaatcacagaagaatacattggaaggcttggtggaggatgtgcattccaaaacaaagaggtggtctgggttttagggacttatattgttttaatcgagcgatgcttgctaaacagatatggagattcctgtgtgatcctgactcactgtgtgcaagggtaatgcgatgcaaatactatccggatggaaatattttgagggcaagaccgaaaaagggtagttcttatgcttggcaaagcattctatctggttcggaatgctttaaaggctacatatggagaattggagatggatcccaagttaatatatgggaagatagtttgataccttcaagcagtaatgggaaggttttaacacctcgaggaaggaacattatcacaaaagttgaagaactgatcaatccagtaagtggtggatgggatgaagacctgatagataccttgttctggcctattgatgctaaccgaattctacaaatccctatttcagccgggagagaggattttgttgcttggcatcacactcggtcaggaattttttcagttcggtctgcttaccattgtcagtggaatgcaaagtttgggagcaaggagagactgcctgatggtgcaagtagctcgagcaggccggtctgggacaacctgtggaaactggaaattccacccaagataaaaatctttgcatggagaatgttgcatggtgtgattccctgtaaaggcatcttagctgacaaacacattgcagtccaaggtggttgtccggtttgttcttcaggagttgaagatatcaagcatatggtttttacttgtagaagagcaaagttgatttggaagcagctaggcatatggagcagaatacaaccgattctgggtttcgaccggtcaggatcagttctggtggaggagatgataaggaagggtgggaaggtttcgcatctgaatgctattggaatgacggaattgatcttaacgggagcttggtatatttggtgggagagaagacagttggtgcagggggaacgaatacagaaccctgctcggtcggcaatgtctattgctaccttaaccacaaactatatgttgtcaaataagaaaggtaaaacaaaaattcagaacggttggaagaaacctcctgaaggaatgctaatgatcaatgttgatgctgccttcgattttgattcaggaagtggaggtattggggtggtgttgagagatcacttgggagcttgtgttgcggcttcgcaagcttttcttccacatgtccttgatgcaccgatggcagaggcttttgcgctgagagatgggctgtccctggcacaacacattggtgctaaaaatgttatagtacaaactgattgtatgcaggtggtttcaacgatgatggatggaggattttctgctacagcggctatgtctgtgtttgatgattgcaagctgatgtgggatgggtttggtacaatttctattgagcactgtaatagaaactccaatcaggtggctcatgaactggccaggttagcgtttaagacaaaaaattcttgtacttgggtcgatgaaccccctggctgtgttctgaaccatctggtaaatgatgtaacaattttatcctatcaataaagctagccgaatggcattcccccaaaaaaaaatataccatgaagggggagagagagggaaaaaaggttccaatatccatttctcacccaattcctccctccaccctatctttcatctaggaaacatctccatggaccacttgacagccattatagctagtttgggtgatgtaggtgaggttgcaacgccctaaactcagccaccatcttaaaaacgtgtatattccatattgacacctagcatgtcattgtcttcactttcaccatttagtgagccacttcgccactgaattcatctatcatcctaatcttgttccatagaaataaacttcaagaactcccatgtattgccaagaatgttctcttctttctttccatcgaagatgtttgatcggtcgcaaatcttctctggtgagcttcgccgcattccaaccatggaaatgtgattcaattcccctacctgatcaatcatgtctcttaacaccttgtgccaagctcgacgccgctctcagtgtccagagcgccgccgtcggccacttcgccgttccggtcgactcgagcctccgctgaccaagccattgcgccaccgacgtcgcctaggtccctggagaaggacgcgtaaagaagatcgagctaaaacgccgccgttgaggagatcgaactcttcttccccaagtccggccgccggccatcgtcgtcaattccccgctcccgggtgagcttcggcgctattcctcgcatatgaagcatccttaggtgatctttgatccatttcccttctcttcttggcagcccaaagaccggaggaagccgacgccgtcgtaccgccgttttccgccgccaccggagcgttcctcggttcaccgtcgtcgtccaagcttcgtcggtgtacgtgcgactcaagtgagtcttcaggagtcccgtagaggcacatgcatgcacacatttggcacaaatcgagccgtagctctaaatggcgcatcaccccgaagcacaccgccgctcgcgctgccgccgtcgttgactccagccaccacagcccgcgataccaccgccattagtttcgccatcttccactctacattttctcttttggctgcatcgtgaggacggccaccgttcgtcgccggcgccggcgagaagctcgccggggcgccacagccctgtcctcctccacctagtgtcactgacaagcgggacccacttcattgggtgctaagaatttgattagtatgagtttaaatcttgtaggattttatttctaaatgttctctgcatgacatgttgacccaggacctattagtaaaagtataaaacttggagcactctttatgaagatagtattaaacatgtgataaggacttcggcctatattcctagaaacctcagggacttttctgcatatttactctcactcaccagtggaccccattttttaaaatctggaaaataataaaagaaatacccaaacaaatatatgtttaacagaaaaatgcacaaacttggcacatgtagtacaattttgaggtaattccagttgctatagattcacaaagatatgaaatttaatataaaaacctaaaacttggcacacgtagtacaatttttgcctctaaaattcatctaatataaatcacacataaagcttgctcaaacttagaaaattcatataaacttcattttaactcattttggagtgaacaaagttccagtgtgctcataaaaccatactcttaattttcatgaactaaaacttaataccttctgtaataaaaacatcaccaaataattaattagtaaaataactggtatagtgcaaactagaaactacaaaatccataagtaatttgttttaactccaattgagacaaactaaaatttcttagtttgataaaagaatgtatattagttctgtaaacaaatctatagaagaatccatatccgaaaacattactaaaatttgaataatgaattaatattaagaaacttctaaaaattcatatcaaatttaatacaactccaaatgaggtgatttcagatttgttagattagcaaaatcttggacattagtttttataaaataaaatatagcacttacagtacccaaaacatatctaaaatgcgaaataactaataactactatagtatatcacttagcttgtaaaatttataataaaaacattctaactctacaaattgtgaaaccaattttgttgaaatcctgagaatatccttttcactgcagtaacccagcatttcataaaacttagacctaaaatgcatctatgtactattagagcttaattaatctagtgctagtattaaactttgaaaattaataactcccaaatgcaaagtgataaaatataaattccttcaccacaaatcttacccacacagcacctaatcacactagtaaactcatgcattttagagcattttgaattattgcatgttttggtatttatcgttacttttatttcttttagacggcgaaatcgttaccggtgaaggagatggattatagctaaactcagttaggtcatatatattctaaggcaagttttgcccttccttgaatcctatgttttcgggctaaatgctttgattataaagctgcacgtgtatttttgattataaacatgcatgaaaccccttttgaaaatcaccccttgctgttttgaaccttaggatttatgagagtactttaattgtgctcatataagtatactatacttttacaaaatgcaaatgcttagcctagcttagtaataaataaaaacatggttatggatcacttattatacttttgaaaacccttttgaactttatggacagaggtgattctctgattatttgtgaaataaaatgagataaaatatgattttagacttgggcgggaagtggtatgcatatgtgatgtgaccatggctactatggatacaaccaccactcacatcatggatgaacaacaaaatatcaagatcaagtcctccaagtgctggaatccgattcgtacaactgctacactgctgacttcaaacggccaccgaatctgtatacgacctccgtttttgccccgtgagtacttgatggaaagctctcggagtcctctttccaatggatccagcctcattaccaaattccatctcagtcggcagcaattgaagaaacaagttggtgcgacacctgtaatgggcctatgggcttgtaacttcatataggacgccggcccaagtgatgcccatctggggtgcaccccaatctagtggagcacgaccctaggagcctcttggtcgtcctcccacctctttaaattgctaggtaccccttcagggtttctcgggttttgttagattaaagtttaaccattgctacttgcttgtagcgtgcatgtcggctacaccgtccgtctgcttgttcttcagaatcccatcttatcatttgtattcaattactatttgcaatatcagattgcttttatcttgttctttcttgtttcttcgatttgcttgcaggaatagggttgatttgcaccggcaagatcaacaacccacggagaggtgtatcgatcactaaagcgcaacgcaacgtcttgtatggttgtagtcgggtcgtcaacttttctcccaaatcgtagttatctcaactcaccaaaagatcgggccaacaacagccataagtgtcgagtggaactcagggttcatcaggtggtatcagagctttcgttgcccggtgagtttttatctacctataaccggaaaattgccatacaaaaaaaattgcatcctgtacctagctatatttgtgccatttcattgttctttcagtttttgctttgttgagttttgtgttgcatcgttgcgttgagttgctggtcttagcgtctagttcgtttagagtttcgagttcttggcaggtctactaccactgtcgtcgcttgccgccgtcatctttgttgtcgtcgggacctacgaaaacggaatcgtctttccgtcaaggttctatttttgtagttttcaaaagtttctactcatcggttttggagttgttgagttgcaattagggattgccagcttggccatgtttctattttggccgtgcttgtgtcgcgcacgagaggaggaaggtgaattaccaaatctgattttggaagtagtcaagtttgttttggaaagatatagtagattggattggctggaaatcagtttcccttttagattgcaccaaatccgaactctaattgcggccgtatccatctactccatctaaccaccgtaccttccacctcctcacggttgtaccggagttgctacacaccttgatgaaaattttttcggtgtcagattcaagatctgtttgcataaacagcactggcataaattcaacattccattttttttttgtataatttcaatttttaggttcggacttttacatttgagtccctgtaattttatctttacatttgaatccctataatgttgcatccgggtccttgagtcggtttttgttaaaaaaaatcagaaaaaaggagagaagaaaagacagaaaggtgcataaaaaaagaaaaagaaaagccgcaccaaaaaaagaaaagaaagaaagaaagaaaagaaaaaaaaagaaagaaagaaagaaagaagggaaactaaaaaaatcagttgtatctttgagtttggtttcatatatcagagtgtgcttaagttgtttctggtgttatcttgtggtatcgtttgtgtctaggctcgcgtctctagtacgttctagcctaggaccagcactgtagttgatttattcaactttgcattctctgatttgagtatttgctattcctttgctacatatttaagcctaccccgagctccacagatttgattgcagccgtacagcaagtgtttgccaaggcatcgatacatctaacctccattggggtgcttggttgtgtcggtgtatgtcgccaccattctgcttgcattggtaagatcttgtaagagcttggttaaatgtttgagtgtgtgtgatatttaagcttccactacctagtagtttaataggaacatgtatatttttgtgtatgtttcttgctttctactaacaatggcagggatacgcaagaaaacttgggataattgtgctgaacatgaacatcttcgtcgagtgatgaggaatgatcaacatgaccaatatgaggtaagtgatgttgttctaggtaagatcaaatctgcactaccttattttgaaggaaattatgatcctcgtgcttacattgattgggagctagcggttgatagagaatttaggaagcatgaattgtctgagaaacatatggttatgtatgcctctagtgttttaattaatcaagcttctaatgattggaaacatctttgtaggcataataaaataccacaatcttgtaaagacctgaaacgatatatgagagatgtttatgttcccatgtattatgctgacattttgctcaataaactggaatgtttaaaacaagataatagaactgttacttcatactatcatgatatggatgcttgtttattacgttgtggttgagatgaatgcgaagaagttatagaatcgaggtttttacgtgggcttaaaaaaaattcaggatatgctggcttgtcaaagatatagaactctttctcatttgttacaacttgcttgcaatgctgaaagtaaactagaggaggacatgaaaaagcaacacgatatctttttgcctcctattactaactatttgcaagaagtgcataatcacggaaaagaagagagagacatgaaaaagccgtcgttcccattgttcacactcaaattcgatgcacctccgtcatcagaagagcgaatcacaggtaatctaaatggtgccgtaattaatcaaggtgagtgtgccgttaatgaattgaatatgtctacttttcatgctatagtagagcaaccattattggaaccaattgttgaaatgcctttgtcacaagttgatttactggctgttccttgtgataaagaagagttgtgtgataatgtttcacttatattcgtgccacaactagtgaatgaacatgctatttctaatgtcagttctaatgaagtagtggaacgtaaattgacatcttctttaaatactttgggctatattcagtgtgatgatttttgtgagctcgatagtttgaaggagaaattatttgctaaataatatttgccctgtccaactaatgctatttttcatatctttggtgaatataatgatagagaaatatatttggtgcatagaggttatatatgttcggatttagtacctcctgtacatgtggataaaatttgcaagctagagagacatgttatttctaatcatattacttcgagtttctcttcttttgattggatgaaacaggttgttttaaatcgaccacgcgatgagcaccatatggaaaaaccgatgacagttttccatgaagaaggggaggatgatgtgaccatggctactacggatacaaccattgctcatatcatggatgaacaacaagatatcaagattaagtcctccaagtgctggaatccgattcggccacctgctacactactgactttaaacagccaccaaatctgcgtacgaccttcgtttttggcctgtgagtacttgatggaaagctctcgaagtcctctttccaatggatccagcctcattaccaaattgcatctccgtcggcagcaattgaagaaacaaggtggtgcgacacctgtaatgggtctatgggcttgtaactttgtctgggacccaggcccatgtggggtgctccccaatctagtggagcacgaccctaggagcctcttggtcgtcctcccacctctttaaattacaaggtaccccttcagggtttctcgggttttgttagattaaagttttgccattgctacttgcttgcagcgcgcgtgttggctacaccgtcagtctacttgttcttcggaaccccaacttatcatttgtattcaattcctatttgtaatatcagattgcttttatcttgttcttgcttgtttcttcgatttgcttgcaggattaggcttgatttgcaccggcaagatcaccaacccacggagaggtgtatcgatcgctaaggcgcaacgtaacgtcttgtatggttattgtcaggtcgtcaatgtttctcccaaatcgtagttatctcaactcaccgaaagatagggccaacaacaaccttgagtgtcgagtggaactcagggtttgtcaatatgatagtagttgcataccaatagggggagtgttcgcctaagtcgattaaggaccaaacttcatatcatccattatgtttaccgtacatccacatgcgttttgatgggggaaccttggcctattaagttaagtatttgcctaatcttgcattcgggaggccgttgtagtataggtaggggccacgagtatactatgggctacctagaggaactacccatgtgtgtgttgaattttaggacgagtgtactgttcctaagtgtgtgatttccgtgaggggacgagtgtaatgttccgccttacagcatgggcgtctaagtctgtccaatacaacgatattgtgccacgtggagggttcgcgttgtgttcgccacctcggtgttatgtttaaggcgtgagcccgccacttaatggttctaggtcatataacgtatatggcctaggatggaggaacacgtatcgtgctcatgcaaggttagacaacgcttaatgtaaaagccttgttatgagctctaaaacgcactcaatgtgtagagtgtggtagtgctttggccagcacaagtcaaactagagtgttcatatcatgtaggtaaagctgtacaaactctgcagagttctaaaaactaatcgattagccatgctcacagtcatgagcgacatgatgatgtgctatgggtataatcttgtgttttctaaatgcttttgaaactaaattttttgagatgatgatgagattggtatatatgatatgattgccttacttcccattgagttttaagggaatgatgtctatctacttatgttgaccatgccatgattgttatgctttacattttactaacatgttttgcttaaattacgttgcaaatggtttgtgaactaaaatttgctttatgctaaaaattgagatcacaaaaagccttcatttgacttagagctttcatgtatgtaggtttgatagtgctcttgccagtacattaatttgattaatgtattgagtcatgccatattttgtctaatttatgttttgcagggaatagacttagtttaatttgagtgatgcgggtttcgattgcttcttctaggatttgaacttaatggggtaaacccctagtctgttcttgtgtttgggtagtcaagcttccgctgttatctgatataattatatttggccagttggcccttgtaactattaataattgtaatttcaaattattttgctatgtatctccatgcttaagatgaaagtgtgaatctagtgcacatcctgggaactagaattcacatgagtatgagttaaaaatatttgagatgttgttgatctttagtcattttgtcaagtctcctgaatgtgtaacacatttggtcgccgcctttgagtgatttgacggcacatctcaggctgaagttgactggcaggctaaagacccagcaatgtctccaatatttttctctctaggtgtcggatatttcattatgtttgtttgatgacttgaattatttagttcatccttcaaatataatgagtggtccggagagcttacgacaacaagctagatatttgttgatatgaaaaacacacactggccagggagatctgcttagctccagtgcaggtccaaaggttgatgatatgcgagcgtgccagctagtttgatcctgcaactagcaagatatgtaaacaacagatcaaatagccaatcggctgtcaagccgatggagtaattctagccgatagccgatattagccgatgccagcccgatgccgatagggttttgagcaatcggctaaatcggctgatgacaataaaatgtagtaataatataatccaatagataccaatcgtctaataataatatgataggatatgtacaaattcgaaggttaaagtatacatcgactgaaggtccgatgccataaaatccaaacgattagataaacagtgaaacctttgttgcaatcggctaaatccaacttgtatgtaatccttgtaagacgatgcgatgtctagataatttatcagctagcaccccaataaaacattagcgtgaacctatcgccttaacaagatttatattatcaacaacaatctagaaggtagaacctaaccgatgctgcacgagattgtatatgatagtctaatactcgatgagccgatagatctgtctaatgtgatagatataacaaatctatctagaacaacattgtgattatagagatatatcggctaggacagaagatcagacctaaccgagacagtcccaactaaaccgatgcgtctctaaacacaatgcaattagagatagaattgagatatcaggtaggcaaatatatcaaccaaaccagagcgatccaagagattgaagcgatgcagccttgaacaacaccaacgtagtcgatagatatacgagggccggcggaacgtaggacttaccccttcgtcggagatcgaacttaccccttcctaggtgccgaattccgccagatgataagtaaaaacttcgggaaagagggtggcgatgcgtaaagagtagtattcatcgagagatattttacaatgaccccgggtgtacatatttatacccatgggtagatactagtccttgtaggacaagaaaaaaaattttcttaagagaaaaggaaaacataaagtccttataggacataaacacactttcctaaagataaaagtaaacaaacaaactattcctaattaatagataacttgtcatgctgcatccctcttgaattcggtcacatttggataagcttcatttaatagattaatttccttaaccgattatagcaggaatccgactattggcgacgtgataattctcataggggcttaccaaatttcaccgttaacaatattatggttctagatattacttagtagatcaaattaacttaactgatacagcattaagtataaagagaaacataagaactaaacaagtcattgagagtcttcttgagatggtagatatactatataatttaattcaattatcagtatctaatcctattggctgttttcgatgatagaggctagccgatgatgttagatagcaagatcggtctagattatatagtatatatgataactcgacaatttacaaagacatgattagagtgccataaagatgtaagcattaatcccaagaatgcaaaccgccataacaagctttaacttttcgtcggagatcgaacccgatgcagcccaactcgaaagcaacaactcgtcgaaacaatgaaaatagaaaagggtggtgatacgctgaaagtgttattgaactaaagttaattgtttacaaggtatcgggtcatatttatacccaaaatacataatgtgtccttgccggacacgactccacttctattacaactcttaggcggactcttactgaaaatatctataaagaaactactaaaatatcctaatagataacaattgccttcctcggactcaatccatgcttggcaatacttgtgcaacaccccagtcaatcccgacaatgattctagaatcatcttgccgaaatcggctccatcgacttctccctaaccgattcggtattagccgatacagatggtagtcgatgtaaactttagccggcgcttaactttaatcctaatgaggtacttcaggcactagccagctccctactcccagatatcgctctactgcgcacccggacagggaggacttcagtgtcttgagggctgtcaccacctttacctagacaccacacctaagcagattaattacttactttaatgttagctacacactaaagcaatcactatattttatttgattattgtgaacgacgatccagcactctaaataggaactaactaagagataattctcaccgagcaaaactaaattgctcaaaagataactctattataatcagagtaattaatagagtaggaataaagagggagaggattaccgacaactccggaattcctccgacttcttctactctactcttttcctattctagtatacaatataatataatagagcctcttataattcagctcaagcttggagtgtgtgtgaagtgaaaaggcgaggtctttatataggggcaggcatgacggtcatagaacgcgaaaagtccattttgcccaacaaccgccattcaggagcttatccagaccgtccacgcaaaacccttgatcggacggctgcaggggtggttcggccaaacccatggctggcccaacaggcttcaactttggcctgttgctcctccatttctacgagtggaaggcccatttgaagatgttttctcgtagtttctggcccactcattatatggataggaattctccttcacttaagtctatattccatccaactttggtggtttattatctgcattcaaatatacaccaacacttgtggaatatgttagaattaaaccctattactatgttggacgttttatttctttgatttatgcaggtattggcggcataaaatttgtcattaacagccaccaacaaaccccccacacttagctctttactcgtcccgaataaaggttagagctaaagttgagaataaaattctccgagatatagtacaagcacataatttattcaagaccagtctcatacctatgaacttcatcggtggctaacttaccatcttgggcgattgaaagaaggaatagtcttgaatctggtccttctcaaactccatctcagacttttggggttttataaattttcgcaaatcagctttatctcctcataatgactcatcctcgatcactcaaatattttgtgctgtttgtgcatcctcaccaaggcatatgctgccgaaattattccctaatctaaaggctgtatatgtggagtttgctagggataactcgggacatacatgcatcatatatattgcaaaaccaaatatatggactcaagaagataatcgatcatactctcggatcaaggattgcataattttttgggtggaaagtgtatgatatgtgtagaaaagatcggaaataaagaaaatgcttctcctttgtctatacattcttctccagttttctcctttataattgtagagggggcatggctattttttttctttttctctctgtttttttttttcaaattgctccacattttagaaaagtattatattttttatagccacgcctttccctacttttatttttctttttcaaggatttttcttaggagaagaaggcataaactaaatggagaatttattcatcaactatatttttcttttttcggtggtagtggaaatggatgaaatgatgctaagttccagagtagaaacttagcataatggttgtgcaaccttgattgagagagcatgagagacatctaacacgagtcactataatttggtaaagctcaatataatgaaaggcagtcatacacattgtcgacgggggatacccgtagaccggatatagagggtattggggttcgttggtacgaggatctacatagtacgatatcaagcaaacaaaagacaagggtcatactagtttaggccccttagtaggtaatagccctaatccagttgatatgggattatatgatggaaaccacagattacaaagggaataacagaacttaatgataccgatgagaccgtagttgagttggttcgactagatcttccggcgacttggctcctgtaggctccgacttcgtaggctgtggtggatgtgtaggcggtaatattcgatgccttaggtcctacccggggggtcccttatataccgcgggccagttgatctccaggtgggactcggagatatcggacccctcgcgatatggaaaagacccagtattatccgagtagaacttcttccgtctatagataccatatctaccacgtgacatatttccttaatgtatacggaaactatccgtatacgcgtgggtacaccgtgtcagtatacaacgaacatccaaggatagagggtataccttatccgtaaccctgacagtagcccccgacttctgcttaaatgaactcatgttatcgatcacgacttctgatgtcggaattgttgtcgctctcatctggtcgatctcggtgtgaaaaccgtagagacaaaagccatcgacaacaccgcgtgaagttcaacggtcatgagtgaatttaaattgaagtctgaaaactaccgcgcgcaacggacccagaattttccggcggcaaactctctcctttccttggaatacgcgccgtcggtagtgcgcttatttgaagggattttgggaattcatttaaagtccgtttgccagaaaacactcttgccttctagcgcccttcgtcttctccgctctctgcaaagaaaaccctagcttccttctttcctcttgttctccggcgatcctctggcggcgatggatcttgagaagtctacctcaaccaccgggtccttgaagaagctgcaagacgacggtgccctccctggtcgcaggaccatgcagagggaggcatgaggttaagaacctaaacccatcttgggccgcatggttgtagtcgaggattacatttcttgcggttttctttcttcgcctttcaagtttcttcttcttggcctgaatttctatggcctttctttgccccacttgaaccccaactctatcggctttctgagtgccttctctcacctttgcgaggcctacattggggtagagccctttcttgacctcttctgtttttactatgagctgcttgatggaatctagcagggtatctggatgtgttggattctgacttcgggatagcttgaagtcgcgttacatccccttccagtgcccctcttctcgcagcaagtggtggacgagatggttctaccttcaaatagagaactcggatcccgtccttgttgtccctgaaggtcagccagaaaaaatcccggagtaggccgccaaacccgccctaactcnnnnnnnnnnnnnnnnnnnnnnnnnnnctccgagaacgggggttgtcggggtacgaagtcgctgccgacttcataggtaggtggattcaaccgctgtaggcccacaaaggggggattattcagagcaggctcaatggacaatggggatggaatagctgttggatggttaggacatcctatctttagagataaagaagggcgcgaactttttgtacgccgtatgcctacttttttttgaaacatttccggttgttttggtagatgaagagggaattgtgagagcggacgttccttttatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaatgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataaaaaattttgtcgttgtttagtaatagcttctttttcactccacaaggatcaagatcaaatgaatacttattccttttctgttgacggaaggtatatctttggcctctcgatggctgatgatgaggtaagacatagactgttggatacttttggtaaaaaagatagggaaattcttgattattcaatgccggatcgaatcatgtccaatggtcattggaattttgtctatccttctattcttcaaaataatttggatttgttagcaaaaaagcgaagaaataggttcgccattccattatagtatcatcaagaacaagagaaagaaccaatatcctgttttgggatttcgattgaaataccctttatgggtgttttacgtagaaatactatagttgcttattttgacgacccacgatacaaaaaagataaaaatggttcaggaattgttaaatttagatataggaccctagaggacgaatatagactcgagagaaagactcagagaacgaatacgggagcccagaaaacgaatataggaccagagaggaagaatgtaaaaccctagaagacgaatataggactcgagaggaggagtaaaccctagaagatgaatatgggatcccagagaacgaatatgaaaccctagaagatgaatatggaatcctagaggacgaatataggactcgagaggaggaatccgaggacgaatatgggagtccagagaacaaatataggcaccgagaggataaatatggcactttagaggaagactcaaaggacgaacatgggactttagaggaagactcagagaacgaatatgggaacccggaggaagattccgtctaaaaaaagggggttttgataagcatcgaggaacaaaaaaatttagtctaaaataccaaaaagaagtagatcggttttttttcattctccaagaactgcatatcttgccgagatcctcatccctaaaggtacttgacaatagtattattggagtggaacacaactcccaaaaaacacaaaaagtcggctgggtggattggttcgagtgaagagaaaaaaaagccacgcccatccggcctttgattactctgggccagaggacacgaccagggtctctcctcggggtattttttctcgcatttctatttttgttctgagcgcatctgtttctcctgacgtatcgagttcgtattctcgatttacaggtctggacagtgacaccgtgggacgccgcgttggtcagataatgatcagcgtgcccacgaaggcgggcgatatccccatcgcactctgtgataaggatgtgactgagcgcgccgccgtgattaatgtaagtgtagtcgataatacctttatatcttccttgtctagattgcgccgtgacttcacgttatgcaggccctccctctgacggacgtcatcgggccgctcatggaccaccaggcggcagcgtcgttgaaagagagcgttgccaaggagccatctaacgttgttgctgccaccacgagtggtagcaacatcccaaagagggaaaggaaattctcctccgtactcgggacccgtcggaaagcgccgacctccgcggtaagcttctctctcgttttttagcgcgtagtcggaagaacttctcctcacaccatttcatcctactcaggactcgaacacgtctcctccgcctcagcgaaggcaaaggttggtgacgatcggcgagaagtaagtaaacgttcttgatgtcttttcattttcaaagttctgatcacctcgcctcatggggaagaggaaaatctttgcagggtggcgtgggaaaaggtggcgcaaggtggggctgatgccgcatccagcgcgtcccctgcagcgacctcgtcgggagtcttagtcactgctaaggaccaggaggcagcaccgagtggccctgccgttagccccgtgcctacccggggcccgtccaccgatgccctcacctggggggaggtccaagcggagatggagcgcattctccaggccggtgctcatggcgtaggtcgcgagatcgaagaggccagggcggcagcgttgtcggcaaaccagtgtgccgaccagctggcgcgcgacctagcggaggcccgcgaggacctcctaaagatgagggagctggtggccggcaacgagatgcaacggcgcggactcaagcaccggatgtcggagctcgagggtcacatgatcaacatctgtggttcgctgtgaacatcgttcaccagcctgcaccaactcgccggggagtgtggtgtcacgactaccatcccggcgcaccccgatgagttctcgctgacgtcgtcgcttgcggaattggctacggcgatggaggagatcccctccaagcacgcggccaggatcggcgaggagacgtccaatggcatctacaccggggagtgccatgtccttgcgtgcatgaggctggcatatcccgatctggaccttaagaaggctttggatcagggggccaccgatgacgcgcgcaaggctatgatggaagaagtcggtgacttgggggagtccgtcctccccctttttgaacagtaggatatttgttttcccttgcaccccttagccttcatgctgtaaaacttttctgtggatctgaattgctcttatctgaatagctgtctccctagtttccttagcatgtgattctgagtactttgttgttgttgtagatatgttgatgtcgaggacgtccagcagcgcgggcagcccgatatgccggtgatcgttccggcgctcacactcgagccgttcgtgctgcgggaggaaactagtcaaagcctgtctgcggaggcgagcgtggcgatgacgtcactaggtttgtatcttgctctccttcactccttgtgttccgtttgacttaattagctatgttctcggaagagaagaatagcttgacttagtcttttccgtgtcgggtagattttgagaacatgttggctgactaagatcgtcgaatgcgatattggaagacgaaactcgaggtggccaaactcgaaaaaaccatggtggaggtgaaaaaggaccagcccgtggaagctctccggggtcgcgaggtgtggttcaactcgtacctcaagagctgctgcatggcgatggcgagggtttgcaaggagctccgagttccccgcgaagatcccgaggagtcggcggctggttatatctcgtggttgaatggggcctgcgcacagctcgaagggattgccagcgcatcgacgatgtcttgaagcaggagtgtcgtcgagcgagccgctacgctagaggacatgtgctagcctgcatccgagatcaccgtccgcagctgcacctcgagaagaatatgtgacctcgttttatttctaggctagagaaattagtttctcagtaaaagtccatatggggtccctctattttctcactagacccaatattttgatcctctgtagaagtccgtttaggatccttcacctttggaccgagcccattatcatcgtccctctacttccctttacttccttacacaaaggcccaagaaccctctccaatacaaggaagtctgtagttacttcctctattttctcagcccaacccgaaggaccaattcccataagtctgcactagctcccttccctcgttcaggccaagcccaacaaatattgtgcattccccagataagtctgtactacctccctctatctttctagataactctatgctgcctcccccctactcctccctataagtctgtactgcctcctccaccaagcttcgggctgaaacccatagacgatgtccccctccttccaaagtttcattcatacccctctttaatctggtgtcgatcaagaagaataatcaccgacacgtagacactctgaaccagctgcaataagaagcttcgatcataaggaacgaggacccccaaattaggggtgtaagtggctaacccgcgaaacctacttataagctaaaataagccgcggacccgcttattttgacctataagtgggttcgcggctgacccacttacacccttaccccaaatcgtacccgaccgtgcgaggactccagaaaatccggaaaccactgtgtgctaacaacacacttaggagcatgacaggaaccctgacagacaggccctataggaactctgaccgataggatctacagccacgcactatccaccaccaataattgagaccgaccataccctgagacgcgcacgtactaaagccccagtgtctggtgcctataaaaaggaaccccgagcgctctcaagcaagcgcaccagccatccctgaccccgcggtaacatgggttgaacccccttgggaaatctctcaaaagctccctgaagggtatgcccggtagctggaacagctactccgacagctcgttggctttgccgagctgatgcatcgtgtcgagcagattttcagggatcccagaagtgctggaaggcgaaactcctcctttccttccctagagagaaagagcacgagatgatctctttcgaaacccgccatccccggatcaccatggaggctgccttccaagacgtattccgcaaagctctgtaccggctttgcaagctctctgccccgttgggcatagaccatgactatggcttgcacccataccgcactgatgaagacaatcggtaccacctccgtatggccggattgcccaaaggatgtcggtgcacgctcctctctaagatggcctgctctgccaagaacgcctacgagcaggcacttgaggagctggacgaacttcgtgatcggtacaccaacttagaagcccgttaccagcagctgccccacaagaacacctccgctctgctcgtgcaggcacgcgcgacgaccaacatgatctaggcccccaacttagaaggactcgcaggaagcctccattaccgatcaatccactttcacctccaccatctctctaagtaggattaggagtgtgagcccctgttgggcgttgcattgttagttggtagtcccgttctccccttttggaatgtatctttcagtgcccgatgtaatatggaatgaagctagttagtccgccatatctctatgtttttggagctgagtatttttattcacacctaaaccaaattgtctccctttggaaagcccttttgcgccggtagaaattattttggaattaatcgataacccctcgtagtaagaaggttatgccgacacacgcccaagttttggatttatcatgcctctgacatagaagcaaaagtctcaaaaataaacccacaggatccatacaactaaggatacatgccttgatctgacaagcaagacaccga

SEQ ID NO: 18339 - DNA, 18343 bp, Oryza sativa
  unsure (1)..(18343): unsure at all n locations
nnnnnnnnnnnnnnnnnnnnnnnnnnnnnnnnnnnnnnnnnnnnnnnnnnnnnnnnnnnnnnnnncnccctgcttttgtagcgccgtcgccgcgttcgtcttctctctcgctgccggcagccgctccagccgccgtttgccgccgcctcggccgtcgccctcctgtgccgccacctctctcggctccgcaaggtcaagagcaagcccggcagcccgttcccttgcgccgaagaccccgggaagcccatcgtcgccatcaacccgaagctcgccgtcgtgttttgatctccggcgaggctctgctgctcctcccgtcatcgccaagcttcgccgccgcctccattggattcgcagctgcgaagtggacagtacctcgccgccatctcgatctcgtcgtcggccgtcttccgtcgctgtctgtcatcacgtcgtaagtgttggtaagaatcgccgtcgccttctctacctcccggtgccctccgtttgcattgttgtgtcgtggttcgccggtaaccgccgctcctatgtcgttcaccggtgtagtttatccctagggtcttaattcaatataatctaattcgtgattggtctagcgttgtcatctccgtgtgttgctgtcggaacattgtcatcatcccttcctctccgatcgctttggttcggtgagacttctatccgttctctcttttcaatggcatattatttctttttaatatatgtcatctaccaaatataatctaatcttttctggaggttgtttaatcttttctctcagttataaatcatttgtaaatggtttaattaatttggaatagtcttttctttaataggtttaattggaattaaatcttgtaaaattcatatctaattcatatgaagtcggaatgaggccgttcaagtctctaaattcatctaaaatcatgatctacatgtttgtttactttttatgtactgtttatttggtttttattagtctttttctctattttgcgtgttagcttgtcgtttttgttgttgcgaaggttcgcgagtgcgttggaagtggttctgaagactaattgaagactgattattgcaaggcaagtcacacagatcccaaacacgattcctttgagcatgttgatcctatatttaaattctctatttatttcaactgtgcatttattttcgaatgtcaccgggtggtgttatcctattcttttgtatggccaatttgcattgaatgccctattccttgataccttggataataaattgattagcttgaactcgggatggcaatcgggcgcgacgggcacgggtagtgcctacccatacccatgcccgtgagattatttgtgcccgtgggtatacccattactacatgacgggtaagaatggttgcccatgcccattgcccgcgggcgccttatgcccgcgggcgtgcccgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagggaaaccgtagaaaacaaagaacgtggcttatgtattctagtggattttgctcctagcctacatgtaagttagatttcgcgggtaaacgggcaaagcgggcatgtgtagtgattacccatacccatgcccattatccatcgggcatagcttttgacccaataagatatccatgggtataaaatggagaacaaacccaaccctaatagggtttttacccgcgggtaaatgggcaaacgggcacaattgccatccctagcttgaaccttatatattggtttggttcagctaaatgctatatatataattgtttagccatgcctagaaacattagttcattaatgggatgaatcatactacattattatttgtggttatatttaatgctagctcacgatgattaatcgtgttatgataattaattgataattaaaacttgataatggtgggttgtgagcacatggttttgaaggttgtgctcatgacaattaagggccgattcgctagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgaggggatgattatgatccagggacggtgcgctgtggtggattgtgttgtgcaaggggtactgtcacagttcctatccgagatatcgtggtggtattgaggcgcatggtaacatgtcgtggagctgtgtcttgtgagtacagtggtacatctctagctagagtaaaactattcgaatagccgtgcccgcggttatgggcaagttgagcaatgtttttcgtgattaatctcataataattatggatgctataactagtaataatttatttagctcctggtttggagtttgatctgtatagccgggtatggttgttcagaatggttgggcctgagcagcatgggcgtgttgttcagagttgattaaaattaatgattaaattactctactgtttcactactcttaaatctttgctaaatgctgctattgcaaatgagcctatattatgccatgctttggtatccttgtgcacttgtatatttgctgtgtggcatgttgagtatgtcatatgctcattcttgtcataatcaatcagcctcagttgaagaaaaatgatacagaaggagaagatgtttgacttataccccagttgagctgcctgtgggggtggagccggagcttcgctagattttatttttccgctgcagttttcttcgttgtgaggactaagtgcctcttcagtaagtattaattgctttagttattttgatggatttctatattaaattgtcagttatgtacctcggctgattactggacggggattttatgcacaaataagttcgaaaattactagtgaatttctgggcgtgacacgtggcaaccgcacggagaagacacaaagcagtccccccccctctcctccgcccttttttttcgaaagcggctcgcccgcaaaataaaatgattacctaagtgcacaagggaaaagagatattttcgaaaatcagtgtattttgaaacaagccgttgcttatcaccacccgcggattgcctcggtcaaacggctataaaccccgcagaggacacaaggttccactacgacatccgaccgtcgcacgccatagctgtggcctggcacgcgtgcctacaaaaggatgtcaaaagacatgcaagccgtccacctaaaaaggagacaagatattccaagctgtgcactgagccatgcattttggaaaccagcgtgccttatcttctttgtttcttcaagtatcttcctaaatctgtttctaaaatctcccacctcataagggcatgtataaaagtagagtcagatatgagctctacattatctagagactagtatcctacaacagttagagataatatggtctctaatcattaatgtatcaaaatattttttcttacttttctttcctttctttcaccaccatgcaataaaatttgctctaataaatgctaacagtcgactctgagccgttgtcatgcataacaaccatactcctttctctttcttccatatcatcaaatttacttgcatagcaatagagagagaccaccaataaaaaccgttgtacatgccctaaggagcccgatggaagcaaggagaactcccgaactgcagtatctctctccctttatctgacccttactaatctcgaggacgagattattgttaagggggtaggttcgtaacatcctgaaaatttcgattctaaaatacggaattaaaaattcagaataatctttttaaacctttttgcatgctaggatttattgttcattcatgtgtgtttaggttgtgtgccaaaggtcttgattaaatcttatctcctaaagggacgccctctatccaacatcatttcattcccttattttcacggtctgatttattaagtgcttcgatactaaacaaaccacagacctgaatatgtaactcaaaaatgtttctttatgtcacaatgcgacatatctttctcaattcttaccctacggttattttaaaccattctattaattccactcgatcattccctcgaatatctacaaatgatcgacgtatttatttatcgtgcgtcgattcaatatttgattctattcccaccgcgacaattggattcgtatgccacgcgtcgtccctaaaatcacttcttcgtttccgtcattcgttcgtacgagcactctcaaaataatcctacgacaaccgatgaattcgttgttgagattataggcatataatgatttaatatattccataaataaatcatagcattgcagatgtataccagcattaacgcatcattagatctacacatgtaaactaagcagtaaaacatgaaaagatcaaatatgcgcaacatattgaacacgtaccgaggtggtagaaagaccggctgctcggcaggaacttttcgcaattgcagatgtttacgaaggcgcgcagcacgcgagcgaagaggaagacgagccgtcgcggacgaacagggaacagtcgcgctaagcgcttcccaaaaaccttattgccgccttctcccggtgcaggacgtcgaaggcataggttccggagacctgctctcccgatcgccggtgcacgccggcgaacgggatggagtaatctacgagcgacggcgcagcacagagtaggaggcaaaccctagattgatttttcgtgtgttgcgtgaagacggcgagtcggtttatatagagaagggtcgcttgatcagggcgcccgcacgatctccactgcgcgtaaccaaaccggataagtcgcgcgtaacttatccggactccacgccgttttcacgcactggatttttcggaacatttccaaaacaaaaacgaatccgaatttgcagcaaaacaaaactgtaaaaggagactgcatctgcgcaaggtgaggactaatttttggcagaccattcgacgcgtacgtcgtgcacacgcgccgcctgcccggcaaggcgagcaagcgcgcgcgtgttccccctcttctctccaccacacatgtttcaagtggctaggagggcatcctcccttttaaggaggtccccctctcctagaataagcaaggtggtactaaactccacatgcatgccatcccatgaggtgggcttttatgattttccaaagaattaatcttcgagtgggctaagccccatccattaattccaacattcgtttgtcaggcgttaagcctaaactcctatttggcaacacggtgcatccatccaaacaaacaagtctcatattgcaatccatttattccgccctcgtgcatcctcgaaagatctataccaacccaaatatagttattgtccaagttacagtttgccacatacacaacccaatgtacggaccaattacagttcgtgcacatatgtcagtccagaccacaagtcccatttataccatcccatttccaaagcactgcccaaatcacatcgtcccatcccaaatacaaagtcccattacagtccattgtacagtccaaattatacagctcaatttgtaaatacactgtcaatatacaactccaaatacaaataccgctctatattcaaatccctgcaaattacaaaagctcctattacacttgggccattcttctctctgccaacacagcccatttcacacccaagtccattttaacccctccgcattgatttagaaacgttttatgcaaataaaacttgctttatgctaaaaagaaccatattatgccttccttgattatatgccttgcaagtagggtgttaggcttgtgttggtgcttgccagtacattatttctaataatgtactgactcttgctattgaattaatcttttgcttgcaggttttagacttagtctttgagtgatgtgggtaatcgactgtttcttctaggactagaacttaatggggtaaacccctagtcggtgtgcttgtggattgggtagacaagcttctgctgttctatatatttatttggccggtcagccaatgtaactaaagtagatgtagtttataatcgctttcatcttatttgtgtttgctatgtataatcatgcttgagatgaaagtgtgaatctagtgcacatcctgggaactagattcacatgagtatgagttaagaatgtttgagatgttgtagatctttagccatttttgtcaagcctcctcaatgtgtaacacatctggtcgccgccttcgagtggttttgacggcacatctcaagctgaagttgactggcaggctaaaggcctagcaatgtctccaatattcttctctcgaggcgtcggatgtttcattatgtttgtttgatgacttgaattattcacttcatccctcaaatataatggaaggtccggaaagcctacgacacgcgcgcggctagggttttgctcaaggagggaagtgacagctagagtttctcacgtgatgcaatatctccggcggtcatacccctcacgaatatataggatccatcactcgagcctccaaggcccgtaggactcctattcggatccctatccgaattaagctcatattggatctccatccaatctccttattctggcccattaagtgtgcgaccctgtaggttcatgtatactcggctgtaacttgaaaactccttttcggtccacgcgtcaatagcggcccctagcagaacgtattgacccaccgggcatacataaagatcatatcgactgaacctctaatgtatacttgtatgaacccctttgtctcacgatatcgattaagctcaaggctagatatgtgccatcctctaatagctcaatcattcactcgaacctctcgatagattatataacttgtgattgactccttaatcacctttggcatggccatgcgcttccataatctacaacatcgaggggcccagagatatctttccataggaggggcaaatcccatcttgattattcatatcccaatacatgtttcatagcatactcgaaaactacttttataactatccaattacgaagtagcgtttagcagtccctaagtaagctactacacatgttgggaaccatgataatctcagtgtctcatgtttggtctatcaaacaacatgttcactaacatgtctccacattgttaatttggtatctatataccatgatccatgagacatgatcatcaattaatacatgtgctgatcatctaatcatatttgttccacatttgatatttgatcaggaatcctttaaaaatagtaacaaacaacataaagagtctcatgaaagaatcacatatttattaaccaataatgagtttatctatttcaaggaacaatgtcggataaatatgtaaacatagtataggatacaatcatctctatgattgcctctagggcatatcactaacaccaccatccttacctccaccaaccgccagcctccccatccacgctgctgcgcctggcagccgccgtcgcgccaagccaccgcgcgccgcgccctgccgcgccaccgaggtcggccgctggccccgccgtgcacacgccgccctcacctctctctctgttgcacatggagaagaacgagagagagagcagaccaggaagagatgagaaagatataagagagaggagaaagattaagaagaggaaataaaggagaatgagacttacatgtaggacccacagtggaacccagtcggttgacccctcactcctcttgacccacaaaccctagtgaaagtctatattggcccccttttactttagtatccttcatttaacaatcagacaaagcccaccgtagccacctcatactaaagcccacataccacatcccctatacaactcaaagcctctcagaaagtctaaaccacctcccttcccgagaatgctccctcctcggtttataaaaccttccaatttcgaaaattcatatctctccaaccgtaactccgattgactccgttcaacttccataacctctctaaaatcgagatctatttaatggcaccattagttgtattgaatgttgttttattttatttcttttaggattgtgcgtggatattctttggttatttattggacgtgtcggatatttatcgatcgcgggtattctagttgtccaactgtcacagacatctcgaagacattaggaacctatagcaaggcaagtccctacgctccattccttgaacatattgatcctacatttacaaatgtgttgttttacaaataaattgcatgctatttataaattgcgtacctacatttgattatagcctgccttgatattgttacccttgtacatattaatgtatgcctttgaatacccaattcatttatttatatacggtcaattattgacaatgcttagcaatgctattgtagacatacgtatactccatatttaagctagatgattacggatgtgagatcactcgatgtgagtgattgatgatttgcgggtggagacatgagcgccacccgccacacacaaaccttttgtgaaaaccaaaatttaatacaacaaaactattttgactggggcagcatgaatagaatatgggtgggtctggaaacggttagtcgccgaccctggtcagttaaggaccgagtcaggaagctatacaggaaacgaacagagtacgaccgcatttctcaagtgggtatagaccggcggattaggaagctctcgtggagcggcacctaaatcgggtaggttctatatcagtgtggtgatgagtacagtgtcggaaaggtaaaggcctagatatgaacttaaaatgaaccctataaatatatatagtaaatatcccctattccgtggagcgccaggactcccttcaccatccagcagtaggggtttggagtgctggggtgcaatgggggttcatagtccttggagcaggtgccgaaatgcgagagcaactgaaaagtcgggccgtggcaagtctcatgtgttgggactaggctcatatgttgggcaagccgcggggtgcgggattaaaagcgtacatccgctgcagtgtgagtaaaccaatctattcgaatagttgtgctcgcggttaatgagcgccgagacctgtagattttaatactgcttagagtagatatgggagagatgtgaaccttgcccaaatagtgggaaggttagtatagtagagttggtataagatgaaatgtgagggtaaatcgaaccaagcgaggcttggagaggtggatgaaccctggataattacaacttcaacaatagtgttgtttttcagttaaaactgctaggtcaatagatttgtgaaatgaattgtgaaaactagctttatgcaaatgaactaagccatccttgaaccactgtgtgcattagattcattttgtagtggtggcttactgtgtactcactcttacttaattaaatcttttagaaggagttggcgtcgattagatttatgccatgctgctgtcaagtacgtgttgaagatgatggattagggaccataggttcaccagtcgttgcttgtggagttcgatggaccgccgctgcttcgctttcccgttgttttatctattactttggtattttgtattgtaagtgaccatgcttggtctttttcgggacccaatgaggttacccttatattattactgtagaaacaccggtaaacgaagtcagttgtgatattatactgtgctatgtgtgtaccacctactgatccagggagtggtactgtataacacatgggattaccggtgtataaaaccgggggtcccacagatatagggtattatttacttaggtaatgttataaaatgtttttgctatgtgatttttattagatttgacttcacataggtgtagagatgtgttttctaggacttgcacattttggtttcataatttttagagttattatgaattccttatgtattttacaagttatagcgtgttacaggtgaatagttttttgtattcatatagttttgggacaatatgtccagaatgttttgcttcctgttttagttgcataatgtgaatgatttgttgaccaactaatttttattttacaccattgaggcttttagtattttgcttcgcattttataatttaggggtgctctaagtttgtaactcaatatatcaacctaggaatattgtatgtgctgagtaccataaattttggtaagagaggatggtgttgtagcttttctggttcatctaggatttatttgttttatttggagctagggtgcattctatataatttgcttaactagtaatatgtgattagcactcagtttattaatttaaaatttagagatatatttgtacagaaggtgccacatttcattttactgggttgaagctcactacttgctggttagatagaaatttagttcaatccatttgaatctaaaatgatttttttttacaaaatttccaagtttaagtgtgcttatgttgattgttccttatatataagtttaggggcttttcatgtactgtaagcggatatttctattttataaatctgaaatgcacaattttttgattctacagaacttgagttcatttaaaaaaaggagtcaaaatggattttatacgactttccaaagttcagcttatctaaaaccaattattttgtagataatatttttagaggcatttggtgcaaagtaagtatatatttttatttctccttaccaaagagtgtatgttagtgaatctgtagaatttgagtttgtcccaaaatgggttaaattaaattttctatgtattttataagttcttacatgttttatgtttactttttcttagataagttttagatgtagattttgtacagtaaataccactttttaagttgtaacattaaagctcatcattttgtgaatccatagcaactggaatcatctcaaaatgatgtttttttattttatatggattttacaagtttaggtgttttcttgttaaaaagtacatgtttttttattttattttatattttcagattttaaattcccaataagcaaaaaggtcccgcaggtttcagggaatagatcccttggtccaaacacgtgtggaaagccaagtttattaagagtccttgagttttaatgtatttataattagatccatggtcccacatataagtctaacacattttacacttcaaaccttgcatgttttaaatttttactaagtgtggttctcagagccaaatcatgtggggcctgcagcctgcttgtcagtgagacaagggaagaagagagcagggatcgagtaggggaggagcacgccggcgagcttcccagcgtacggtgacggtgaacggaggccgatctcgacgagcaaccaaaagataaaatgtagaacctttgattgtgaatcaatatgtgtccttctagcaagctacggtgatcgaaatcagtggcgacggcggtgcgagcggcagtgaccttcctggtggcaatgcatgtcactttagaggccgggtctaggtgaatagagtgcatgcatgtgacactaaagccttgagggtgctcaccaaaccattggggaggaatgccgagacttggttggcaatggcggcttgcggatgatatttgttaacgaagtttagctgaaacctacatctccagggctctaattatgggcgctcctctccaaccaatatagcacctagccgctacgagtccatggcctcgccgcctattgacggtccttaaatcataatatttgaccatcaatacctgcatataataaaataaaatatggtatccaacttaatggtagggattattactaatcaattccactagtgttggtgaaatatgtgtgtgcaagtagtttaaggagaaaacacacccgtcatgcaaggaaacacacctccggccaatcaggcgcaagtacacggattgaagggcccacaagtcaggtaaacccgccatggaacggatcataactgccataaccgccatcagggcccacatgtcagcctcctagccaaagaagaggccaagaggtggggcccagggttcgaccgaaccatcgctggctcctttcatcccgctcttccacgtgtacgctgcttatgctttcccaatgacggttgagggcgttttggacaattctcatagctgtaactgtcatatggaggctataaaaggaggagctgatctcacttcactcatacaactttgacttgaattaaaagaggctctattgtattttttgtacattagaaaataggtagaaagtgaggggaagctctaaaggagtgcccggaagtttagcgctccctccgacttctacctcgacaaatgtagctttctaggaggaattctggaggagtaccggagctgtgatacactctgctctgggttcggagaaacttcttctattaagtaagcattcaggatccattcttatgttatttaattacttagtataagtaagatagatttttcatctttgcaggttcattgtttagtatttgtactaagtgctttagtattagaactatggataaaaaaggaagttcctgcgcaagtattagagtagtaattgataacttaggtatggtatctaggttagatattacctttgtttgttgtatatcccacggatttgttagaggtagacggcaggtggtgacagccctaaatcctgtcctagtaatcctccacattcggatacatcatagagctatagccagaaccacgctggcagaccagcaggggtcggtgcctgaagcaacaaataggaaattacctttgcttagcttagacaattaaaacacatagaatgtcctctctagcctaactagcctaccattaattgttgtccttgaatagttttagccttaggtagatttcacacgttccctaagttcgatatccttttggggtcacccgaaggtgaagtgctacagcggtattccgtgcgcttgcggatttatctgtggtcgtaagaaataccaacaccgccattatcttcccgtgtgtcaactaggggtggaaatgggccagctcggctcggcttgcagtggctcgtaacaaactaggcttggcttggcttgggcttattagggaaacaagctaaaacttgagctccggttggattggattctggctcgagccaactcgagatggcttgcaaggcttcccgttgaaacacctctttatatatatttgtaattatttaaaaaagcaagaacaaattatcaacatgtaaaatttaaataagtttatatattcaattcttcaaaatcttaatgataaatttcaagttaacaaataataacgctattaaaagtaaaataatcaatataaacacatgatggcctaagctcgtgagccaaaacaagcggcttgaaagctagctcggctcggctcggctcatttccagcaacgagctaaaaaggaagcttgggctttgctcgtttggcttacgagccaagccaagcccgaactgagcccatgagcccgagcttcttttctacccctagtgtcaatgccatgattacattgtgatgtctcctctctatttaaaacagcctatgacagagtttgactctaactcaggtttacacatattccaactctaattttaactcttagtaggattatatattctgacacatattctaacagctgaagctgtcgtgagctcgtgactccccattggtaagtgaagacacaggcacgaattttgtaggctatgttcagcagaaggtgttggcaaccccttcttttttgcacacaaaaaatgtatgcattaacgtatgattaattaagtataagctaaaataaatttaaaaatagattaatattggctttaaagcaattttcatatacaaaatatttgaaaaaaaacacactgtttggcagtttgaaaagcgagcgcgcaaaanatgagagagatgagttaggaaagtgcccaaaagaactcactcttatggcatccataatgtgacgcaaatgtagtccccaagtaatataatatatcatgcagccacctaggccccgttctaaaaaaaccaacttttcctcactttttaatagcatgcttttcaaactactaaacggtgtgtttcgtatgaaagctttttacatataagttgctataaaaatcaaataaatccattttcaagtttttaataattaaaatttaattaatcatgtgctaataacttgtctcgtttggtgtacgcacttaatcttcatgcttgttggagaatcgaacgggatcatagtactattgtgcaactagtccatataaaaaaaataataaaaggtacccatatgcatatagactacctatatgaaataaacaatattatttatctctacttttctcttttcttctcatgctatcttgtatttgtgaggattgctatagttaaagtttaaggtgtgtttagttctttgggtgtaaagtttttgaagtatacggacgcacatttgaagtattaaacgtagagtaataacaaaacaaattacagattccgcctataaactacgagacgaatttattaagtttaattaatccatcattatcaaatatttactgtaacatcacattatcaaatcatatcgtaattaggctcaaaatattcgtctcgcaatttacatgcaaactatataattagtttttttttcatatttaatgccccatacatgtatgcaaacttttaatgtgacgtttttgccaaaaaaaatttttatctaaacaaagccttatttttatttatatgagtgatgaccagtgtagatccgacatccaaaattcgactgctgtggaaagtccagcaattaaaaaaagaaagtgatctgcatttgttagttcaccagcacttcacccactttatttcgcttgcaaactgcccctgtcctttggcttttaaagcaaattaagacctttcctcctccagactagtctagagcttaccaacccaaactaccggaggaaagcaaattgcgagcctgtcgcactcggtggaaatggcgcttgtcgatcccaaggccggggagtcctcctcctccaccgtcacagctcaccacctgttcgtcgttgtgatcgacggcgtggagacgtccatccacgagggcagcctccaggccagtctcggcggcacggtcaccatcaccagcgcggggaacctctccgccagcggcgtccgcagcgtcgtcgtgcacggcggggcgggggacagcgtcagcttcaccctgtgcggagacgcggtcgccgacggcgtcgactccgcgtcgttcgtccggtncggcccagcgcggacgaagggcgcgcggacggtgtcggtcacccggtgccgcgccgcgtacttggagcaggccggcagggtgtccctcgagcggtgcagggaggcacgggtccgggacggcggcgcgctgcgagcagccaggtgcaggcgcgccgacgtgaagagcttcggcgaggtgcacctggcacggtgcaagggcgcgcgcgtcgactggtgcggcagcgtggaggtcgagatgtgcagggcggtggatgtcagccggtgcgggtctgtgaccggcgaacggtgcagggtggtgagcgccgtcggctgcggcagcgtcgaggtggcccatgccgtggtgaacattcttgaagaagaccagccacaagcagcacaacatcccgtctctccatcacactccagtcgatccagtgacagtgaatgaaggttagcaccagtaagactcggtaaatttggtgtttagtatattcgaaattgcaatctcatactgaatttgctcagtaggttttttcttcttagtttcattcacggtggatttgtttttaattaaactgaatttgatttgtcgactacgggtaaaaggtgtaatatataaatagtcttgacaagctgcatcttaatctgaactcgagtaatacgaatggagataggattttcatttttaaatgatagttttttgcattctctttcaaataaaatattatttaggcaatttcagttgcaaggttgaaatatcactgaaggttacaagttgatttgtgttgtcgacaagctcaaattacagagactcaattttggatgctatttctgctcccaatagcaacctgatctgaatcgtcatctttgggtgttctgcacttctgctctgccgcctcttgcagtcttgcccatttttcattccctgctccactcgaatgggccatatgcaagttacttcttcttgtcgtgctcaagagtcttgcctagtttcttccattttcctttttatagcttgtcccaaatctttctactccgtacttcaattattttgccccatgcacgtaccgagtactcccaattcacaaacgagatcttttagggagttagcgagatacttaaatgtattaaatggttgatcaatgtgaaccgttgatcaaaagaggggtaaagtacactggtggagagaggggttgtactcccgattgaaaacccctgtagtttcggtttttcaacatctttagtcccataaccccccctatagtctcagtttttcaacatctttaatccggttcgtaacaccaaccaggactaaagctttttttcttttctcatgttcaatatctccaaatcattataataacaaataacaaatcacaatcgcaccacaaatcacaaataacagaaagcacgaatcatagatacacaaatcacacatagttcacatataacatatctcccaataccattcacaaatcacatatcgcacaaatcatagtcattcacatcacattaagaaggaaaaaagaagaaaaaaagaaagaatttcccatgccaccgttgggcggccctccgcgccttcgccgcctaccgccatgggccctccgcgtgggcagccgctgccgccaggcctccgcgcctccacgaccttccttcgcggcggccgccgccgggaagacagggttgagggaaaggggaggaggagaaggaggaagaggagaacgagtgatgaggagaacgagtagaggagaagaggctaagggataagaccaagggaggagggacagacatatgcgtgaagagataatgatcgcgtagcttggggtgaattttagtaccgggactaaagatctatttttagtcccggttatttataccaaccgggactaaaaataattggggcctgacacgacccaacaacttcttcaaccgggactaaaaatgatctttagtcccggttggtaacatcaaccaggactaaagatgctttttaatcccggttttcattggaaccgggactattgtggaatttggccgaccgaccaaagatggtttctccagcagtggtacgaaataaaattattgtaacatggtgtcgaaactagatttcggcagtactaaaaagggatagggaacaagctatgaaagtggttggattatgagacaatggatttatacaggttcaggccttctcgatgagaagtaataccctactcctatagatgaacgagtcgggattacaagatacggaccttatcccttacggtttaagctctatatatattttacaattgtaaccgactaagattacgtgatacttccttgatatacaagttaacgtaatacccgagtcctatctttacatattctattactatgagttacccccgataactagtcgggtaacgcagccctgtgggtatatggtacccataatctccacagtagcccctgagaggccgagaccttcacagatgataaggtaatcttctcccgagtggtttaataaaaagatccgagtgctttagtcattttcgccacaactcctgagtacctcaatcatctcaagctgtgaagggctaaaaaagaaaaattaaggtgcatcgactagatgcacctaattagttgtagcccccgactatgtgatttgttgaacaaactaaacatatatagtcaaggaaaaaataaccaaccgagtggtttctaatgattatagtcatcaaaacgactaaaccaaataccaagcatatgcagcttaaatccccaaaataatatgatttataggatatgccgactgctttttatacaacatattaactcaaaacatttagcctaagcttaaatgctgatttaaaaagctcacttacgtgataacgatcggggtttgatgngggntggttgtagcagctagtcaaccgcgg

SEQ ID NO: 18340 - DNA, 10373 bp, Oryza sativa
  unsure (1)..(10373): unsure at all n locations
acttgtttccctttttgggtagtcctatccccnacttcctttttccttcccctttcccaagcggncngnccttcccctttcnnttcgggggngngggccntcnccctcccctgnncngagtcagtctcctcccctccgtcctagtcctactccatctatgactccccctttcctaatctagtcctcccctatttaagtgttccctcccccagttttctttcttttctgccctagctaccctagctgtcgcgccaccgccgcccaagctagccgccgccaccgccctagcgttgttctgccgctgtcgccgtctccgccatcgtcgccctcgcgtcgccggtaatctattttcccctctcaattgaattggttaacccaatgtcaattgtttccacgtctaacctagcacgttgtgtcctctctagcgccgccgtcgtcgtcgtgttccctgccggttttgctccctgctgagaacctccctcctgtttttagggttttgttcctgtgtcgtagttggccgaatcgtcgtcgtggccgctgccgccgcctagccgctgccgcgctgagccaccgtcgctgccaactgccgcaccgttgcgctgcgtgcctctgccgtgcgtctttgcctagccgttgttttgtcccgtcgctcggtagttgagttgtctagctgtaggtgtgttgacggtcgttatcgatcaatttcgtccgtcaatattaccaaaataaaggagaactagttatgcttgcaatgcatatacaagttagaataataatattccactagtattaggtttactaaccttttgaagagaataaccataaagtggaggagaatcgacatcaactcagatgataaatcaatcggacgatgtcaagaatcagacttatgcatgaatggaccaagaactcagaattgacacgatgaattgggccaaaattcaccagtctatgaagtgaagcaacggaggaggccgccagccaaaacttgggctggttgggccggcccctggttcggccgaacaagggggttcggctgaacctccctcgtcgccgttggatgcagggcttcttctggacggttgggattgatccccaatgacggttggagggtattaccgaccattccaaccatcacaaccgtcattacctgcctataaaaggacttcctcttctcacttcactcacacacctcaagcaagagctctctcatattctctcaagttagtttagtattcttaagctagtggaataggaacagagtagaaatcaggagtccggaagccttcggaagagttcaggtatggctctaggagctcttctcctctcttttgtaagctttgtactttatttagaatactcttctatatacatttatggtattgaaatactttccgagtatatgaatacctactttatattatgttcatgttatattgaatatactgctagcttatctgggagatgctttggtgcgggtataatgtttgcttatgcaattactctatgtcatgacgatgatattagagtagtatctggtagtttagacgtggtgtctagattacggatatcattatttggggttatatgctgcggatgagaggtgggccgctgatggtgacagcttagtacgggtattccccacgcatgtatatagtcctaagttcattccctagggagggtattcctccgtatttagccccggttgtatggtcatgacgggctgtcgtaaggaactcggcagtcaagggtggcttctcaaagtactaggagggcatcggatagagggtattagctagtatgtcggttaactagaatgtatgtatactatgtatactagaagtataggaatagattttctttctcttttctttccacttagcttagataatatatcatgagaatgggtagataatgcttgtgtgtcactctaccctaggattatcttaacccctgcttagaatatgattatcacaagtaatatataaattattagtcaagttctctctacatgatcttcccacgggataaaataaatacaatacccttggaatactctcgggtgaaatgctacaatggtatatctgtgcgcttgcggatgaactctgtaaccataatataccaggagtatttctgcgccattgctgggaattatatttctagtactgtcgtttagaaataccaacaagtatttctggcgccgttgctggggaagattcataatagagattacatgaactaatactttatatttacctctgtataatcactgccctttgcaggctaaccttggttgttttcacttttgttgtgaaaacagggtagtgcatgactggtttcaacttggcggaaaacttcaaagaaaatccagaagctttcttccggagcatcaggccgcgattcattgctccgcagaaaactctactgacaaaaaatccagccgtaccagcgccacagactttcaagactatggctgacaagaccctccgcgaattcgctgctccctctactggcaatgtggccattgggccgcagatcaacatgggagacgttgatttcgacttgaagtctagcctcatcatgatggcgcaagcttgcccattctgtggcgagcctaacgaggatgccaatgctcatctacagcagttcctagagatctgtatcacgtacactataaagggtataaagggtgtcagtccagacgccgtcaggctgcggctgttcctgttcttccttctcgggaaaacgaagcaatggttttatgccaaccgtgctgttgtcaacatctgggacaaatgctctacggcattcctctcgaagttctttccgatgggcaaaaccaatgcccttggtggaaggatttctagtttccagctgacaagggttgagtccattcctgaagcatgggaacgacttcaggagtatgtggccgtctgtcctcatcatgggatggacggctggctgattctgcagaatttctataatggactcactccaatgtcccgtgaccacctggacgcggcagctgaaggatcgttcttctctaaggtggttcgaggagccggtgatttaatagagaagatggtctccaatatgggttggagcgaggaacgactccaaacccatcagcgaggtatgtgcttcgtcaaggaaacggaactactcgctgccaagctggacctcctcatgaaacgactggacgaccacgacaaacggccacaaggcaccatcaaggccttggactcacacgtcacgtgtgaggtctgtggcggcacgggtcactctgggaacgactgcctagaaactcgtgaggatgcgatgtacatgggcaacaacaacaacgggaatcgtccacgaggaggttaagggtggaactagacacacccatactattaaggaggaaacaacaacggtaacttctctaaccaaccctccttaaaggatctcatttttgcgcaagctaaaaccactgatgctttaagcaaaaagctagctgccaatgacaagatcctagagaacatcaatgttaagctagatggcttcgcttctacttttcaaaaccagctgagcttcattaaaatgataaaaacccagctagcttaattggcttctttagtccctgcaactgaaactgggaggattccggagcagaccgactcctccattgaaaatgtcatggcgatcacgacgagaggaggtaagtccactcgtgatccgccatatcctaaccctgcaggaactaatcgggttgccagagaagcgccatcgagtaactcggctgacaaagaggttcagccagaaaaggccgtgccgcaggaatactgcgacacacgattgctgccgtttcatcaacggagtaggaaaccgtcagtggacgagcagttcgctcgctttgttgaagtaatccagaagattcacatcaacgtgccgttggatgctatgcaagtgctaacatatgcccgttatcttaaggatatcctcaacaacaagagaccgcatccaacaatgtaggtggttaagctgacggagcagtgcagcaacgtcatactccacaagctcctagaaaagaagaaggatccggggtgtcctacgatcacctgctcgatcggggcacagcagtttgaccaagtcctgtgtgatctcggagctagtgtcagcgtcatgccaaagaacgtctttgacaagctcaacttcacggtgttggcaccaacaccgatgcgcctacaactggctgactcgttagtccgttacccgacggggattgcggaggatatgctagtcaagatatgggatttcttcatcccggttgacttcgtggtgctggatatggacaatggaaaagagacgccgctcatcctggggcgtccgttccttagcaccgcaggagccaacattgacgtggaaacgagaagtatccgtttccatatcaacgggaagaaggaaaagtttcagtttcagccaaggactgaacaatgctccatggtcagaataaagtacgggccaaatccgcagaatattcaagtggtcgaagtggagccacccaagatggatagcctggtaaagttcatgcagaatttcctggaaaaggaaacaacgatgcccacgaaccgttattggaagatactggtaaaattaagtacactggccaagaagctagagcagtcgaagccgtcttccacaccaaaaccaaagaaggtgtggaaagaaaagtcaaagacgcctactccattacctccggagacaggtggaaaatcagtgcactgaactgaaaggagatacggtcttgcacgtggtacggtcttgcacgtcggacttaaaatgatgcgaccttcaccaacacataaattggtatgtatccgcatatttgttttcaataatttaaatttttgcatcatcacatgtttgaatttcataattgcatttaggattttcagaattttgaggaaattcttcaaatgaatttttaaaaacaaaccaaaataaaattttcaacgaaaattcactgtgccacgaccacactgaccgttggaacccaacggccgaaagtggggccggttgggcccaccaggggttcgatcggctgcctcccttttttgaggcaatggctagtgggccccacatgtcagttttgaccgttgtgggtgcactacttaagccaaccggccgggagaggggaatccaccccatttcagcacattttcattccctctccaaagttttctctcaagttcattcaagctttgattgtttccctcaaattcaaatacttagctgcatatatacatgttgctttggtgaaactaaccggcgtgtgacactcttgctattctaacccccgccgagttagaccattcttgctccattgtgcagaatgaggaggcggctgcctcgtctattcaagtggtccggctcttcgtcaagtcaatcatgatgagtctagcgcttgttcatcagctgatgtcacgatggaagatgccgaagctccgcgatgtctcctgaacgacgccgaccttgaccttgtcgacaatcaggaaagacaagcctactacatgctaagcgaccgggagcatgctcacacgcgagaatactctccggagctgctgaaaaagataggaatggatgttgattttcgtgctatttggaaagctgttggttggcagagatttcttgtggtagatgagcctggttctcgtttggttactttgcaatttctgtgcactttgaaagaaatagaagatggaatttcttttcgctttttccataaagagtatacacttacatggaaaggattgagtacactttttggctttcacgattcttgtaaaatcgatctctagaaaggaatttctgggttcgagaaaaataggttttgggaaggtatttctggtgctccaatttgcaagaaacctaggacaaatgatatccataatcctatagttaggctcatgcacaagtggattgctctgagtttgtttcctagaggtgatcttagacccattaggggggatgaattaattatcatgtttgctatggttagaaaaatcaaaattgctcctgtgaaatgtatgataagggaatggttagaaagtataagattttctgctcctattgagtgcatttctctgattactaggatagcgaaagtgctaggggtcgttagtgaccaaatcgctttcatctcagcagctcgtccctgtattgatgagaactatctagtgcatgggcatattcttaaacatggagtagacggatctttgatatacttttaccccggttgtacaaatgtgtcacgccccaaaacgaccctaaaatacatcctttaaattatgcctagaataattaaaatcctagtgaaaagccttcaaaaattaaaatgtgcaaagttaaaagtcaaaaaaggcttggaggatttttgtatatttcctaaaagcctaaaatgtgtaaataaattttagtggaattttcagagcacaaataataattatcaagaaataaacaaagttgaaaaggttttataaaaagaaaacctctaaaaatcctccttccctctcttgggccgaatccggcccatctcctcctctctcttcttccccgtggaccactcggcttctccctgcacgtgcagccgctgacggacgggcccgcccgccaccctcgctgacgggtggggcccaccaatcatccccttcctcccgccgcatgcgccgctccctccgctcgcgcctagcgcccccgccgccgccaaatccaccgcgctccgctgtgctccgccgtgctccgccgatcccgttcaaaattgaatgggggaaatatttcccctgattccctctccctttccccccattttcccctctctctctctttatttcggatggaagccccccactaatcccgccggcgccattaatggcggccgggtctcccgcgccggtttcctcccccgctgtcacgtcctgattttcgtttcaggatttataaattatttaataaattattattagaatttatattaaatgttcattaatttacaagtgaagttaaatgtgggaaataaaatttcctaaatataaagcatggatggatttaatttttattaaatcctccatggttaattatactctctggaattttctcggatttttcggagctgaattcttaattttaatcatacaaagaacatttcagtaattatccacatattaaattaatcattaaatggtctgattataattttgttaaatactttgagggtccaagtattttcaagatttttcttgaaattatttgagcaatagaagtatttttaacaattcaaagatcatttcagtgattaatttaattggaaaagtaattaaaattcaccttttccttttcgggccgaattaggaaaagtcctctcactctcggcccagtctcctctcagcctgcagtcctttcgctctctttcccgacgtctgctttttgtccctcctttaatcagtccttggaagtagaagcccagccgaaagtctaatttgcgtcccctgtactgctcatcttcaagcttggacagaagcccgagctgccgtcctgtacctgtgcagccgccgcttcctccaccaaatccgccgcatcccgtgctccgtttgcaaaattagttgaggggaaatattcctcttatcctcctctatccttccccccaagaatcgcactttatcccgaagaaatcaacgcggaatcgaattcgttttcgagtttatctctccaactaaccctcggatttttcggctcaaatcctctcgtttggagtccgatctctctaatccaagcctataaatagcatccccttggcgtcctctttcgtttgcaccaactcccgagccttcttgtcccccgtagcgccgccgccacgccgtccaagccgccgccgccgccggccgacgttcagccgcgccacgccatcgcgttagcagtcgccgccgcttcccgtcgtcgccgttaggtgcgcacggaggcggggaacctcggctgccccctcgccgccgttgccggtcaccggagagccgccgccgccgacgacccgagccgtgtcgccgctagagctcgccgccggccaccattcgtcgtcgtccatcgcgtttgctagtaccggtgagttcgcgtcatcgtcctctacgtgtagatgactttagatagccctgccgacctctctatcgccggcaaggtcgttgcccgtgaaattgcgcgatgatgacgtcagcatgacgtcatattttctttttccagttttttttctagatgcaaatagattaaaacttcagaaattcataactaattcatcgtaactccgatttgagtggttcaagttgctaaatttttctaaaatcgagatctacatgttaaaaatatccacatgtattgtttatgcttgtttttgtactgttttgttgattttgttctttcgctttagtttccgacgttctgaaggagagcgttttcgttgaggaaggttcagaagcgcttgatgaagctcaaggcaagtcacacagatcccaaacgaccctttgagcatgttgaacccatttaaagctaatgttttatttcaacttatgcattattttcgaatgtcatcgggtggtgagcctttcccaattaattattggccgaagatgactttattttcctatgggttagaattcgattagctagaaccttatatattggtttggttcagctaaatgctatatagatataattgcttagccatgcttagaaacattagctcattaatggggtgaatcatattacattattacttatggttagatttaaatgtagcttacgatggttaatcgtgttatgataattaattgataattaaaacttgtcaatggtgggttgtgagcacatggttttgaagttcgtgctcatgacaattaaggatcggttcgcgagctactgttgtgaaacattaaccgtaccaaccacaagccagcgtgggcaacggctttatcttttgtatagcatggttcattacggggtgccagactgagaagcggcgagaagtccgtgggggtcgctggggagtccatgcctttggtttttgagggggtgattataatccaggaatggtgcactatggtgagttgtgttgtgcgaagggtattgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggctggttgagcaatatttttcgtgattagtctcaaacctctcacaaatagttattgatgcaataactggtaataatttgtttagctcctggtttggagtttgtgcagcattggggtgctgttcagtgttgattaaaattgatgattaattactctactgttttacttctcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgagagtggagctgaagccatcgctagaccgttattccgctgctgttttcttttcttttgtgagtatgtaacgttattattatcatggattcgcatattgaattgtcagtttgtgtacctcggctgattcctagacgagggttttatgcacaaataagttcggaaattactagggaatttccgggcgtgacacccgacggccgcactcttttactgccaaccctatatgaaccctccccggacttacctcgtgcgtttccggcactagtcgcacttctgctcgacagaatcgatctcgcgccgacgtcctctctcttcgacgttgccatcgacctctggctgggcctagctgctcgccgggaccgtcccccacctcggcgtcgtctcctccggcttcgtcgcaccgtcgacgacctcgtccacccctccgtttcggtcgccgaccgccggaacgccgccgaccccgtcgactcgagccgnaccaccgnctnccttcacttcggncgnctnctcgtcgctgtcgtcgctccggggtgagccgtggaccgncgcctctttcccctttccctttccctctcttgggcgccgctccgccgcgcctatggccgncgccggcggccataggggcgcgggncgccttctccgacgggcgcgccgatgtagccggctctgggcgcaccgtgtggccaccgcgtgggggcctggccgtcagtcccccgtgc

SEQ ID NO: 18341 - DNA, 5198 bp, Oryza sativa
  unsure (1)..(5198): unsure at all n locations
ggggtgcaccgggtccaccgtggacgaagaggctgccgcgtggggcccaccactcccatggaccgggcccgcgcgctccctcccctcaactgacacaataaaccctattttttaattaaaatttaaatgaagaaatttgcaaatattcacattaagagcatataaacttcaaatggccatatcttggccttttgaactcagaattggaccgttcaagtctctaatttttccttaagaagtcaagaacctatttttgtgctttgtttctgcttgttatatggagtttattagagtaaaagcctttttctttctattggccgtgtagacgctgcagcttcagaagatccgctctacgtggaggttgaagccaacgtttgggaaagcgagcaaggcaagtcacatcatccttgagcatattgaatcccagtttataaaactattttggtttaaattattgcaatatcgttttatttaaattcccgtgttatcactgttttatttagccatgcctatttacctttgttatgaccttattgttattgctattgttatttattaccttgtttaccctaggataaacaaaacccccaactagtgggtaccctattcatggttccacgagcatgaatttaggtagatgcctcgctgattaattagacaacattaggtgattttataactttagactttaggaattctcatatcatttggacattatggaatggttggcttatgttggaattggacacacacctccccctctattcaatacccctaaaatggttttaggctgggctcgaggtgcatggttttgatagtagcatctcggccactataaggaccggtcttcgggcctctgttgcaaagcactaccgtacttccacatgtctagtgggtaaggcttagttcgtggctcagtctggtcatgggcaaaaatacacggatagggatggacgaagtcggggctcgatggacatctctagggcaaattaaggctacacgagctgcggcccggtagtcgagatgtcatggcacatggccggtgtcctgctgctaggggctcaaccttggttacctgtctcgggaatcctggccgtagccagggttgggtcggtactcttgtttatggctaggatggattgagaactatgtcacgtctttcgtcggtatgccgtggtggtatgtggcacatggttacacatgagaaagatgtgtcttgtgggtaaagatgtacacctctgatcaaagtataatctattcgaatagccgcgccctcggttatgggcaagcctagcaatgtacccaagttagtggtttaattcttaaaacatgcttaacaactaaaatgtggtatggttggtctgggttggcttgggacgagctaggacccaggtcgggttgtcagttcggtctgaatcatcgaaggccttgggttaaggcaggttcgtgtgggtacacggccttgattataacattgtgtagctctagaatcgtctttacaaaatagctttgggcaactaagtgacttttaaatgctgtttactgcaaaccctaacccctttattataactcccttgtactcctttgcatttattctgcattcgtgggtgtgtcttgctgagtaggtggttgtactcaatcttgcttaatttttccccagcccagaagaggagttcctggaggatgaaggctttggtgtctagctcgtgcctgccgtcaagtgcctgtggtcgtcgccctagtcttccgctgtttctcgtttatcttcgtgtgtgctgggccttcatcgctcatgtaataaattaactatttacgcttccgcttgttaaactctgaattgtatcaacttttggtgtaccttgcctcctgggacaaggagtaatacacacacgtatggaatgcccgctgggttaattccggtcgtgacaaaatgaaatcccgttaccaaatgcggggtatcatttgtacaactgccgtgagctaaccattcccctgcagaccatagaagaatctcatgcaggtggagtatacagggacacacacaacatggcaaggaacgaacgagaaagttcatcatcctcaacacccgtgcagattatatgaggcaggttgggaaccaactggggatgcactcggatggacccaagctccacgccacaacatcggtgtctcaagctgggcaagtgccagtgaggaccggtggcatgcgcctcatgacatatagtggggggacaaccaacctcccagatcaagtggagtacctccatgtccaagtgaatggcgctcgagttcctctcgttgggacttgggtgaaatcactaggagaatggacacccttgatgtgcagacgggggagatccaatacaacctcacggaacacatagctcagacacaagaatgacaacagactactaatgctcaatttgccaacatcaacaacatgatgcagcaacaacacgatgaccttcaagcatatttccgctttcagggattcaatccttaccaaggaccctgagcgaaagccaagcttggggggagacatctctctccccactgaggtaacttgtatcacattgcatatttccctttccaattgcatatttgctttccaattgcatcctataaacttgaaaacagacaagccggccccaaataaggcgtgtggaagtacgtatggtgcttgaatatacgtcaacatgttcggtccttaacaacccagacgaggctacttgcatcagggaaaatcaccgtcccgtcatcgccctatcacccgtccaagttaaagcatgtttccatattaatcattgagtgaggtaatcagattttaatacccataaatcacgggtggtgaatcaaaagtagacctaagcacggctaagcattcgatgatagaataaaccatcctaaccatttacaattgaaggtgacaaggttacagggcaacaatatattaaaggaagggaaatgcatgaaatcccttcttcctatatagtcctatacagttattactataaagcttgcaccatattgagccacgtcacttcctgagccgttggatcgtcctgcagatttcccagatgaatgtttcggtaatattgggccagcctaggctactcgttgaccaagcccctccgcttctccgagaaaagaataaaaacatagccccgtccatcccacatgctacacagcgccgcaagaggaagcgaggcattgacaggggttgcgagggagttgctaccatgcgcagctcgagctgccgcatcgccaggactcctccccttctgactcaaagtaaatcagcaataagaatcctcttcataaccgctttcaaatgctcctatatcaagcaatatacctcgagagctctgaatcaattgccttcacctcccccatagatcaactacgcgttgctggacaaactcttcttcctggaagcagatcctctgtgggtcccactttgctatggcccacatatcagtgactcaactgcacagcagttaagtcagaggatccctttccctcttcctgtatcgcttggatccacacaagcttctgccgtttagcacaggtacgcacactaaccaattatatgtgcactatgtgtttgataaaatgcccaaatgcacttgcatcagttgtatgccagtttttgttgttcggaaagtttctgataaaatacctacattcacttcccctgattttaggtctctgttgttggggcttgcatgatgaatcacaaggaaataccaagttaaattttgtattcacttatccacaggcacatggatttatctgttagcagttataggcagctttggccttgaaacgagttgctacaggaccctaggacgtcattggatatatatacaatcttggacaaaggtagaacaattatttaattattcactataagatctgcatagaaaattattggatcgagttggacacaaggatttttcctatacggtatgtatcttttcctatttttattagtttgtatcatgccatgtttccatcatttcttcgataatgcttgtcgccagtcgatcggcacggagggagacggatcgggcgctcgccccgcgcgcgcccctggcccacgtgctacctgttggcccacccacttctttctccctttttccacaaaaagatgtttcaactagtgtacttataatgcttcactatatatagatctaatatagctagcagtgaattaaaatactcttttgcaacaaaaaaaacctacatattttagaaactctctattaaggaaatttggtttatttttttccataaaaaatgtttcacctagtgtagtcacaatgtttcgctatgtatagatctaatgttgcagtgaacgaaatattccattgcaacaaaaaacccacatattttagaaaccccctattaagggaatttggtttattttttgttccaccgaaaaatgtttcacttagtgtaattacaatgtttcactatttataaatctaatgttgcagtgaactgaaacattctttcgctatttgctgaaacattgtttttatataaggtgtaacaacacccgatttaagcgagtgaaacattttcgatttacttagtgagacaattccgatatacctgatgaaacatcatgcaacatttaaaaaaatcaataataagctatttttttcgtcggaatatatccatgtgtggttttgttttgaagatttaattgcaacgaatttaatagtgcaatcggatcatgatttggataagtaatttaagagaaaaatcggtttaaagtaatttggtcagcgcccaatttcccagccccagatcggtcgcccgatccataggtgctcccacatttcttctctcatccctgtttatttttttatagattttagtattaagctctcacgcagaatgctcttggttaacatgtgatacattcttgaatgtgccaagtatttagtttacttaatcactaagctttgacattccaaaatgtcagcatgaagaagaaactttttttttaaggaaaggcaagaagattgccttatatattgatagagtaggggagaagaagaaacttgaaagtgtagtattgttcctacaaatttcctgtccaaatcgaaccatcaaatctatactaggtcatcgtattaatttgttgatgaactnctgtnccgtcggaagagccatcaaaanntaccagc

SEQ ID NO: 18342 - DNA, 2066 bp, Oryza sativa
tcaatatcgatatcgaattaattatctcagtgattggaccaaatctatatacaagttgtcttccagtttatgacacatacaggaatatacttaaggacatagtacctgcaatgatctaattatttcaacaaatatataatttatgtaattatctttttcttggatatatgttttcaattactaggaatcatgtgatacggagaattttgttccaagattagtacaaataaaccctgccctttcatctattttcttcctaacttctccttgcaatataaatattaggcagcaatctaacattctgttgataattttctacatggtatattaattttatctctctactataaccaggtttggcaaactattataattgttgtcaatagcttgactgtttaaaaaaacatgtgaaagattactcagtaattcccgccgcaaagcgcggggtatcacctagttggatataaacaactctacccgttaccgacattttaaggcaattcaactcatgcatatatatagtttttgcaagcaaataagttttgtgaaatcataggttcaatatgcatagacgcttgccttgctgctgtgtgaactcacactcaacctcggagtctttgctgcacgtactccgaattctccgaatctaccgataagaggcaaatatgcaaatatgattcaaataaacatgcatatgcaacatgctctataaatcatggcctaattacagtaggtagagagtatgataaactggttttagaaacaagaatcatctcatttacatttgtggtttgagagatataaaaataacaagccatatacactgaatatggcatatctgtaattacgtaagaactaccctatgtcatataaaaactgacattttctagctagttttaacaagctaccattttcaagtaatggagcataactcactggttgtaacaaaatttggttcaccacatttggagttaaaatatttagttataaattttacaactttaataaaaagaggattacttaatcgttttactttaggaggtagttttgtcaaattatttcttttcagataaaagattacatatttataaggtaaccaaaagtggtttcataattttaggatatagcataaagttcctagagattatacaactcctatgtgcaaaaataagtgtattttatgaaactcacaattttagtgactttttcagtaccgcagttgtaatgttttaatttacaaacataaagactacaaatttatgaacacatagaaatttggttcactcgtaaatgagtaaagatgaattagttatggatttttgaagttttcctagttctcatatatgttttcgattattcttttggactgtacttttgcatgtcgaaccctgggatttctaaaactttcaaccaggtccagcttttctccacaagagcaggaagcagcgacagccatggctgagctcgatctcaagctcgatctcaagctcgccggcggcaaacggcggctctaatgggggcgaggtcaaaagataaaatgtagagcaaaacattgcgattccattcctcaacttttccccagccaatggtgactgcaccgacgcaggcagcagctgcaattggaagcgctcgggacgccatgcatgcgtcgatgcgtcaaggtggacggctcgatctattgcatgcatgtcaagaacatcacatgcaggatgtagaacaccacctaaggttgctactactgcaataaatcgacaaatggctcaccggttgaacgggaatcgacgacggaggcactagatcggagttggagaagacggtggttgatctccctcctcgctgcacggttctgagagattcttggggcgttttggagagaatggtgaggcgaagctggtggcgcagtagctcaaccggattcgcctcgaggcgacgggaacagcggcgcgaacccacagctgcgcgttgacgacggtgtggccgcgctccagagctaccgtggcgaggtcggcgttcccagagatcggctccaagaaacgaggtgagatcagacagagcagaggctaccg

SEQ ID NO: 18343 - DNA, 8311 bp, Oryza sativa
  unsure (1)..(8311): unsure at all n locations
cgtggtagactaggtaagggtaaggagnatggttaganacaaagtaaaccgatgttttattcagtttacaggattttagatttttctgtctctttctttgaagttcaaattgaaagttagaatgatgctaaaaattttgatgatttttttggtaataacctatgctacccagattccatttctcaaaatttcactcaaaaatttgaaatattttaattctgacaaaaagatgaaaaggggtatgttgagaactaaattgaattttgaggtcaaaactaagggtaaaaattcttgaaaaaatatattaactcttgataagtactctagtatttgaataaattatgaaacatatatccttcagttcaactttaggcacatttagatgtttcttcattttaccaattaggtttctaataaatttagtttgactaccttaactgctttacttgaggtagtaaaaagtttgataaaatcacgaaaccttcatagtggttatcttaggttggctaagtgacaagaggatcttcatggatgtgtgttgcttagatttgttaaatagtctctaggtttatttaacatgcatcaaccaaccaattatgaacggcataaacatcagtcaagccaataaattagacttcactacaaacaaacaagtacacaagcacacaatcactcactagttattaattctactagccagttgctaagcatgatcgggtagattatccaaagagcgaaagattaacgactatactacaacgtttcttaactaccgcttgaccatttaatttggttatatacaaagaggcttggacaaagcttagaagctaaaaagtagaagactccaaacaccagagcttcatggattatctagtattgagtcagcttggtctcttgaaacaatgttcccctcgtggaagggaaaacacaaattagccgagctacgcctcaaaagtgttgctagattttattagcaccaaaacactctctgaacgctggacgagtcatttaaaaaaatagttttcgtttatctaccaaaaaggttgtagggtcattagtctactataatgatcactaaagtttcatattaactcaaaccaatagtttgggaaaatggtttcaatttctatccatcttttttatacacaaattaaccagatgaggtttttgaacccaaatagctttaaaacatccaacttttactaaggacataccccgatttccacctaagttgattaattaaaacttccggatgttacacttttgggctttaatctctatcaattgattaaggtttttccgttattagtaataacacagagcatcttgtcaaattcataactaaatagtcgaagctccattttaacccattcaaattgtagtaaattcattaaaatgtcaagaatccactaaaattggttttttttttgctgtttcagtagctttttagcttgtatttattgtgtgccttgtttgtcatttggcaaaatttgcaacaggacaccaaaaaattgcggcctttgctgtgagacacctgaagatcatgaatcttttcttggaatatcgtaaaaaagtggtaattagatgctggacactcctcccattattttattattcccaatcaaaatggagagagaaagagttatgtaagtaccaaaatgaccttgctctctcttcttttcttttcccgtcttcttcctctcgcttgctactgagccgagcagaggcgcgatgcgcgcagccaacgcggccggcccgagccgggacggctcagccatggcggggcagcggcggtggcacatcgccggggttcactgccaacggcgacgacgcacagcggcatcctggcgcacggcgcggcaatgcacggtggcaccgatctcttggggagctcggcggtggcgcaatggcgactgggccggcacggatacagcggcgcgtgcctcaaatcaatggggccaccgacttcttggctgctaggagtccacgaaggcattctgcgcgcctgaagctgttgtcgcggtgccagtcaatgtcgacatagatgacgcacctgaagctgccgaggaactcgtttatagggagcacgatgtcattgacttagcagaagccattggccttgcacgcggatgcatggtgcatgttgcccgaccaagttgatggcgatgtcgaaggcgccgtcgacgagcacgcaagctgcagcgagctacccacgggcgtaggcgcgcaagtacttccagaggcggtcgaagncggggcaatcatcatcgccactgagtaaaccgatgccgtggtcatcctcccccttctgccgaagcgcggcatcgttgacgtagctctccgggatgaggtcgcggaggcggcgcatgtcaccgagcatgccataaaagccgacgaggctatgcgccatggcgacgcaggtgggcctgggtcgtagtagtagcacacccgccgctgtcgtcggtgcacgttggagaccattccagcatgcgcgacttgccgccatgggcccgcacgcctcccacgcttctcttggtcttgcccgacgatcgctctccgcaccacgcccctcagttcgactcgcccgtccggccgtccttccagctagccactgtacgtgctatctagctgttgcagcacacgcatgagaaagagagaacatgaagaagatgaacagagaaagagaggaagaagaagaacagagaaagatgtagcacttcacctgggagtattccaaggtatcgattttccatagggaaagagtgtgctcagctcttctccatgttcatccaaggacacgaagcaaacatagacaacgagtagagaggatttcctagtgagaaatagtatctacggaaagcttaatttaatcctatagcggtacttcatgcacatgcttgctcgctactaccagaacatgctctattccgtaccccgacaatgaggacttaagtgttcttgagggctgtcaccacctctacacatacctctaactatttgtgggatacacagcaatcactggaaattaatgtttacggtctttaaatcatagtttttgaccatcaatacttgcatataatgaaataaaatatggcatccaacttagtggtagggtttattactaatcattttcactagtgttggtgaaatatgtgtatgcaggtattttgaggagaaaacacatccgtcatgcgacaaaatgcacctttgcacattcaggacgcgtttacacggattggagggcccatatgtcaaccaaaaccacttagaatggagacaaatcaaagtacatgatgttgggggcccaataagctacctaccagccaaaggagaggtcaggaagagggtttttaggttcagtcgaaccaccagttcggccaaacctgtttcgtggccgttgatcaccagattgcacgtttttgcttaaccaaatatatctttaaatgaaaaacacaaaaaagttaaatactagagagggatgttatgcaagttagttttaggaggtcccgctaattatattttcctaggtttagcaagttattaagaacataagaaacgacatgatgcatgattagaaaatagttaattttcatgatgttacaccatgccaactcaggcgagttgtttggttatgcacacatctcgggtgcaacaaccttgtaccttcaaggcgtgatccatttgtacaatgctgtagagtctacgctggccgccactgatcgttgactgcccacagctggcgccgacgtcaacgttgtgccgtgtccgtccttctttacccgccaacactcccggtgtcgccgcgtgtgcgcgccaccatggatacccaatcaggagacgaggccggcgccgttttcttttcccctacgtagccggtgccgtgccttcctcgtcttcctccggcaaattgacccttgtgaaccaacgtccgccgcctataaatagccggtgaaccctccccttttctctattcaaaacagagccgagctacttgagctctctctctcctcccatgtccggccgtcgccgccgacggtcgatctcctccaccatagtgtttctatccttttccttgtgccactatgttggtctccctccggcgaacccattttaccgatctcccctttttttccccttcactttaagccaccaccatcaccacccaaactggccggagctgagctcttagctgcgccgttccagcctcctctctcacttccactgccgaccactaccttccctggatgtgcgccgacggggaacacgttatgttgccggcatcgccgcatttcggccaccagagagccagcgccccgctcgccctctcctctctctctctctcggctgccaaagaaaaggaagagaagaggcaacgggaagaagaagaagaagaagaagaagaagaagaagaagaagaagaagagaaataaaaaggaaaagaaaagaagattccctgacaggtgggtccctgcacagtgacttaactcattttccccatttaattcaaaacccaatctttagaaacccatatctcctaaaccgtagacccgattccagtgaaacttggacctaaattcatttgaatccaaaccctatattttgataccaattttgctattttactatttggacctaaattcatttgaatccaaaccctatattttgataccaaatttgctattttactatttggacctaaattcatttgaatccaaaccctatattttgataccaaatttgctattttactatttggacctaaattcatttgaatccaaaccctatattttgataccaaatttgctattttactattttatttgaaattccttaatgccatttgaatgtatatttgattttcaaatatttcctttttacccaaaaaatacccctttagccagtaaaaagccgccgattggaactttacaccttccatgcatggggacatttgtggtccactaggccccgatgtcgaaccgttggttgtaaagcccggcaaaaccaaacctaaggtcgaagtgttgctcctagcacctcacgcctcgatgcgtataacggagcttcactaatccctcgacctccacggcacgccgcacagttagctctcgggctctatgtgatcctaaccgctctgccgccactcacggttgtcggagtaacacttccgccccgctaaatcagcacaaacctcctatccatctagctgttatgctctctctgttgacaccggctagagaagataccaaatatagtcgttatgctacccaactctagcaacgactagcaaacaaccaaaccctagccaatactagccacatttccgtttaatcagttagactatccgctataccccctactatccatcaaccaaaacctgcacatgaaatataagcgaccctggttgcttaatcccatctagcctccaaccctctagaacctccacataaaatattagcccaataatccctatacccaataaaaatgagatatttatacctcaaacccagcctttctcgctcttcatcgctttcttgccatttcatgatttttattcaatttggttattcctctttcttagtagagtctattatcttttggatggcaactcgtggtatttcgaggatcagataatcaggttgcctatcttagatttatttgcgttggagtaaggcaagttgttattcctctcctttgagcatagatgccctatattctatatctccgatatctcatgcattagtcatacatgatttcgaatgcataacctgaacatagcaaaccagatgtgctagcttttgcttagccctgcctagttagactgcataaaaatataatgaacttatattgggacagtacgtaggagttggttgatctccgggtggctagtactgtctcagtcgatataattgttaccaaatacttatgtcaaatgaacgagtacgaccgcagcttctagaatggggacagacctagttattatgttaattaacaatgtggtacctctgtatagtggttctatttttaagtcctcgcgcagtaggcaaacttatgccgagcagggcaatactgtgatatttaccgaggcgcaggtaaatatatatttgagataaattgtgatcacgtttgtgaaccctgattgcgatgacatggtgtcatacaatcagttctctctaaagacctcgggaacgctagaactcctctcactgctgataacgtcacgttcagagcgcatgaggactcaagttcatggaacaggtgccattattgttagtaacctaatactgggccatgactaagctaatgattattggcaagttatggactgcgggtaaagcatacatctattacagtagagtatttatgaaagtattcaaatagccgtgctaacggatttgagtatcaaggctcatatgtttagaaacttaattccatattttattaaatattgttgcatcaaaaacattgcaggctttctcgctctttattctcagctttctgcaattaaacctagctctactcaaatattaccatttcatacattcattattgaatataatagcttgctgagtacgttgtactcacccttgcttcaacccctttttcagagtccatttgatgtttttgccgaagctgggagttcaatcatataagttagtctcatgtcaacctagttctcaagtctagattagttagatggtttaagtctatagtaaaacatcaacgtcgagtccttctatagcctctgctggattagttagccacaagcttgtaaattcccctattattttatgtaataacgtctcctttggagccttgaccaagtgcatgcgatgaagatccagattgttgaacctgcatcaatctaccaatccagggcttgatacagttaaacatgtcggtttccaaatcattagttttgggacccgacatatggtcaaagtgccttcctccgctacaatctacattgagatggaggagaaatcgacaatcataggtgaccatgccactgccccagatattccaatatatacgtcatgctggcgctaagtacactaaggtatgcgaaagataaaacaaggttcaccattctttttactcaaacttatcactatgtgaatatggcttgatcatatatgttatgctccttatgtccatttttgtatgacttgatttgggtgtattatcgatgtacatccataggctttttaaattaagcatggtgctgttaacgaccaaatttggtaatataagcatcggaaaagaagattatatcgaagtggagtcgaagcggagatcgattcgagaacagagcaagaatcggctggagtccagatcggctacgattaggattggctgggtccgaatcggactaggtaagccgatgcaacggattccgacaatacgacttggtgtacaacatcgggttgagttgatatgcttcaagatgattaccgcacgtggatagagtcctgagaaggcaattgtatctattaattaggatgttttatgtaatttccttagagatatgtttagggcaaaagtctaccgtaaagacttatggtatcttagagtttgttagagataagagtcgtgtccgacatggacatagtttgtaattttcgggtataaatagaccccgaaccccatgtaatcaaagaacacacacgttcaatacaatttcggcgcatcgccatccttttgcttttgttttatttcgacgagttcttgctttcatgttgagctgtatcggtttcgatcttcaacaagaggtaaaacttgttatgacggcttgcgttctcgggattagtgcttccatctttatgatactctaatcttatttatgtaattcgtcgagttaccatatatcttacataatctctagaaatatcgccatctaacccacaatcggctaacatctgttaacagagggcagccgattaagttagatatcgacgttggtttagattatataagatatctaccactctatgaaacttccagcgacttgattgtctagaaattggtcttcttttcatacttaaggctgcatcagttgagtttgatttattaagtcgtgcttagaatatcaatctatagccttgcttcttgttgccgattagggtagtattggagtttcagccgatcttacctgatgtatctataattgctctattatgcttcattgacacgttaaatctgccctttatgtcaagaatttattggatataagtttataaagctttgtttggtatattctacttgcttaacatcttaacatagagtcgtatcggagtatttacccaatacttgc

SEQ ID NO: 18344 - DNA, 1459 bp, Oryza sativa
taagtatattaagcttctgtttggtatattctactgcctttaacatcttaacatagagtcgtatcggagtattagccaatacttgctagatctatctgatcggctatgctataaacatatatagtcccgttattaatatatatttcgatctaagtgatttatactatctcggcatggcgaccgatctatcccaatcacttgatttaagtatatatcgatataagaactatatattgttaatatctacagccgatcgacaagatctagttctttattatctagttataactgccgattgatttatatatgacatcggctcaaagataaatgatatgtcatcggcatttagccgatcggctatcgtttataggtttaaccacggtttctttgtctttatttcttgttgattgcaggatcaaattaactggcacgctagcatacccgaaggcgagttttggacctgcattggagttaagcagatttcccaggcctcgtgttttacgtcaacacgcttttgggacgcctggtgggactgattaggagtcagacaagcagttttcttcatggccgagaaaccaccgccatcaccgtcctcggctagcccaggttctgttaaagaaaagattcagaagttaggtttgttagacgttaatgaagggaacatcatgaccatcgatccagaaaagttcacacctgatcaaaagaaagattttgaagagatgatgcagcaagcacgggatcagttcttgaactcattcatgcagacccgcaagggaacacttgttcagaagtataaaataaaggtagttgctgatgatcccgggactagttcttctaaggatgaagaagggaaacaagctccagatggcttggctcaaccaagtgacaaaggtgccacatatggttttccagcaaatcaaggtgacaactctcaaggagtcacggggttcaaggtgatggttctcaggggttcaaggtgatggttctcagggagttcaaggtggaggtgttaatcaagacgacaatgcagcacagttgcagttcaacaactttcaagatcaggttgactatgctgtacaccatgctttgatcaaccaatctggaatattaaccaacactttggcaaacatggtgaagtcaatggttgatggttcaatggccgagtatcaagctacaggaccggtgtacctaccaggaggagtattccctaattatcgaccaataatcactgataatcaaccagtcgtccagttaatccctcttaatgcaccatcggctcagccgacggcaccagtatcggctcatgcacctgctccaacactttcggcttcaggccaagtaattaatccccgattgttggtgagagaacagccacagcacgctagatagaatgtgaatcgctaacgcaagaccaggttgcatctatgttcttacctcctcaacacaccattgatccaat

SEQ ID NO: 18345 - DNA, 1199 bp, Oryza sativa
  unsure (1)..(1199): unsure at all n locations
ggcgtgtcccttttgaatgccncatgaccaccattggacagacgncatcaaaatgttcacatccacaaggcacgattggtggtgaaaggtttcagacaaattctcgccagttgccatgctaaaatctattcagattgttttagcgattgctacctatttcaactataagatatggcaaatggatgtcaaaacagctttcctcaatggaaatcttgatgaggatgtgtacatgacacaacccaagggatttgttgatccacaatcagctaaaaggatatgcaaattgcagaaatccatttatgggttgaagcaagcatctcggagttggaaaatttgttttgatgaagtagtcaaggtcttgggctttgtcaaaaacgaagaagagccttgtgtatacaagaagattagtgggagcacactggtgtttctaatcctatatgtagatgacatattattgattgggaatgatattcctatgcttgaatctgttaagacatcattgaaaaatagtttttcaatgaaggacttatgggaagcagcatatattctgggcataaggatctatagagatagatcaaagaggttaattggattaagccagagtacatacattgacaaggtgttgaagaggtttaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcgtatatggtatgctatgtacacgtccagatgtttcatatgcacttagtgcaacaagccgataccaaggatatgttcctagtccaggtgagagtcactggatagttgtaaagaatattctgaagtacttgagaagaactaaggatatgttcctagtctatggaggacaggaagagatcgttgtaaatggttacactgacgcgagcttccaaaccgacaaagatgattttagattgcagtttggatttgtgttctgcctgaatggaggcgctgtgagttggaagagttccaagcaagatacagtggctgattctacaatagaagccgaatacattgccgcttctgaagcaacaaaggaggcttgttggataaagaaattgtttctcaactatgtgtgatgacttgtgcttctaggcctatggaccctctatg

SEQ ID NO: 18346 - DNA, 1023 bp, Oryza sativa
  unsure (1)..(1023): unsure at all n locations
aaagaaagtaggggattaggacttacccaaaaaggaaaaccaatgcggtgctgttttaggaaagaaaaggaaacggtcccgcgaactgacacgtatacggttcgtcatgcaaaacgaaaccgcggactgagaggcgagtgaattgggcacaattcacgaccaaaggcaaaggaagaaaaattaacttgacacttttaacttagcaacattgcctctggtaatctgatatttactctttaaatcctgttagtgattttcagagcaaagagaattagaaaaaaattctccctgacaattccaattattaaaagtactgttaactggggttttctcctggttaaccaaagcaaattcttgagatcatttattagtgatttggaacctaagggaagggaaaactccgggtgtgacagggtcgttcgacatcatcgacacctcgtcacacaaagctatcacacttcgtgacgacttagataatttgttcaaggtaaacggccaacatttaaaaattttccttgagtggaatgaagttttcgatgaagaagtagacgttattgaactaatcgatttcgagcctcaatgaactcatctaaaatttgcttaaattctgtaaaattgtatcatgtcttgcttgaattaatttagtgtagacgtgtgaaaaatttagaggccgactgagcccaccagggttcggncaaaccacngngnnnnnntnnnnnnnnnnannanaannnaaanaanattnnaaaaaaatattaaaaattaaaaatatantaaattattatattattattaattttttttaatatttattaaattatataaatatttatattaattatttaattatatttaatattattatttttttttaatataatatatatttatattaaatatttttaaatatatttaaaaatattttttatttttttaattataattaatatttattattttaatttttaaaatatattaatttatatttaaattattattattatttttttttaaataaaaatt

SEQ ID NO: 18347 - DNA, 4035 bp, Oryza sativa
  unsure (1)..(4035): unsure at all n locations
tggggtcnnaattgcttgatttatcgtacagtagttcatcatggaaccctgtttagtgtgaacgcagctgtctctagagcgtaaccccaaaagcttagcggcatatcagtttggctcatcattgatcgcaccatgtacaataatgtacgattcctccgttcagacaccccattccactgaggcgttcctgtcggagtgagttgcggaacaattccacactcctttatatgattgccaaattcaaggctcaagtactcttcaccacgatcagatcatagatacttgattgtcttgcccaaatgattttgtacctcattctgaaattccttgaacttttcaaaggactcagacttatgcctcattaagtagacataaccatatctactaaagtcatcggtaaaggtaataaagtacccaaaatcacctctggcagttgagctcattggtccacatacatcagtatgtactagtcccaatagttcacttgccctttcactttgaccctgaaatgtgcctttatcattttgccaagtaaacaagattagcatgtctcaaattattcaaaatcaaaagagtgtagaagtccatctctatgaagcttctccatgcgtttctcatttatatgacccaagcgacaatgccaaataaaagtgggattcaaatcattaggacgttgactttttgcattaatgttatagactgaacatctttcaagattcacaatgtataacccattcatcatgggtgcatggaaatagaaaatgtcattatagtagactgaacaaccattgtccatagatctaaaatcataatcctctgcttgcaaacaagaagcagagataacgttcttacacaaaactataatgcaataataattatttaactccaaaactaatcatgaaggtaaagataatggcatagtgttgaccgcaacagcagcaactcttgctctattgcccacgcgaatgtccacttcgcttcttgctaagctcctacttcttttcagcccctgcaacgatttgcatatgtgagcaactgacccggtatcaaatacccaagaatcagtagaggaagtagcaagattaatttctataacattaatacctaaggtggaactcttaccatcctactgcttctgcttgagctgctctaggtatttcttacagtttctctaccaatgatctgtctccttgtaaaagaagcactctgtatccttagcgggccctgtcttttcaaccttggtcttagagttgctagtactcatgatctcatcagagtttagctttctcttttgaccactcttcttgttgttgggcttgcacttatgcataaccatcacatggttggagtttttcttgatgctttcctcggcagtctttagcatcccatgcaattctgccaaggaactgttcaagttgttcatgttgaaattcattatgaacggctcaaagctgggagggagcgactggagaatcaaatcagtagccaactctcggctaagaggacaaccaagcttatccagactctcggtgtaaccaatcattttgatcacatgtaggctcactggattaccttctgcaagcctacacgcaaacaaggactttaaagtattaaacctttcagctcttgcttggtcctcaaacatgttacgtagtcccgtgattatcgtatgagcatccaatgcctcatattgcctttgaaactcaggggacatagtagcaagcatgagacagcttatatcaagataatcattgcatcgcttttcatgctcgctacgttgtgcaacaggagcattgttgggcaagtcagctggaaaaggctgtgtaagcacaaactctttgtgctcttgtctgagaacaattcccaggttgcaataccaatccatgaagtttgttccagtcaactcctctttctcaagaatagaccgcaagttaaaactggatagtgcaggagctgccatgatctacaatagaaatatatgtatgcaaaatcagcaccatgtctacatttaacctttcattaaacaatttaacaaaagatactcccattatgtattgtgaaacgaaattccctctagtaacatagtgagtcaagatcatcattttattagtgtctagtgagctttggcatcacagctagacaactatcaaaataggtaagcaacaccttgctaatcacatcatatgtgactcttatgctgttggggtgacatctccatcttcaacccaacctatgccccaaggtccaaaaccgtttcgataaccttgtcaagtaaaccaataatctccgcatatagatgtcagacatctatcctattttatcatgataaaaagtgatactttgctatggcaaacccatcacttatgatcacaaccgtaataggtgtaattattggaagagcataaattacacttaatttttctgagggaatcaatcctaccatgtcatatcaaatatacaacaacaataaagtaagatagatataaaaccccaagcaaaatctaaggggcaacgcacacggcggtcccgctatgattcgccatgtgaaaaccttaacggcgtaatcaaattatgccgaaaccgagtcaatctcattggctcgtttttctcattggcgtgcggttccagtggacatcttactacccgatgaacacaatcacgctcggccttggtgagtactagacattccagtgaagtcaccaacacacataccgattgatctcatcaacccatgcggctattggttcatctcatgttccgatcacctaagaactcatatacaacataatagatctcaactactacacccgcatatcaattatatgcagtgatctagatcataaactatacaaggaggctctgataccactgttgggatacgcgtaggctacgatagcataaatcaaaattttctatcgcgtaaaccaggaaccatgcaagtattagatcatagatcgttaccactcgacgcgctgcgcagaggaaaaaggcgttaagaagtcgaaggaattctcgcgaagtagcgcgcgtcgatgtagaggaagtagtcgatcgcactagctcgaccttctcctccttgtgtgttctcctcgccgtactcccacgccgatcagcaccgcaaaccagcggcgcctctactagtatccacacgtacagggacggaacgccacgcgcagatgtgctagcacccgcgtgcggctagggttttgctcagggagggaagtgacggctagggtttctcacgtgatgaaatatctccaccggtcacacccctcacgaatatatataggatccatcactcgggcctccaaggcacgtaggactcctattcggatcccaatccaaattaagctcatattgggtctccatccaatccccttatttcggcccattaagcgtgcgaccctgtaggttcatgtatactcggctgtaacttggaaactccttctcggtccacgcgccaatagcggcccctagcagaacgtattgacccaccgggcatacataaagatcatatcgactgaacctctagtgtatacttgtataaacccctttgtctcacgatatcgattaagctcaaggctagatatgtgccatcctctaatagctcaatcattcactcgaacctgttgatagattatataacttgtgatcgattcatcaatcacctttggcatggcacatgcactttcacaatctacaacatcgaggggcccagagatatctttccataggaggggcaaatcccatcttaattattcatatcccaatacatgtttcatagcatacccgaaaactatttttataacaacccaattacagagtagcgtctagcaatccctaagtaagctaatacacatgttgagaaccatgataatctcatgtctaacgattcaacaccaacactaaatgagatcactgatgacacaacacatatggctcttgcaatgtctcatagtcggtctattcaacaacatgttcactaacatgtgtccacattattaattggtatctctataccatgatccatgagaa

SEQ ID NO: 18348 - DNA, 834 bp, Oryza sativa
  unsure (1)..(834): unsure at all n locations
taagaagcactgttggagaacccttttgtagtcccggttcgtaacccccctttaggtccgggttttaaaaccgggacctaaagatcgctatcttaagtccggggtgaaataccgggaactaaagatcgatctttagtcccggttggtctgtttgtatgcatcgatatgaccttttgttttgcatgaccctgtggctgcatggtttatatatataatacatataacccatgcatatatatgttccagtacatatatgcatatataatatatgcatatatatatataatatatatatatatatgtatatatacatatgtacatgcataatatatatgtatatatgtatatatatatatatatatatgaccaaaatatatttacattatagaaaatgtgtacacatgcatatagaaacatatgtagtcatgtattaattacaatccattatatgtcctagctagctatgatttcgacgtagtagtagtcgctagctcagaagctaaggacctatgaattgtgtttccgtcgtagtagaattcacccttgggatcaagaatttgttcgttgatgaattccatgagttgttcttgaaccgccgcgataaattccttgggtgtggtcaggttatccctcatgcgaataaactatatgaatgtatgaaattgattagtaattaaacaagaaatcgatacgtaatgaaattttgaatttatttgtacgtacatttagctctcttgtggtgatgatttggtctgcaaggcagtggcaatactcgcacacgtaatagccacacaagttatgatgngctactgcacatctcatggtcatnncaca

SEQ ID NO: 18349 - DNA, 772 bp, Oryza sativa
cgcgatcgatgagtctgcattctactgcagtggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtttgccacgcgacatcagtcgaagattctgtatggaaatgggcgacgacagctccaggacattgatcttgggagagggtttgcgcc

SEQ ID NO: 18350 - DNA, 759 bp, Oryza sativa
  unsure (1)..(759): unsure at all n locations
cgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtaccatctngtaggcgaatccaagaggnccca

SEQ ID NO: 18351 - DNA, 1096 bp, Oryza sativa
  unsure (1)..(1096): unsure at all n locations
atgtgnattttgatcgcttgctatgcagtatttcatcacttagacatgaagagctatctgaactggtcatgtttgctgtctgaccaccatctttggtaaagcagctgtctggcttgttcaccacaggaggttcactattgcaagcagcttgattattttcactgctttcacatggctgatctgttatcgatttgcaagcttcttcagatctatcagaggaagcttcagctagttcttcatgctccgagccaagtatttggctacaattgacaatatcctttgaacaccccacttgattggatcgatcaacaccgctaactgtttcagaagaaccattcgaactccctaagctagctttctttctagcatccattggctcccatacttgttttggagctgcattcttgtttggcgtactaccaactcggcttccttttgacactatgaagctatccaatggatagcacctgcggtactgtaaccagggcttctcaaccattgttttcctggacatcttcatctctctacttgatctagctgttggagaaaaatacccataatcttcctgctggccacaactgcaggcattgtactcatacctttctcttgtccggttattcgcactgaacaaagagttgcagcctctacctgcattccttgccctctccctagattgccagtgaatatttccaacacccccagtgtcatcttggcaatcttcataccaaaaaccagtggtctgttcttgaagggaatcccttctaaatctgagtttcctccttgaggatgtagattgttcacacatgaaagaaccattgcaatctgatggaataaattccagtgttgtactgcaatgaaactcattgctttgtccatcactttcccttgttagagattgatcaacacaggtatcaggagagaacgattccaaccaaggatcaactagctgacatctttaccaagcctcttgatgaaacccgcttttgcaagttgaggaatgagttaattgtcatagacttctctaatgtggcttgagatggtgcaccattgatgaactnctgtnccatcgagtagatgcatgcaatcaaaannacac

SEQ ID NO: 18352 - DNA, 83031 bp, Oryza sativa
  unsure (1)..(83031): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagaagctgaggaagaggatgtaagctcatttcttaagtaataagattaggatgatcagaacatttgttagtccatgttgatggtctgccaattcatatagtctaatttgttatacatgagcaggaagatgatgctatggacagggatggaaatgatactgatgtcgatggtgttcatccacagaagcatgctaagagtcctgaacttgccagagagtttcttttggatgctgctgcagtgatattcaaagaacaggtagtgtatatcatgcaatttctaagtcctaatcactaaaagatacatgttttttttgtgatattagctgtatatatagcaaacacttttctaaatttatgatctgcgtctgaagtatcattgttgttgtatacaatatcgatgtcttctgtgtaatatatatactaggatctttagcatatgactatcgcttcagtgtcattaagatgtttagcatttactgctaagttatgaaaatatgacatggtattctaaaagaactttttttaatataaaactacccttttcaaaggatgattttctttgtggtctagatgaactaatctttattcatactcatcacaatatatgtaatatatgtattgtattagaatagccaacatagttgattaaatcatgcgacatagtatgttcttaactagttcattgaactgtttatgacattagatgattgtactcactctccagtgtatagatagattgtactcgctcttcaatgtaccaaacattcatggtcaatgtaatcagcacacgtgtcaagctattgttgtttcctcttttctttttaagatagtcgtacttaagcctgcagcatcatctcgtgttgacataggaaacattgtttttcctgtgaaggttgaaaaatctttgagggaagccacggcacaacaaaatgcacatagcgtatttgtgtcccttgcattaaaattgttggaagagcgggttcatgttgcctgcaaagaaataattacattggaaaaacaggtgagctacacatactttgttgtgtagaagaagagagagggagcaacttttgttaggatttgttgtgccttagttgacatgtagtaaattcgattaacttgccttgtagaccaagcttcttgaggaagaagagaaagaaaagcgtgaagaagaagagcgcagggagaggaggagaacaaaggagagagaaaagaagcttagaagaaaagaacgtttgaaagaaaaggaaaaggagaaagaaaagataccagttcaattgaaaccttacattggtacctcgtcatcacccctgagcaactcagcaacaccaattaatgatcagtcaccagatattgcccactccaaatactcagctagcgatgatgaagataaagatagtattgtggtcacggaatcgttctctcctgatacctgtgttgatcaatctctaacaagggaaagtgatggacaaagcaatgagtttcattgcagtacaacactggaatttattccatcagattgcaatggttctttcatgtgtgaacaatctacatcctcaaggaggaaactcagatttagaagggattcccttcaagaacagaccactggtttttggtatgaagattgccaagatgacactgggggtgttggaaatattcactggcaatctagggagagggcaaggaatgcaggtagaggctgcaactctttgttcagtgcgaataaccggacaagagaaaggtatgagtacaatgcctgcagttgtggccagcaggaagattatgggtatttttctccaacagctagatcaagtagagagatgaagatgtccaggaaaacaatggttgagaagccctggttacagtaccgcaggtgctatccattggatagcttcatagtgtcaaaaggaagccgagttggtagtacgccaaacaagaatgcagctccaaaacaagtatgggagccaatggatgctagaaagaaagctagcttagggagttcgaatggttcttctgaaacagttagcggtgttgatcgatccaatcaagtggggtgttcaaaggatattgtcaattgtagccaaatacttggctcggagcatgaagaactagctgaagcttcctctgatagatctgaagaagcttgcaaatcgataacagatcagccatgtgaaagcagtgaaaataatcaagctgcttgcaatagtgaacctcctgtggtgaacaagccagacagctgctttaccaaagatggtggtcagacagcaaacatgaccagttcagatagctcttcatgtctaagcgagggagacagagatagtagcatgagcagcatgacctcattgagtgctcagaatccggaatcctcgtctacttctgattcagaaggatcttcagaaaggaacaatagcaacccaggcaatccaccaaccaagaacggttcgcgttcattacttgaaatgtgcgcaggaaatggtttcagagaataccagccacagaatattcacccttctgatggcaatcaatttgggtttggtgtgacccctttccaggagcagctgttacatcagcaaaagattcatgcagctccatacccgtcaaccttgatgggtttccataatcatcacatgtcagttccaacaaatggatacctagcataccctcaacctggtcatttctacccaaatgctgttggatatggtgtggctggaaaccaatgtgttgacttcccaatgcagtacagtaatgtgcatccttatgcaggtcctgaatttggttatgtgcctgcacagccagtccataagactccggtgaactttaatgccatggtgccaactgctgcgctctttagaaatggagcgccagaagtcataaaccctgtcattgtaaaaccagacaggcagcatcgccatacccttcctcctgagccgaagcgggtggatcctgatcctcagaacggctgttcagaagataacaagaagccgcaagatggctctgtgcctttctcgttgttccatttcaaccttcccatatcctcgcctgcccaggcatcatctgaagacgaggtgagtggaggatgtttggcgtcgagatcgccaactccaagtgctcaaaaagctcagccttgctcaagggaggagaccaacataaaggagtacaacctgttctctgcaaggactggagtggaatttcccttcttctagacaacagacgcgcctattatttggcacagaacaatacatagcgagtgatttgtattctccaaaaaaacaaaaacaaaataagttacctcgaggtttttaccgtgttccctcgaatatttatttatttcttcttccatttgttttggttgcccttgtgtgtaaggaaattgcaaagatagtgagtggtatagtttctaaattttgagatatgttaaatgtttgttgtcccgttttccaccgttgcttttctaccgtattactatgtttgttccagattttcagcaaaggtggtacgtagattggtggacgctgttgacatgttttgctgtgataaatggacgcatcaagttcaattggtgggtaccaaccatcacacaatcttccatcgatcgccgtgaatttatctgctgaatggttttcttttttttttttgagagggtacaatttaggacgctcacgaacacaccacatcacacgcttgcgcatccctaacacgctagaattgagattggagacgtggaaacgtacagtcccataaacatgtgtaccctcccggtgcgaaacctgcgccgagtagcgctagaacgtgggtggtgagcacttcaccgagccatcggctcgttcgcatctgctgaatggattttgaagttgaaaggtgctgttcatggcaggtcatcaatcaccgtgattttggttgtgatctacttcctccgtcccattttaagtgcagctatggttttccgtatccaattttgatcatccattttatttgaaaaaatttaaaaacttaagtcacgagtaaattactattcatgttttatgatctcacaacaacgaaaaatactaattataaaaaaatttcaaataagacggacaatcaaaattaggcgccaaaacttatggttgcatttaaaatgggacggactgacggagggagtattggctatgaaatatatctaagcacgcaaagtggcagcctccgaatagaccatttttacggagaacctatgtacaaaccataaaagtaaactatatgtggatccgtgggtctgttcagttgtatccgatccctaaatatatttgagctatgctccggtgctttctagtggccagtattgttatggataaattaataatttactaatataataattagaagttactttatcatttatgtgtattcccggctaaatcgatatataattatctattgcgctagcatcgctcatatttcatcgaaaaagctaaaaaaggagaaaaaaaagattagtcactgctaaatgacgattagtcatttctaacaataatgttcatccatgtttttactaccgctaactgggatgataatacaaatagatctaaagccttcgatcaaatgagatcaacggtttagattgatttctactaccagtaaagagcaccgtagtgaggataaaaaaacatcattttacaacatctcaatatggagcttagctaaattgattgtagcgtgtttattttgctggtttggactagacgagttagagatggccaaaaatgtaccaaaaaccgaacaagagtgtctttcccttctttctattgtacttcggttttggggcctgttcactttgatgccattttcaatcttaccaaattttggtaaagttgccaaaaaagtggctacatttagtttgctgctaaattttggtaactatataagaaatcctgtcaaaattttagcaagttgccaaaattaactatgccaaaattttggcattaccaaaatttggtaaggttttttttggaaaatgaacaggcccttggtctttcagaagttcgttatttagtctttggctcagtttgtgacttctggaaacaaaactacatatgtaaaaacccgctttagcctcatcaattcaagccctatatatgttggcaaggtccgttacatccctacgttggcatatgcctaatccataactttgacagacttaccgtatgaaacggaggtagcacaaaattttcaacgtatgtacggctatcatctatcttctatctatctattatctattattatatactaaaaatccattaaacttcctacaaacgctctcaagccatcacatggcacttctataaacgctcctagaccgccacgtagcaatgtctaatctcaccatcgattttcacttaaatcggtggacccaataatttagaccattatattagattagatactaaaaatccattaaactttctacaaacgctctcaagccgtcacgtggcgcttctacaaacactcttagaccgccatgtagcaatgtctaatctcaccgtcgattttcacttaaatcggtggacccaataatttagaccattagattagattagacgtattttatttaaaaggaaacgaataacatactgttgggcggaaaaagaacgggcggaaaaagaacggaaaacataagtactccataaatacttaagtacgactaaaaaacaatcaagtttacataatgttgatcgaagaaaaaaagacctacgcactgacttgcttaaaataaataaagccaaaaacaacataagtacttagtaccattgaaaaaatataaaaaacaacaaagccaaaaaaaaatatacgtacataataccattgaaaaaaccgatgatctttatatataattttctattatttaaatataaaatataacactccataaatttaaccaaatattaccgttggtttttcactttttcaattttgacgtaaactaagcacactccaaaagacgtacaagaatctatcttagcaagttgattgaaaggcacggcaagtgggactgcctagacatccgtttacttctgcagtaatatgcagttttacgggcaccaacacatacataatttgttcaagaaaaaaacatacataatcatacttactgcagtaacatgcagtacattttcttattgcaataccacactattaacacataggatgaggcacactatgacagcaacacactatatatactatatactgtacatgcagtaacatgtagtactttaggcagttggcacgacggcgacagcggtgctggcggcgtcgacggggtgtaccgtgcgagccctcttccctgccgcccaccaccaggaagcggccttccagccggcacagcaaacaagagtaactgcagcgagaagtacgacgatgaccacaatcaaacatgaaaaaatcattatttagtaattccgaaagaaaagaatatatgaagaactaggacttgaacgtatgacctcctagctgactagctgaggaaaacatattttctcgtggctaatgatttagtacagatgatcttcttgaacctttgatcgtttaagactcatcgtcattattacgggtttttattctaaatactaaggataaagataaagaagagataaaatccaaccaatctaaaaaatagatactccatccgtttcatattataagtactagtcaattttttttaagttcgactaaatttttagaaaaacataggccttgttcagttggggaaatttttgagtttggttatcacatcagatatacggatacacatatgaagtattaaacatagtctaataacaaaaacaaattacacattctgctagaaaactgcgagatgatttattaatcctaattaatttatcattagcaaatgtttactatagtaccacattgttaaaacatgacgcaatttggcttaaaagattcgtctcgcactttacacgtaatatgggtaattggtttttttctacatttaatactctatgcatttgtccaaacattcaatgtgaccacgtgaaaatttttgttctgggaactacacaaggccatactagtattttcaacacaaactaacatgaaaatatattcaatgttagatttaatgatataatttcatattttagatgttgttaaaatttttataattttgatcaaacttaacaattcaaatgtcttataatataaaacagagggagtactaacattacaaacatgctccaactcaccgccgataatcttcatcagtagtaagtactaacaaacattcaaaagacaccaccgataatcgtcatcagtagtaagccctaacaaacattcataagaatcaggggcggatctagagtgtaacaagcggagcccttggcccccactcaattttgcagcgagtgggggcaaatgcccctttaacactttttacttccttagtctacctaagcggtagatccttagcccccacttatactattttctgcatccgcccttgaaaaaaatcagtcaacggggacgcggcgcattattttagaccattagattagatgtattttatttaaaaaactaataccttattactctatgtacatatacaggagattaaataactgttggctaaaaaatacaaaaaataatacataagtagtccataagaaggtacgtccaagagaaagaaatgaagcttatcgactgaccagcggaagaaaaaaaatatgcgcacggacttactataaaaacaatacaaccaaaaaagtatgtatcattagaaaatgatcgatggtattttgaaatagtattttatactatttaaagataaacatattactctacaaatttaagtaaatatacttagttaaactagatttatattataaatacgagatatccaatcaatgatctttaaatgttctacttaacttacgaggctaatatatataataactaatgctatgattatttttttattttacatcatattttagggtgtcaaatatcacttgacgaatatacaacactaatttaaatctaaatatgtaaaaataaaaacaaaacaatttagttgttttattttacaccattatattagatttattatttaaaaataaaacatttctcctatatacggacacatgagaaatatataattgttaaccagaaaaagtactccatacgttcatatgattgaaaaaaaaaataatgcttacgtatcgtttgccgtaagaatagaaaacatagttatgataaagccaacaaaatcgatagtccttaaaatagaactttctaataaaatataataatattcaaatttacgcaaatataaatataaaatatccaatgaatgctttttgacgttctatctaattattttaaaactatatatccaattttttttatcccgttgtattcctttaaataaataaactattaatttgtgtaaccctaaatacaacaaaatatatggagccgatatgtaataattaatgttatgataataatttcacatcatattttagattaaaaaacacttgacgaatatacaacactaatttaaatgtgtatatatattctccaaattactaaaggtgtctcatgtgataagataggtgttaaaaacaaaccaaacattgaactaacatgcactacactagatatcactttgtcttggttactgttaacagtgaaatttggtaagcctggagtagtcatcggcttagagtcaacatcgtcttcgaagttctgagattagccgatgagagttgtcaagtcgtcagttgtcggattcttgctatattcggttaaggaaattgatctactaaaggaagcttatctagaagagactgagttcaaagataatacggcatggcaagttatatattaattaggaatatagtttgttagtttccttttatatttagaaaagtgtgtttagtgtcctataaggactttatcttttccttttatctttaggaaagtttctttcttgttcgacaaggacttgtatcaacccatgggtataaatatgtacacccggggtctttgtaatttatcttcacgatcaatacaattcggcgcatcgccaccttttaccttttctactttattttatcgtccggcgggacttggcacctgacgcgggactgcatcggtgttcgatctccagctaagaggtaagtccaatgttccgccggcccaggcaattgtatcgtctacgtcggcgtcgttcaaggctgcattagtacattcgacctcttggattgctctggtttggatgatatatttgcctacctatttatcatatgtctttgttaatctagtcttagcatatcaatttagctctatcggctgcttttcgttttagggtttcagccggtatcggctaaatcgcgttgctagattagattagcttagacatctaccaccctgaaaactcagtcaacggcttgattgtctagatattagatattatgtttcttttcatacttagtgctgcatcagttaagtttgatctactaagtcgtgcttagaaccataatctctagcctgcatctaggcccctggtgttaattttggtaattaatgacaagtgctaattgtggactaaccgttgtctttgagctatacattttaagttaggtccacgtcatatgtgcgcatggatgattatcgatggattaaaattgacggcgcaaagcagagggaaagaagacggtaaaactagcgctttaatttagaattaatcgaggtgtagggcgatcaaatttgctagtttatttttagtttcgccgtactattaagaggggtaatgacctagcaaagagatgattttaattgccacactaggtcattgcattttcacttgtgctcacattttcatcacacacacaaaaatcactttgcactttcactgggttcggcctgaccagggacggtcagaccggccacatagtggcggtctgaccagcgtgccctggccagtctgaccggccgcaataaggcggtctgaccggcggcacatgcccggtcagaccggccccctggaggccgagatggtgctgctcgaggtggctgatacagagccgacggagccgtagtcggtcagaccgagccgatggcggtctgaccgagccgaggccggtctgaccgcccactcaacgccggtctgaccggcaaggccgatggagccctctgacagcacttcaactgctagttttctagccattgcagagtagcacggtctgaccggccacatatctccggtcagaccggcagagcacaaagttggaggatttcgcccccaacggctagttttggtgggtgagagtataaatactcccccaccagcagcaaggggactctcttggcacccaattcaattgcatacaccccttgcacctctctcacactcacttgagctttgtgttcatccatctagtgcgttagagggttgattagccaagagtcaagtgcatttgcttccattgtagagctagtgtggcacttgatcatctccacaccgggtcattgcttgttactcttggaggttgccgcctcctagacggcttgtggagaagttgccggtgacctctccgagaagattgtggaggaggcccgatgccggtttatgagtggtttggagttcaccaccttcggagtgaaggaagaactaccctagtgatcgaggcttgggtagttctctccgtgggccggctcccgccttgcccaccccttgacgaagggggcgtgcggtggcttcgtggttgagtggtggagttgggctcgcctcaacggggagtaggaaaccggcgagtttccgaacctcggtgaaaaatctcgtctccttgtctcattttattgtcgcatttacatttgtgcaatttacatttctagatgcaaacttgagatcatatcaccctaggattgctaaacattgacataggagtgtgatttactttcctagagatataattgagccactatcaccctaggtttgcaaaacataacttaggttcttagttagagttgaccctcaccaagcctagcaacttagattagttttgattaggtgtcatttagttttatattgcctattcaccccccctctagtcgacatctcgatcctacaagtggtatcagagcttggtctctcttgattgggcttcaccgcctagagagaagatgtcgaacgaggtgaaccatgtagggaaggctcccatgtttaatggcacaaactataccacttggaaaattaaaatgtctactcacctcaaagctatgagcttccatatttggagtattgtggatgtaggctttgctatcaccggcacgcccttgacggagattgatcaccgcaacctctaactcaatgcccaagccatgaatgctttgttcaactctttgatccaagagtagtttgatagagtgagcaaccttgagaccgcatatgagatttggaacaagttggtggaaatccatgagggcacaagtgagtacaaggatgccaagcttcacttcctcaagatccaatatgagacattctccatgttgcctcatgagtgtgaatgacatgtatgggaggctcaatgtcattgtggatgatctcaaggggcttggggcaaactacaccgatcttgaggttgcccaaaagatgcttagggctctaccggagaagtatgagacccttgtcaccatgctcatcaactccgacatgtcaaggatgacaccggcaagcctcttggggaagatcaacaccaatgacatgtacaagttgaagaagaaggagatggaggaaacctcaccttccaagaagtgcattgctcgccaagccgaagttgaagacaagggcaatggcaaggtgaatgaagccaatgagaacttggaggaagagattgcccttcttgctagaaggttcaatgatctcttgggaaggagaaaggagagaggaaggggctccaactccaataggagaagaaatagaagacccaacaagactctctccaacttgaggtgctttgagtgtggtgagaagggacactttgctttaaagtgcccttccaaggatgatgatggagacaagtcatccaagaagaagagtggaggctacaagctcatgaaaaagctcaagaagtaaggcaagaagattgaggccttcatcggggaatgggactcaaatgaggagagctccgcctcatccgggtccgaggaagaagatggtgatgatacaagctccaagaagaagaagatggccgttgttgccatcaaggaggctccatcactcttcgctccactttgtctcatggcaaagggctcttctaaggtaacatctcttagtgatagtgagagtgatgatgattgtgatgatgtttcctatgatgagcttgtgagtatgtttgaggagctctatgcttatagtgagaaggagattgtcaagttcaaggccctaaagaaggatcatgcttctttggaggtcttgtatgaggagctaaagacttctcatgagagactcaccatttctcatgagaagcttaaggaagctcaagacaacctcatttccactactcaacatggagctctcattgatgttggcatatcttgtgatttgcttggtgatagtgctacttgccatattgctcatgttgcatcatctagcatttctacctcttgtgatgatcttgtggatatgtctagctctagctctacctcttgtgtttctatttgtgatgcctcacttgttgttgagaacaatgagcttaaagagcaagtggctaagctcaacaagagcttggagaggtgcttcaaggataagaacactcttgacaagattttgagtgagcaacggtgcatccttaacaaggagggacttggattcattccaaagaagggtaagaaaccttctcactgtgccactcgttttgtcaagagcaatggtaagtattgctccaagtgtcgtgaggttgggcatttggtgaatgattgtccttgtggtaaacctcctaagacatgcatgtttgattctcattatatgcttaggaaggctcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgtaggtgaactaccgcaccggtgggagccattgggtgtttgatagtggatgcactcaacacatgaccggtgatagggctatgttcaccacatttgaagtaggagggaataaacaagagaaagtgacatttggagacaatagcaaaggaaaggtaattgggttaggtaaaattgctatctccaatgatttgtcaattgataatgtctctcttgttaaatctctaaatttcaatttgctttcggttgctcgaatttgtgatcttggcttgtcatgtgctttcttaccgcaagaagttattgtttctagccttcttgacaagtcttgtgtgttcaaaggttttagatatggaaatctttatttggttgatttcaattctagtgaagcaaatttgaaaacttgtttagttgcaaaaacttctttgggttggctttggcatagaaggctagcccatgttggtatgaatcaattgagcaaactttcaaaacgtgatctagttgtggacttaaaagatgtgaagtttgagaaagataagctttgtagtgcttgtcaagccggcaagcaagttgcatgttctcatcctactcagagtatcatgtccacatctagaccattggagctcttgcatatggatttgtttggcccaacaacctataagagcattggtggtaatagtcattgtcttgtgattgttgatgattattctcgctatacttgggtgttctttttgcatgataagtctattgttgccgagcttttcaaaaagtttgcaaaaagggcccaaaatgaatttagttgcactcttgtgaaaattagaagtgacaatggttccgagtttaagaataccaatatcgaggactattgtgatgatcttggtattaaacacgaactttccgctacctactcacctcaacaaaatggtgtagtggagaggaaaaatcgtatattgattgagatggcaaggactatgcttgatgaatatagtgtttccgattccttttgggcggaagccataaacaccgcttgccatacaaccaataggctttatttacatcgtctcttgaaaaagacttcctatgagctaattgttgggaggaagcctaatgttgcctatttttgagtttttggttgcaagtgttatatttaccgaaagggtgttagactaaccaaatttgaaaatcggtgtgatgaagggtttcttctaggttatgcctcaaatagcaaggcataccaggtctacaacaagaataaaggtattgtggaagaaaccgccgatgttcaatttgacgagactaatggctcccaagaggggcacgagaatttggatgatgtaggtgatgaaggcttgatgagagctatgaagaacatgtcaattggagatgtcaagcctattgaagtggaagacaagccatccacctccactcaagataagtcatctacttccgctacgccaagtcaagctcaagttgaagtggaggaggagaaggcacaagatccacctattccaccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatcttgattggatgaatgctatgcatgaagagctcaacaactttgcaagaaacaaggtttggactttggttgaaagacctagagaccacaatgtcatagggacaaagtgggtctttaggaacaaacaagatgagaacgggttggtggtaagaaacaaggcaaggttggtggcacaaggtttcacacaagttgaaggtttggactttggtgaaacttttgcccccgtagcaagacttaaggctattctcatccttcttgcatttgcatcatgttttgacataaaactatttcaaatggatgtgaaaagtgcttttctaaatggtgaaattgccgaacttgtctttgttgaacaacctcccagtttttaagatcctaaaaatcctaaccatgtttacaaactctcaaaagctctttatggtttaaaacaagctcctagggcttggtatgaaagattgagagattttcttttgtcaaaagatttcaaaattggaaaagttgacaccactcttttcacaaaaatcattggtgatgatttctttgtgtgccaaatttatgttgatgacatcatattcggttctactaatgaagtattttgcaaggaatttggtgatatgatgtctagggaatttgatatgtccatgattggagagttgagcttcttccttggacttcaaatcaagcaactccaggatgggacgttcgtgagccaaaccaagtacattaaggatctactcaagaggtttggcttggaggatgcgaaacccatcaagacacatatggcaaccaacgggcatctcgaccttgatgagggaggtaaaccagtagatttaaagctttatcgttctatgattgttagcttgctttaccttaccgcatctaggccagatatcatgtttagtgtttgcatgtgtgcacggtttcaagccgctcctaaggagtgtcacttagtggccgtgaaaaggattctaagatatttaaagcattcctctactattggcttgtggtacccaaaaggtgctaaatttaagcttgttggctattccgattcggattatgccggttgcaaagtggatagaaagagcacatcctgtagtttccaaatgcttggtagatcccttgtgtcatggtcatccaagaaacaaaactccgtagccctctctaccgccgaggcggaatatgtttcggcgggtagttgttgtgcccagttgctttggatgaaacaaatcttgttggattatggcatatccttcaccaaaaccccactcctatgtgacaatgatagtgccataaagatagccaataacccggtccaacattctagaaccaagcatattgacatacgccatcacttcctaagagaccatgttgccaagtgtgacatagtcattagccacataagaaccaaggatcaactagctgacatctttaccaagcctcttgatgaaacccgcttttgcaagttgaggaatgagttaattgtcatagacttctctaatgtggcttgagatggtgcaccatggttgcttcttttgcatattgtatatttgctcctatttgctcttatgctttggatttattgccatttggttcttcattgcgaaaatggagcatgtcacattaagggggagttttgcactcttgcatgtgctccacttccttttatatgtgagcaaatcaactaaaagtcaacataagtcaaaacttttgcaaaatcaatgtaatttgaaaactatctcttggaaaatgtttcaaaaggttccctatatgttttccaaccctcactttgcaagaaaaatgttttttgaatgaaaatgccattttggccctcttttgaagaaactagaatcttgttttttggccaaaatgagattaaaccccaaaatgagattgagaaggaatttgaaaaaagtttcaaaacaaagttggtagagaagaagttttgaaatgtttttggtgttcaaatcatattcaaaaaccaaatatttcaaaagttgtttgaaaatcaaattcgcccaaaaacccctatagaccataaatggtcacctcctagcactcaaatgagttttgttgcaaatcttcataaatttcaaatattatgaatggttggcaatatttcaactcacacatttcaaaattgctccaaaaatcaattttttgttgaattttattgtgcggggtagccgaactgtgcaagggctgtgcacagtcggctaggggctaggcggtctgaccggcgctatatgcgcggtctgaccggcctagtagcggcggtctgaacggcctctagggcccagtctgaccagccgcaccccggcggtctgactggccgcatatagccggtttgaccggccgcaccccggcggtctaaccggccgcatatagccggtctgaccggcctgggatggtgggcccaggactttgtcctttcttcctcctcctcctcctacgcgacccctcctcatcccatctcatctcttcacttctccaactcgaaatttcttctcctctctcctctcccaaaccctagccacctccctccaccaaatccatccagttcaaccgtcaaaatcactccggttacaccgtaagtgaatctcctcctcttcctctctctattccatggattgatttgagattttattgagtttgtgatccatggcatggaaccctaggtgaaggaagaggtgttcttcgatttgcaccaatagagggtagtttcttggtgtgattcaactccttcaaccagtaaatctctctccctcttgtgcattgctctcaaatcgatctatttcaatctctagggttaagggtagtttcccccattactttaatcttgatgaaatagacctacaccttgatgttcatgtttcaatcttgtgcaacactgtcctagcaatttttagaatcatttgtgtggattatggaaggattcggtggtgctactgtcagtggcagtctgaccggccttgagccgtcggtctgaccggccgtcggccgttggtttgaccgacttcaggcatgcggtctgaccggccgtggctctcggtctgacctcccctgacaggccgtactcccccttcctcccacttcactatgtggtttctaaaattattacttatatatcctttgctcctgtttttcagtgatgcctccccgcactcgtcatggtcgtcgtgcgccaactccggatcctgtgagtgagcctgaggaatcgagtggagaggattacgctcaaagagatgaagaggttgaggccaatgttgagggggctagtgaggaggaaagtggagatgatgacagtggaagtggagagtatgaggatgaagaaagtgatgatatgcacattgatccatccatccagtttgttgtgaacatgaggaatccatcacagtataccatcttgaggcaccatgatcagtttttgaggcctcgggacaccccggatccccgttttcacaccgctttccagaagagtgtgtatgagcaagtctatgcagggaaagcttttgcagagcataagtggatctcttggagagacatcaatgagactctagagtttgagggcttgcaggatctcttcaggactgttggcattgaccggattatgactcttaagcaagattacaatgaagatttgatccggcagttttatgctacagtgtgggtggctggggactatagtgagatgaagtggatgtccgacaccctctagtgttctatctctaggaggcaattccggcggctcctcaatattcgcttggactttggagatgacttgcatgaggagcacacccataatccgctctccatagactacctctctcagttttatgaagatggagcgcggtacacatatgggaaggttgccggcttgaggaccatcccgagtgtggttaacaagattgtgagagctaccatcctccctcgcctgggtaacaatgatgacattaggggggtggcttggcacgtcatcgatgcaatcattcagggccgacagttcgacattgtgactctcatgctgcaagagattgccatctccaaggggaccttcactcagggaatctattatgccccttacatcatgaggttgattcaagacaagcttggggctgctaggcagaatttgaagaagcacaagcagtacaagccccgccttcagcttggagctccctgtgctcctagggtggcgccctcctctcatcctggagctagctcaagctcagcacctcctcctcctcatgggtatgatccaaatgccttctttcaccctcagtatgcctattttggaatgcaacccaacgagtacttcaacccggtacttggggctattaataccctaagtgaaagcattcaacgcttgtttaccgggcatgaagctttgcatgaggatgttcgtggcttgcgcacagatgttggagacttgaatgcttccgtggggagattgcacactcgagtgggtatattggattctcgagtccaaatgttggagagctcccaagcttctcatcgtcgtcgtcgtgatgcttctcatccttccacttcggcgtgtcctccttctcctccacaagagtgaagacctttttggtgcttgatgccaaaagggggagaaaagtgtgttttatgttgggttgggactagtagtagtgaggttagtcacctcatatttaataggttaaggaggtttgggctatattttgtgtgggtatgggctattactctatcttgtgtgttatttgtcattttgttaaactctctatgtcatttggaccctttgtggtcttgtaatagcctatgttttatttgtgagcccttgatgtggtcttaatgtgaacttgtgctatgatgcatggttggagttacattgatatacttgtgaccatcttatgcattcggttgattcatatgtgaagttcacattataatttgcatatgtgttgtgctatgttgaaatgtgaaattgaaatgtgcattggctccatatttgctatttgtaattgttatgcatatgtttagggggagcttttgcttgtcaatgcaatatatgtccatctgctctatgtttgattatatatatttgtggtgtttgtcatcaattaccaaaaagggggagattgaagcatctaggcccctggtgttaattttggtaattaatcacaagcgctaattgtggactaaccgttgtctttgaactatacattttaagttaggtccacatcatatgtgcacatggatgattatcgatggattaaaattgacggcgcaaagcaaagggaaagaagacggtaaaactagcgctttaatttagaattaatcgaggtgtagggcgatcaaatttgctagtttatttttagtttcgccgtactattaagaggggtaatgacctagcaaagagatgattttaattgccacattaggtcattgcattttcacttgtgctcacattttcatcacacacacgaaaatcactttgcactttcactgggtttggcctgaccagggatggtcagaccgtccacatagcggcggtctgaccggcgtgccctggccggtctgaccggcgcataaggccggtctgaccggcggcgcatgcccggtcagaccggccccctggaggccgagatggtgctgctcgggatggccgatacagagccgacggagccgtagtcagtcagaccgagccgatggcggtctaaccgagccgaggccggtctgaccgcccactcaacgccggtctgaccggccaggccgatggggccctctaacaacacttcaacggctagttttctagccgttgcagagtagcacggtctgaccggccacatacctccggtcagaccggcagagcacaaagttgggggatttcgcccccaacggctagttttggtgggtgggagtataaatactcccccaccagcagcaaggggactctcttggcactcaatttaattgcatacaccccttgcacctctctcacactcacttgagctttgtgttcatccatctagtgtgttagagggttgattagacaagagtcaagtgcatttgcttccattgtagagctagtgtggcacttgatcatctccacgccgggtcattacttgttactcttggaggttgccgcctcctagtcggcttgtggagaagttgcccggtgacctctccgagaagattgtggaggaggcccggtgccggtttgtgagtggtttggagttcactatcttcggagtgaaggaagaactaccctagtgatcgaggcttgggtagtcctctctgtgggccggctctcgccttgcccaccccttgacgaagggggcgtgcggtggcttcgtggttgagcggtggagttgggctcgcctcaacggggagtaggaaaccggcgagtttccgaacctcggtgaaaaatctcttgtttccttgtctcatttgattgtcgcatttacatttgtgcaatttacatttctagagacaaacttgagatcatatcaccctaggattgctaaacattgacataggagtgtgatttactttcctagagatataattgagccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacatttcatcggggttttagccggtgagttatctggacgttgcatcggctcataagaattgcacatacatataagttggatttagctgatgacaacaaaggtttcactgtttaatctaatcttgtggatttcatgacatcggacctccagccgatgtgcgctttaaccttcggatcgatgcttatttatcatatcattgccagccgattggtttatactggattatattgttattttattacatcatcatcagccgattgcttttatatcatcatctacattggacatatagccgattgcttaaaccctattgctatcggctggtatcagcatcggctattatcggctatcagctggaactactccatcggcttgtcagccgatcggctgttctgatctactatttgcatatcttgtcagttgcaggatcaaactgactggcacgcccgcatctcatcaatctttggacctgcacgggagcttagcagatttcccaggccagtgtgttcgattttttcgtcaacagttacatataaatgtttctattattttgggataaaatttaactccttagatttatgtgacggagggagtataagtaatataagtctatctttaattagatgaagtagtatcattagctatatttttaatagaaaatatctttcattaatatataataaaattaaattgttccttaaagtcatctatagcatacaaaataaaaaatgttatataagtttggaaactccacaaatgtaaaaaaaaataatcactcatatatcgtacaaatagatatgcaccacctccatcattgtgacatattttttttctaataaatttgagcatatacggtttcaactaatatgcccaaaccagttattaacggacccatgtttaaaatagagtcaaaaataaaaattcgtattaaaattcaaacaacattaaacaaacttacacgcgcgtacgcgcgggctaccttcgtagtttttatagtagttaacatacatttatccatacattcgtagtaaaagcacgttgcaggtaaacataaagtaaaaattttcccactagaacggaaaagcgtaaaaaataatccgaagatttgttataatttgaaattaacagtaaaagcaagtttttaggaaggtttgtgtcgcagcgaataaaagtcttatgcatatttcatctttcatctttttaattgctcgctcacaagaagtatatttcaagaattgctcgctccaataaaagtcttaggcatatttcaactttttaatttcaaatgagattatcatatttgtaatgtatatataataaattaaaatgcatttatatttggaaaaagcacaccgaaggtccctcaacttatcagcgagataaaaaagtcctcgaactgcaaaaccagatatgcggggtcccttacctatataaaatcggtcgcaataggtccctcggtaattttgatcccagttttatccaacgtggcgctttgaccacggccatcggcggctgagtccacgtaggacccatatggacccaacatgtcagcgtgtccacctcaccttcctctctctttcccctcttctctcccttcctcctctttctctttctctcaatcttctctctggggctttgggcaggccaccgccgtcggtagacggggcgaggcgggagaggaggtccgcagccggtgacacagcggcgacgcgggagcaggggagcaaggtggcggcagggggagctgtgactggcgtgggggagctatgcttgcccggagccgccaccgacgacgaggccgagcggcggggagtcgtcggcggcggtgtcgaggtggcctgctcgacgaagcagtggcgcgagtggcggcgcccgagtccatactagcgcgccgctgcgcggctcgagggagagaggcggtggccaagtcggcgaagggaatagcgagcaggcggggcgtgatgcgggaggcgagcaggcgacggccctttccctgcccggatctgccaccgccgacgaggccagagtcgtaggcgccgccactccgcatccacagcggcggccccatgggaggaggacatggcggcgcgcgatgcgagagcaggaggcggcatcttcgatggcggtggcgatggaggtgaacgccgggaggaggaagacagcagaggggaagggacatgcttcgtcgccgctctcccttgtcggccgccgcgcgcctcgcactctcccccggccgccaccgttcttctccccagcctgctcccgcctcgccgctgctcttctccactgctggtcgccggtcgccggccgtcggacctgctctcctctcccacctctccatcctcgtcggcgcctcaccaagtcgccgccgcatcgtccgtcatcgatcaccagacaaggagcaaagtgagagaaagagaggaagggagataagaggggaaagagagagatgatgtggcatcctgacatgtgggacccacatgggtcccacgctgacttagccgccacgtaggacaaattcggcgtcaatactgccctgggacgtcaggtgaccggtatagttaatggaccccgcgtatctggttttacggttcgaggacgtttttgtatctcgctgacaagttgagggaccttcggtgtactttttcatttatatttatagtgttctgggccggcccgtaggcacaaaagcccaccatgctcttaaatggaaaaaagttcatttttatccgtcatgtctttgggttgtctcttatatggcttagtaagtctattgttcgtacctcatctctttgagccatgcttataggctggaataagtctattttgggtcccttaacgattttgcatcccctgatgttgaaccgggccggcccatggtgacgaggcccatcacgggcccgacaccagtcggggcgtgtcatgcttgggccggtccaaaaccccatgatatgggccgggccgtggggccccgggccttttggccgacggtgtgaatgtgtggggaggaaagtagcagagtgaaagctgatagtggggttgaagcgaagggcccacacggtagacagagataggaaggaaaagcatcccaacgtttcgaaggcgaaaattcgaaccatcccgcccttcccaaaaaccaggtgggcccactaccactacccactgcaggtggggccaccaacggttgggcccactcgtcatggtcacaggtaggtgcgggtgcgggcgattgattccgaaaattttgggggttcccgctccggcttccgcccaactcccatctgaaatcgattcgaatcctccctccttcgatttcacgcggatttcttcttctctccatttcctcttctccaggttctcctgctcctaaacccatccaaaaccctagcaagaggaagaggcagcagcagccatggcgcccagctccccgtcctccgccgccgcgcccacgcgtaccttcacgcgtaagcgcgccgcctccgccttcgccttcgccaaggccaccgacgagccctccaccaagcgcacccgcaggcccaaggcggagaccaagcccaggaagaagaaggacgaggtaaaggaggaggagaagccgcccatggaggacgacgcctgcggggaggagccggatgcggaggagatggccttgggggaggaagccgaggccgaagaggcggaggcggagcaaaagcagctggacgcccccgcccccggtgtggcgaggaagcgggtggcgcagcccagcagggtccgacacggcagcgacggcgaccacgacccggagttcgtcggcgaccccttccccgccaaggaggcgcgcgacaagtggccgcagcgctaccagcgcaacgccgccaccaggaggtataacactcacgcatcccagatctggcctcctcaccacgtttgcatcctcctctcaacgcgtcctctgggttggtggcaggcccgatgaggaggaggacatcaaggcgcgctgccactacagctccgccaaggtcgatggcacgctctactgcctccacgacgacgtctatgtcaaggttcaccaccccatctcaatttccttccttccttcctttattacgtcttgccatgcttcgtgtctatgctttaatttattgcgacttgcttgtcattaattgtgtcccacttaactagctcatctggatctctaacacatccgcctcaccctgatttctttcgttgtgtgtgatttttgttgcatcaaacaaggatgctcctttcaattatcaattgtatggaatgccccacatttccacttatatcttattgttaactgaatatcctgtcgtcacaattcagtctttgcatatactcctttttcgtgcttgtgtatttgtcaaataatcacaattatgtggccttgctcgatgaaattactttttctctaaagtagtacatctccatttcgtttgcaacaatcataggctgaggaagataaggccgactacatcggtagaattactgagttctttgaggggactgaccactgccactattttacctgccgttggttctttcgggcggaggatacggtgtgtatcaaactctactagagtatgctttcctttctttttttttggtgtgtgtgtgtgtgtatgtccaaactctaacaacgtacacatctgggaactatctttgaaggtcatctcatccataatgatggagaatgctgatgatgaaaagcatgatctcaagcgtgtttttctttctgaagaaaagaatgacaatgtgcttgattgcatcatttcaaaggttaaaatcgtgtatattgatccaaatgtaagtggtctctctcagaatcttgtgctacctcatgcttgtaatgttccacattgtgattttccccttcatttcgtttagatggaatcagaagccaaagctcgacggttggctgattgtgatctgtactatgacatgtcgtacaccgttgcttattcaacatttgctaatatcccacttggtaaattgctctgttcttgttgctagctgaattaagatgacctctatatatattgcccaatatatatttgtgaactgtttcaaatagaagcactaactcatattacttccacctagaaaatggagcatcaggcagtgacactgcatcagatatttcttctgatgatgtggattcttccaaaggcaaagttgtctctgattcagaggcatcttcagtgggaaaggctacactccttgatctgtactctggttgtggcggtatgtctactgggctctgtttgggtgcggcacttgctggactcaatcttgaaacggtattattcttccctcattcgtctgggagaacttttgcgatatcagtactaaaccctttttttttctgctatgtggccagcgatgggctgttgatttcaatagttttgcgtgcgagagtctcaagtataatcatccaagaactgaggtatgttgtgaactgcattgatctatttgttttcagtgttgttttatgatctgctaactctaacgagctaatcattggatcaacgtgctatggattgtgtaatcaaatttggcatactgtgaagaaaccatttggtaatgctagtaccttttttttcctgaatgcaggtccggaatgaaaaggcggatgagtttcttgctcttcttaagggatggcatagcctttgtgatgaatatgtcaagaaagatattgatttcagttcagctggtgcctcagagaacgaagaggatgatgatgagcctcttgaaaaggatgagtttgttgtggagaaactagctggaatctgctacggtggcagtggtagagaagatggcctctatttcaaggtacccttgtctcatcatttgcatattatttatgggttcctgcagtattctgtgagtgttgcttcaacataattcttttaacaggtacaatggaaaggctatggccgtgaagaggacacttgggagcctattgagaacctcaggttggtacctttctggctggcatataatcattaacaaggtttatttctgtttgaaataacctaatctattttttaataacctagggattgcccattgaaaattaaagaatttgtgcaagaaggatacaggagaaaaatcttgcctcttccggtgagtatttgctttccttttatgctcttttctgctatatactttgatctgctgatgccatctatgtttaataattccatagggtgatgttgatgtcatttgtggtgggccaccatgccaaggaataagtggtttcaatcggttcagaaaccgcaaagagccactaaaagacgagaaaaacaaacagatggtgacattcatggatattgtggcatacctgaagcctaagtatgtcctgatggaaaatgttgtagacatactgaagtttgcagatggttaccttggacgttatgccttgagccgtctggtggctatgaagtaccaagcacgacttggaatgatggttgcaggttgttatggcttgccacaatttaggatgcgtgtgttcctctggggagctcttcctaccatggtttgtttccattgcatttgtgaacatttggtagtgtttgatcggaacagtgaccaggtgcatttgttaatgtaggtgctgccaaagtatccgcttcccactcataatgttgttgtccgtggtggtgccccaaatgctttttctgtaagtctgaccataactctaaattccattgaaagtctccgtattctgactagcttgatcttgcttgcagcaaagtattgttgcatacgatgaaacacagaagccaacattgaaaaatgcactgctgcttggcgatgcaatttcggatttgccagaggcaagtgtttcatcatctattaatacgtttcttgacctgcaactgcaatcttaccccttatcttcaggtaaacaaccatcagcctaatgaagtgatggaatatggttcttcccccaaaacagaattccagcgctatatccggcttagccgtaaaggtaataaaacaacctctaatagctatcatttgtgtgctttgaatatgatgggtgggtttatttttgttatcaatgattttttcccttacatttcaccctgtacaccaagtttaattcattttttccccaaatgttctagaaatgctggatagttcttttgaagggaaggatggtccagatctaggcaagcttttggatcaccagcccttaaagctaaataaggatgaccatgagcgtgtgcagcaaattccagtaaagaaggttgtcagttgtacagctttggtcctttgtgaacttgtccactcattctttctgcagtcataatcaatttactgtgtttcagggagccaacttccgggacctgaagggtgtcagggttggggcaaacaacatcgtggagtgggatccagacgttccccgtgtatatttatcttctggcaagcctttggtaagtgttccgtgctctccccattgttgtgaattgtttgctgcatctagtatctgctgcttagtatgcagctagtgccatgctgtttgcagtcacaaggggatgtatttatattcaggggagcacgtttacagttgtgatgcatctattactttgtggggacaaatttacaggcgccctaggtgctgattagcccttttgaattatgctccctttgttttgtattgtcaggcaccttgattttttttctaagtcaattttttttaaaattgatcaagtttatagaagaaacgtagcaatattttcgatactaaacaaatatactatcaaaatatattaaatattagatttaatggaattaatttggtgttataagagttgccatattttttctattaacttggtacacttatagaagtttgacttaacaaaagacaaagtgtcttatgattgaagcggagggagtatattgcatttttaggaaaaatatgttaaaagtattagaaggcctgacaaagtagctagagaatttctaggagtggagtttcaaaccaaagtaacaaagcatggcatcctctaaattttcatgaactttgttatgaggagctcctagcttcctaatcttctattatatactaaaagtccatgaaactttctacaaacgctcctaagctgccatgtagtattcctagaaacactcttaaatcgccacgtggcattttaataagttggtgggcccattattttcaatgaataaatttatctttagagggaaaaaaaaccacaatccctcccaaataccagtcccactctcaaacaaccctagtcggatgtacatagtcgtacatggtacgactatgtacgttcctccatctgataacctattactctaaatataaataaagataattcaaaccggtgaactcattaaatttattttaaaaatacaaactctactaatttttaaagtagaccgttatccctttcatgacaaactaagtaagaacgcaacataagaaaataacaatatttattattttatattaaattcattttatataataaagattgattaaatcaccacatgtcacgttttaaacttaagaaaagtaattaaaagaaaaaaagaaattgatatacctattatttttaaccattagatcattttcagaaaatcttaatccaccacatcatgtcttaaaggttaaaaaaacattgaaatctaaggaaaaaaaacattggttttcacttagatatctgcaaatcagtcctccaccttcacatcctgccagtccatcacatgtgcataatagtgcccaccccttgccatctctcaatcgagcactgcactatttattcctcaccagtccctccctatctagttttagctatcgaagtaaaagagaaacaaccaataattatagatattgaaaagaccatagttttaagctacacatattatttctaatccaactcttgctgtatttatatttaaaacaacaatttaaaatccacatgtctgtattttgcaatataaaatatatgacatttaggcacactccaccagtgcacttggcatgtcatccaaatagcaacggattattatataaattgtcgagacatatttcattactatacatcagtctacaaatgctgatagctatactaaatcaatagtacccaaacaaaattggcaaattcatgttccaatcattgtttttatcgatggacaacacccttgctattttacatgctattggacttgccttgaaaaactatgaaataattcaacaaggcacgttgctccatcatatattgttttgcaaacatgcaaaactaaactagatattcagtgcataagaaaaagatagctgaaattttaatagtctaagctactacattaaaaaataattcgaagggacaaacaatttaacaaacataggttgcatcattatacattgttttgcaaataggcatagcttaacgagataaacaccgtattatgaaaaagaactatctcaaatatgaagatgcagagttgctattgtattaaaaaaaatggtgcctgacttatagaaaacaatatgattacttcgtattttttaaaagggacaagtttgtgcatttgaccctacttttcaaaattagagttaccgtctcaccctgttttgaaatgagtaaacttaaaaaatagcgttagtagattggtatttaggttttgaaataggccaaaatggacaattgtcctttttaaaaaaactaatatgctcaaataatccaaatgttcttcctattttctgtgtaccatgttaccctaaacaacaattttaggcagtcacttgacactctaataaattagagaaaattctagaaattccgagaaaagaaaagcaaagcatcttgccatccttttatcacttaaacaagtggattcattatttccaatcattacatataccttatatatatatataaaaatatcacatccacctccaccttctgctacctatcatattcaagcatgtattcatgatagatcacattccaaaaataatattacccaattatatttagccgtccaaccatattcaccataggctacgtagagcctcatgtcccaaccaatccatccattaataaaaattgacaacttatataggtaatcaattaaaaaatgaaaaaaaaaaacaccacttttctgttacactaaatttggtagacatgttttctaaacaaaataagtccaaaataagacgattacaaggattataaaaaaaatgtttatggggattgcttaagtaagcaatagaaaaaaatggagaaatcgtgcttttgaagcatagcaaatgttttccagtttatattccgccattgtaagtgtataaaataacactatacgatgcatgcccgcgcagatgcgcgggctatcttcctagttgttacaattgctgaagagctagcttgtctgtgtggctaggttcctgactacgcgatgtctttcatcaaagggagatcactgaagtaagttgcacaatatctctggtttcttctcctgcagtaaaatttggagtgcgatatatttcttacaaatgttgttgtaggccatttgggcgcttgtggtgggatgagacggttcctacagttgtgacccgagcagagccacacaaccaggtccgattgtcaagaaagtatagcaatttctacatctgtgcatcctttctcaacgtgtctgaatgtgcttctctgcagattatattgcatccgaatcaggcgagagttctgaccgtaagggagaatgcaaggttgcaggggttcccagactactacaagatgtttggccctatcaaagagaagtaagctttgtccctttcacatcacatattatattgagttgcaccgtccatcaacaatggtgtcaactctaaatgttgggttctaactggaaggctgtgtttgatggcggttgcaggtatatacaagttggcaatgcagttgctgtacctgttgctcgtgcattgggttactcccttgggcttgcataccagcgtgagtcggaggggagcagccctctgttcgtcctgccagacagcttcacggaagtcgggcgacaggcggcgccggcaagagcatcctctgttggtatccctgttggcgaggttgttgagcaatagaacacttgggtagagtagagtcattatttggttcgattcgaaccgatccgggagaatgttgtttaaaatcactgatcagccaccttggtgctgtcatgtgatcaccatcaatgttattattgattgattgaatgttgtaaggctggtggcactcctgcttgagtgcttgttgtacttgtagcataaggtccaaaacattcattcatatccttctatgggctatcttatgtctgtatcctgatagattgtttgtgttcaatcatcatctcacattgtataggctgcccctgatatcattgttgcatcaaccttgtgcttttttggggcttatttgttagtccctcaatctgaactagtaaagttgaagtttggatgttgaaatggattttgggcctagagttctctttggtgtattgctggtacaaaggcgctttgcgaaattctatttgggtagctccctttggatagctagtttgtcctagggggtgttttggttgtgtcatgtttcacgatgtgtttttttcttgttttttttttggtgtttttagagaggtcctttggatcactcggttatatagtttatcttcttaatgaaatgaagcgtagttctcttgtgtttttgagaaaaaaaaagcaacagtcactagttagatagtgtgatggatcaaggtgccagttgaggctaatgacgactagagccaaaccaggtatcaagtggatatgcaattaaattgtttgctcctcttttgtgcgtgttagtacattcttttttttttcaatcggaaagactactactccatgcattctttctcacatactcccttcctaataaactgagactatcaaacatacttgtaggataaaagaaagatcttaaaacaataggtcttgcctagttacaatagttctactagttctttttttgttgtttctttgtagttatgtaaatatttactctctccgtactcgtaaaggaagtcgtttaggataatgtttaagtcaaaccttgggaatataaatcataaataactctcaagttgttgagtttaaaaatgtaaaaattatatgaatagatttatcttgaaaaatactttcataaaagtatacatatatcatttttcaataaatatttatagaaacaagaagtcaaagttgtgttttggagaccgtgtcaatgtcctaaacgacttctttaatgagtatggagggagtacaactatactgagtattgtctagtcagtgttcccttaaaaaaaagtccaccattggatgaaacttgcttttgaatgtttataactattaaggccctgtttagttcccaaaacaaaaattttcacactgtcacattgaatgtttggacacatgcatggagtattaaatgtaggaaaaaaacaattacacaaattgcgtgcaaattatgagacggatcttttaagcgtaattgcgccttgatttgacaatgtggtgctatagtaaacatttgctaataacggattaattaagcttaataaattcgtctcgcagtttcctggcggaatctgtattttgttttgttattagactacgtttaatatttcaaatgtgtgtctgtatatccgatgtgacaaccaaactcaaaaattttccccaactaaacaaggcctaaagcttgttatttgcgtgcatcgtacaatggcaagaaattgtacttttattgtataaaaataactaataaagttgtagtttgtaccttccatcacatatatgcatatgtgggtttatttgtagcatggctaaaaatggagaatggcatggagagatatatggcagtagttggaaaggatgacgagaattgcgtgtcaccctcttccctttggccctgttgcccccaattcgccttcgaccccttctccttctccttcaacatctaatcatcacggagaaaggataaggtacattacccccatcacaatacataaaaaagttgttttttattgcatttggttgaaacttgcatgattgttgatctagcgttcatgtgacatgtttctctaatgttttgatgtgcggacgacatgtgtattgatcccttgacatttgtatctcaaattaaatggtgatttgctcatgcgtttgattcacatgctttgattattgcctttcgtttatgaaatactttatctatttcatattataagtggtttcgactttttttcaaagttaaatttgatcaagtttatagagaactgtaacaactcttataacacaaaaattagtttcattaaacctaacatttaatatattttggtagtatatttgtttggtgttaaaaatgttactactatgtttttttcatttaaatttagttaaactttaaaatatttgcaaaaagaaaaaaaatcaaaagaaacttaataatttgaaatggagggagtataagaatgcacgtaaatatgtgatgcacctccacacattcaattaaaccgttcactttaatgacataagatactccctctattttatattataaattgctttaacatttttcatagtcaaattttatttagatttgactaaatttatacataaatttagcaatatcagctacaccaaataagtttcattaaatataacattaaatgtatttttacaatatattgaatatgttactatgttttaagttgaagtaagaaaaagaatatattacactcacggtacaacaacttggcgggtgtgtatgatatagtgcaagaacttaagaattaaaacgttcgagtgcaataatttgataagtgagtgcactctagtataagaacttgacaatttagtatttagtgcatcaacttagctaaacatatgctaggtgagtttttctcatgatgtcaatataccattacaataaagttaaaacgacttgtaacggaggggtaacatgaacaaatcaactcacaacaatttttcacctgtcctaattttatccgttattgattaattaaatttaactttttgcaggggtgggttcacaaattttttcaattgtgttcttatttattagaggtaattaagtaattattattagaggtacaaattaaggtctctgagagagaggggccggggtgggccctagctaggtaatggcagcctcgccggagtcgtctccgtcgtcggccaactccaccaccccgtcagcaccgtcgccgtcttcgtcgttgtcaaaatcaccctcacctccctccccatcatcgccgccgccaccagcatcgacgaacgcgccaccaaaatcagctggcggcgtttcatcttccacgcaagcgcaaccatcgtcggaatcatcgtcggagtctacgactacgccttcggcgccagcggagaggaagagcggcgggtcctctcgaggagagtccgggcggtatcgcggtgatgtgaccgccggcgtgtttgtggggttatttgtggtggcgatggttgcggtgttggcgggtgtggtggccatcgtggtgtgctgctgtataaagataacgaagaagaagaagcggccgccgccgccgaacatgcccttcttcaccgacgagaagggcaacgtgtactacgccacaggcggcctgcctcccatgtggcagcagcacggcagcagcaactacagcatcccacctccgccgccgcccggctggcacatgtcatcgtcggcggggggtttcagcggcgagatggggatggggtactcgtcgggaccgtacggtccggcgctgccgccgccgtcgccgaacgtggcgctgggtttctccaagagctccttctcgtacgaggagctggcggcggcgacgtcggggttctcggcggcgaacctgctggggcagggagggttcgggtacgtgtacaagggggtgctcgccgggaacgggaaggaggtggcggtgaagcagctcaagtccgggagcgggcagggggagcgggagttccaggcggaggtggacatcatcagccgcgtccaccaccgccacctcgtgtctctggtgggatactgcatcgccgccaaccagcgcatgctcgtctacgagttcgtccccaacggcaccctcgagcaccacctctatagaggcggcaatggcgatcgagttctagactggtcggcgcggcacaggatcgcgctggggtcggccaagggtctcgcctacctccacgaagactgccacccgcggatcatccaccgcgacatcaaggcggccaacatcctcctggacgccaactacgaggccatggtcgccgacttcggcctcgccaagctcaccaccgacaccaacacccacgtctccacccgcgtcatgggcaccttcggctacctggcccccgagtacgcctccaccggcaagctcaccgagaagtccgacgtcttctccttcggcgtcatgctgctggagctcctcaccgggcggcggcccgtcgacacctccaactacatggaggacagcctcgtggactgggcgaggccggtgctggcgcgcttgctggtcgccggcggcgaggaaggaggattaatccgggagctggtggactcgcggctgggcggggagtactcggcggtggaggtggagaggatggcggcgtgcgcggcggcgagcatccggcactcggcgcggcagcggcccaagatgagccagatcgtgagggcgctggagggggacgcctcgctctcgctggaccaccaccacgacgacgacttctccgcctcatcggagatctcgcggcatcggcaggtggccttcgacagcggcgactacaccgacgactacttcaccacctccacctccacccactcctcccgcctcccacccaagcgctaatcatcactaattcttttatttatcgatttaaattataattagctggtttcacaaatcaccctacactcgtggagaaaccatctttactcccggttggatatccatttaatcccggttttccaaccgggagtaaggatccgggactaaccgggactaaagatgtatccttagccaccaaccaggactaaaaagaagggatcaaccgggactaaacagacaatagcggtagtgcagatggtccctttttctttttctttttttttattttctcccgaatcaagtaggcaaatccccaaatctaactaacatcccaaattcacaacaccaaatccacctcacaaatcataaagttacttatacacacaaatcaaatacatcacaatatcctaagaaattactcaaatacatcacaaatccaaacaatgaatcacaaatttgtaacttctcggataaatacatctcagtgaatcatcacaaattaaaaaaaaaagaatgccgctgccggtcgccacgaacgacgggcgcggccccgccgcccgccgccgcccgaagccctgccgccgcccgccaccgggcgcggccctgccggcctttgccccgctgcccgccggccgccgcagcgcgcggccccgccgccgaccggcccgccggatgggaaggggaggccggccgggaaggggaggaggaagggagagaaggggaggagaggaggaaggggaggagttggagaagagagttagagaggatagatctgaggggagggggtgagattcgatctgttaagttgtaactgtggaggagaggataagggatagggattatatactacgtgtttaattttagtcccggttggtactaccaaccgagactaaagatcatcttgatctttagtcccggttggtactaccaaccgtgactaatgtggtgatctttagtcccggttattgacaccaaccgggattaaagatcttcggccccctgacatacatctgacaggggatgaaccgggactaaagatcatctttaatcccggttggtgttaccaaccgggactaaagatcaaaatttttataaccgggactaaagatcatctttaatcccggttggtgttaccaaccgggactaaagatcaaaatttttataaccgggactaaaaacaatctttagtcccggttctttttggatccgggactattgtggattttgccggaccgaccaaagatggtttctccaccagtgctacgaatcaaactcgagtatacttacttctatggccatatatgtgtattatatatagtcgtttggatttaactgcttgtgtataccatattcttcattaacacatatacatacctatatataaatcctactccctctgtcccaaaatataacggattttgaacggatagaatattttctagtataacaaatctgaacagagttatctagatttatagtactagtaagtgtcccacaagtccaaaatcccttttatattttgggacaaagggaggagtatataagtagccccatagttatgatttggtgcagtcacgtcatctgtattatttcagccattagatgaggggagagtaggtgtcatatgaaccgttcgattaaatctgagtattggatacttgtataattgttgccccaactttacttttcatatataaggatactctcatttaaaatgataccacaaatcactgctccactactctaaatattctctccatttaagctactccctccgtttcacaatgtaagtcattctagcatttcacatttatattgatgttaataaatctatatagatatatatgtctagattcattaacatcaatatgaatatgggaaatgcttgaatgacttacattgtgaaacggagggagtagaaattaaccaagaggtcaccaatgccataaatcctaaacgaccgttaccactgtcattttatctccatttgcagtttcacatgcatgggcttaatcaagaattaagaacatatctttatatataagatagctttgtttacctaagaattctgtactacctgcttaatgctgaatataccactgatggaatcaaccaaggatgggtgccaattaaaaataggttagtatgctcatatttcatcattttgcatttttgtgtgatcttcacatctttttccataattacactataatttactctatttttttacttgcatcacatttctaatcccttctcttttgtccaaacgagtttgcatgaaaatgtccctctaggacaggagcggatccatcatgggagcggcgggtgtttgaaccttcaatactggcgtgaggaccatgggagtccctttaaagcatctacaattttttttgccatatgtagatgggagagggggttatagctttgttctagtatattcatacccctactatttttttcatggatccgccactgctctaggatgtcacttacactatgatatgcgtggctcaatgttttctccaagggatatatgtttgggatcgtcggtacgagagtatatgcgagattgaggtaaaagagatgaagacaaggattttcatacaggtttgggccccttatatatctaattggtaatagccctacatcctattggtcgaaaccggtgttgctcttattcatctgaaccacacaagtacaatatttgggataacctatctagttgtcgtcgacttgtcggcatggataaccaactcgtagtcgatgacagggtagtcttcctcctcgaattcgcactcggcgagatcagaggtagcgctagatccctcttgttggcctccgcagacaccatattgggattgtttaggcttatctctgatgtcgatatccgacggcttgtcttggcgtatgttggcttgtgtattgtgtgcaacatcttgtggccttgtggcgtgtccctctccttctaggaggccttgtatttataaccatagatatccccttgtctaagtagaactaaagagaccaatatggatacaatccgagtagtccttgtcgtttcctcgtagaactccatttgtccttctatatacgaggtatgattccatataagacttagtatgtggtgtgtcccgccgagcttaatcgattactattaattgagtatgtgatatctataaccctaacaagacagacatggtttttcatagcgaatgcatacataataaaactttgtttcatcttccaaaacaaaacataacaaaaataacaagaatagattaccagccaacactatattacggtcattgcgccctttacgttttattcaggagaaaatatgctatatcaagttattctatttttaccacaaaatagagtaataattgttgatggtatcaacttattatcatagcttcctcctttgttacttgatgaatgtaaagttttcctaataaaatttcaaagttgtacgtttcttcgtttacttaagctgtactatattttatacgcacaccaatccaatgtcacttaattttatcttataaaatttgcttatgtcaatttcatacatattttcacagcaacacgcgaagtactatctagttaatagatgactactccaccaactcctctgccgcgcttccgcccaagtgctagctaaacatatattgcatctttaaccaactagaatttaatttaatcgattgattaattaattagctgatgctggggcatgcctttgcgtgccgcttgtacaaaggatcgacacgctataatacactagttgattgacaatgaataccttcatgaatccttcaaacatatcttgaaatttatgaagacgctgcagtcgtctcactatcgatggttatgtcgttaattagctataaatacaagcacatgtgttaagtttaggacttgaatccgagtggatagattccaccaccagaaatccttctaattggcattcaagtagtgtagaccataaggatccaccctcatttggagcttgaggcgatgttcattgcttgaaagctattaatgtgcaatggagagggagtaagagtaagcagagaaaacttgactagagaatgattcggttgttgaaagatatttgtcatctgacatgacagatttttattacactcatttttttaaaatgtgaagtgcataaaaagttgatcatagttccttgttcacacgctatgttgcacgtaagataataatgattttgtaggcacctctctaattaatatgtagaatcaaaggtttctaggctctgtttggttccatgggctaatgtttagccatcaccttttagcctcaaattagccttcaatgatccaaacatgtgggctaattttgagctaatatgaattagctcccctcaaaacattagcccctccaaggggtgctaatggggctaattttgtgttgggaccatcaaaaagcaaagcagctctctctctctctccttctctctcctctctttctactttctctccaccttttagctttgaattagcccatggttccaaacatgccatcgtaagctaatgtttagcctaccaattcatgactaaacattagctctcaaaattagccctgggctaatcttccaaacaggccctggtagggtgcccaacgattgaaattgatgctacatttattgccatgcacatagactatactttggtgaatcctctcaacatgtgcttaggtagatatttaaaacttcatgaagtttactttcaaacccatatatatgaactatgaagacatgattatcaaaaattaaaatttgggcttagagttaacaacactgaaagtctcatttgtaggaattaaatagtcatgaccatatcatatccttcattcaaccttggccgccacaacttcaaccgtatattgattataatgcttcctctgctatggattaccacattcttctcgttggtgatgttgatcgatgtgcctccttactactgagtggcatctactatcaccaatagtagtatataccattgtaaaaatatgttttatcataaaaaaatcatggtcctaggttcataaaaaatgaatgaattttaaattgcgcatgaaattttgatttggaggtcctcataaatagaggtagagtgagcatgtgagtgtttatagaggtgagtgtgcgtgtgtgcatatgaggctatgagcacgcgcatggtgttttcttttaagaaaatcatgtttcgtccgttttataatataagttgttttgactttttcatagaaaatttagcagcatctatgataccaaattagtttgattaaatcaaaaacattaaaaatattttgataatatattattttgtgttaaaaatgttattgtattttaatataaacttgatcaaacttaaaataggttcagttatgaaaataaatcaaaacaacttggaatatagggagtactaagctagctcatcgtgactgttcagatttgtggtattaggatatgttatatatcatagtagattaatgtgggacggatgagtagcaatgtatggtccaattgagatcctacagtactgcatgtgtcacatgtctgtatccggtatggtctgttcaaacgcctgagcgactagttacttgctggagttgttgtattgttacagatagacccttgacaatcaggcggatacgagcaaaagcaaaggcgatatttgaagaaaaagatgagaatgagagtgaaattttagaagtcggccattggagaagtaggaaattggaaggaagagggtatgtgaaggccgcaggtggcaattcggcccaagaaagcagaaagtggggtggcaaaattgtagaaaggcccaacaaaaattgtagaaaggcccaacaaattgtgcgaaaaccaccccacaaaaatatcgtctcctccgcgtgtgcggaaaccaccccgcataatttccaaaatacccccgagccctaatcccctcttccccttcctcctcgctacggcggcggcggcgacggcgaccgccggagccgacccgatcccacccgagtccttccctgtgcgcgcaccgctccttcctctacttcccgaccgccgcttcctcccctgttggtgtgggcgcgggcggctagaggaatcgaattgaaggtatacgtcctcttcctcctctgcgtcgtgacttggtggattgaagggccggccacctgcgtgttgtagattgggaatccgtccacttcttttttctcttctggatcgatttctttctttcttccccttcaatctcatgactctgcttctggatttctttgatgcggtgtggggtggggtggggtggggtggctggtgtagtactaccaggcaccagcagcagcttgtgtttcatcctcctcctcctaagaaaaaaaaagaaaatagaaccaacccatgctccatgttaggtcagccccttgggcttcttgttattttggatctgttgtttcttctttgcaatacatctcaaggccatgtttttttttcattacagataagctggggttccttttggtgcctgtcggtccataaaaatagtttctttggttcaccgaatggtcaaaaaaagtagaattgggggaccaaatgtgtgattcgtatgtaattagggggctttccattatatatatttggggtgtgtttcaatcctcttagcacccatgaaaacacgactgtttcttaaagtattctgtttccaagtgtaaaaaggaaaaggaagatatgtagcaggggcatcctgattcaaaatctaccttaggtttggggtcacgcaaaattacaatgttgaactgttaatttgtttgcttacagttcatttgcttccattttgaactgttgcatatatgttttgatacagtggaacagattacatcttcagtcttggttctttttttttggataatcactggaggggagagattccccacctgaattttccattgataagagatttcattacaaaggaggttacatagggcgggcagaacgacagtgccgttgccattacatatgttggagttgcataggacaggagaaaatttctttccaggctgaaaccacaatctgatcagggcgctggatacgctcagcccacaagttagcttcatcaagacagcgtcgaagaagtcgtcggagggaaggttgctcatttctgaagacgacatcgtgttggtggttccacagacaccatcagcagagcaagaagatggtccgatggtgcgccaccggtattgtttcaggggggtaaatgcaaccgacatctcgtacatcagagattccaggatgaacagagagggccgcccagaagtcgcaggtgaaagggcacagcaggcataagtggctggctgtttcatcgtcgagtccacagatatcacaagttggggattgaacagaacacttatctattctaaaccactaatataaaaaaagtatcacttgcgttcttccctacctccacccaaaagaggtgtacactgaactactacagtcacctgccttcaatcaaatccaacgttccaacattcaccgttgcaatacggacaaactatgcaattaatgcattaattacacataaatatctaaggtagatcataaaacctgctaaatcctcaccctaaataatgcccatgaacgtagttaacatatactgctattttgttctgcttgggaaacttgctcgctgaatcattcttttttttaaaataaataaataaatattttagcagggccataattcacgcttctgtagagttcatgtatcagggatatcgatattattgggtttcatttaattttggataataatatttatttcatagtgacgtggattctttatgtactacttaatttcttattgtactgtcctggattacgcatgcacattgatttatttcctaacatgtagattacggaacaactctggaggcatggcagaggggtccctagttgttgccatttgccagtatggtggagagttcacttctggccccaatggcaatttgatctacaaaggaggagaagcacacgctgttgacgtcacacgagagatgtcactagataacttcaaggatgaggtgtccaaggtgtttcatgttgaggtttcagatgtgtcactgaaatactttctcccgaacaataacagaactcttatcacaatatcatgtgatcgagatttgcaacggatggtcgattttactgctagttctgcacaagtggatgtttttttgataagtagagtggagaacaggtatttccttttttacctttttgtgcagccttttggagtaacttttgcaagcctacagaaccttcgacaaagttatcttagaagtacagattcaagccgtaattttgcgataccatggcttaaacctatagttttcttataaattgagtgttaaatctatactttttttatactatatcttaaatttctagttttgcaaaatttactattttttgagtaaatcattcatgttctgttttgattagtatgtttctcttgctaggagtataactcagactggagcctccactgctaaacctgggtctaatgcacgaggtgataaaaggaaaacgccaacttccaaaaataagtaggtgccactgttccagttttctctatctgatgttatttatagccccgtgcttttccatgttatattgaataccatctttctccagggcatcaaaaaacaagaagaagactcccagtgctactggcactgcagttcaagctaatgccaataatgtgaaacagccaagacaagttgttaccgaaaatgatgacaacaggtacataattgggtttcatagaattgccacatttttgcatgtcttctctaattttagatgttacatcattttattttaatgaccgtatcatgcccaaatttatacggttgctacttttgttaaaataaactagggtttttccactggaatttgggagtgatattgcctttgccaatacagctggagctggttccacagctccagacatcttgaatcagcaaaagcttgctcttgttgataacacagcgaggtaattgtttgactaattttatgttcttcatcattcctgcaagtttgtgaagtatgagttcaacggatgttggcatggcttttgcagggaatcagttgggctttttgatgattcagtcaatccatatgttggctctgagatcacaacagaacctacacagggtcttaacaatcctattgtgttttgggatgatattatcaaaggtgtcggtcaagaatttgataatgtgaaggattttcgtgctcagttatgcaagtatgctattgggaaaggatttgtttatcgattcattaaaaatgaaaccacacgtgtcactgtaaaatgtgttggtgagggttgcacatggcggttgcatgcatctgaatcatctcggaacaagaaatttgttatcaagaaaatgacagacgagcatacatgtggtggaggaagtggagagggtcagcggcgagcaacaagacagtggctgactactgtcattaaggagaagctgcatgagaatccattgttcaagccaaaggaccttgtcaaggaaatttatgaagaatacggagttatgctgacctattcacaggtttggcgaggtagagaagtggcacagaaggagctttatcatgctatccgggagacatatagccatttgccctggtattgtgaaaggcttttggagaccaatccaggtagcatagctttgttgtctccgatggtggatacaaaattccgccgcttctttgttgcattccacgcttctttgcatggcttcacaaatgggtgtaggcctctcatatttcttgacaaggttccgcttaaagcgactaatgagtacaagttgctggttgctgctggagttgatgcagatgatggtgtctttccagtggcatttaatgtggttgaagatgaaaattatgagagttgggtttggttcttgatgcagctgaggtatgctctccagaatcacaactatccttacaatgctatgacatttttgtccagtggacaaaagggattggatgctgctgttccacaagtgttcgaagaaagtcaccacgccttctgtttgcatcatatcatggaagaattcaaaggagagctgaggaagggaccgtggtcacaacagataagagatgggatggttgaggatttcactcgagcagcccaagcctgcagcatcgaggattttaacgcatcaattgagagcataaggaatatatccactgaagctgctgattggattattgcaagtaagccggagcattggtcagatgccatcttcagaggctgtcgttatgatcatttctcctcgaacattgttgatgcttttaataactggatacctaccaagaaggaaggatcaatagtgctgatgatagactctctgagaatgaaaataatggaggtgatagaagcaaggcgcgagtcttgcaagtcctggtcagggcctttaactccttccatggaattcaaagtgcaggatgagatgtccaaagctgggaagctgactgtgctgtgctcttctgaaaccgtgtttgaagtccggggcagtgcaatttatgttgtcaaccttgcaaattgggaatgcacctgtcgaaggtggcaactttctggccttccttgtatgcatgctgttgctgtgttcaacagggttgggcgatctttctatgactactgttcaaaatttttcagaatagagagctaccatttggcttactcaggagcaatattcccaattcctgacatggataccgttgattttagtgctggggcaaatttgattccacctcctaagccacggacatcagataaacccagaaggaagcgttttaaccccaacaagatacctactgttgtacggctctgtagcaggtgcaagcaagcaggacacaataaggcaacctgtgaagcgattttgtagacaatggaagttctggattatccagtatgcgtagaaggtatgccttcagtccgtactccaaccttttcgtctcctaagataacctctttccttcattatgaagtttgaaatgtgtgagactgaaattcgatagtctgtagaaatccgacatcttaaacagttaaaatcgatatgccagttgtatctataagtataactgtacagaaagagagcttgttgactgaaaacatctaaatgtcaatatcatggtctttcatatgccaaaaaaggatatcctttatgtaaaattcatatatgccaaccctccaattcaggggcaatgaaaatgcaaatggcttgtattcgagaaaaagaaaatgcaaatggctttcctatggtattgcctattcttccgctgattttgattttacattctagattgtgatcctgggtatcaatttcctaatttgtaatggtatggggaggactatatgtgcattcccatgttttcgccagtagaaaataccgatatttatggaatgtaacagtagatatcaatttgctcacaagctattgttcccctctgaatatgttttcctctgttgaatttactactttccactggtagcatggaaccatatacatattggaggagctgtgctgtactggtgaaatagtaatttgggcgtactgaaaagtagttggtgtagtatctgttgatctttgtctgaaatgtttgactaatcacatattctgaacattttatctctgtttgacgattacagggtgaaaggtctgaagctttaagtggagtagcgctggtgagaagccgtagattttgttggatggatggaagaacgatgagatatgatgaatgataccaccgttttgtaacttaatattatattataaatgggggtggaaagatgtagtaatttaaatgtcaaatcttaagaagaagaggaatgaaggatgagctttgttagtagatagattatggttagcggtttagaagtcataataggtagcatggctgttgaaaatgatgatgattcaagtgtaccagtccatgattttaaacattgtctttctagtcttctattcagtgttaaggatggctatcaactagttaccttctcatgttgtggttctactatctgggtacatgcaatgtttcttttaagcatgcattattggggtgtggtcagtatatcttaatagctgcgtgaggcttactttggaacggaaaaatgttgacaaattcctggaaagaagtcgtaaaatttgtgcgttccagaaagcccctaataatctgatgttctttcatactacctaaacaaacaatatattagggaggggttttttgtggcaatattttgtgagtaaattgtatcggcaatctagtactactgaatttgtagaagtgccgtttttgatgtaggacttgcgtaatgcgtgtgaaccaagactaaagtggctgatctttttaggatgccacataagctactattaaagagaacatatcctatacacacaagcttttcacgtacactccgtgcgcacaaactatcaaatgacgaaaaattttagaaaaaaaactggacacatacttccaataatattacatctacgtgtaaaatcttatcatcaaattcattatattttagctggaagggtctacacgtcgggcgcccgatcaggattgggaaaaatcggactctgacatcagcatgacatcagcaccacgcatgcatgcaaaaccactttaaactgatttttctcttaaattatttatccaaatcatgatccgattacacaattaaattcattgtaattaaatcttaaaaataagaccacacatggatatatttcgatgaaattttttttagcttattattgaattatttttaaatgttgcacgatgttccaccacgtatattggaattgttttactacgtagatcgaaaatgtttcaaccatttaaatcgggtgttatttcaccttatataaaaacaatgtttcagttcactgcaacattagatttatacatagtgaaacattgtgagtacactaggtgaaacatttttggtggaacaaaaaatgaaacgaattctcttaatagagggtttccaaaatatgtgggtgatttgttgcaaaagaatgtttcagttcactgcaacattagatctatacatagtgaaacattgtgagtacactaggtgaaacatttttggtggaacaaaaaataaaacgaattcccttaatatatgggtgattagttgcaatggagtatatggtggagacacatggtgggcccaggaaggagacacgtgcgcatcgggggggggagggagggggggagagcgtccgatccgtctccccccgcgccggttgcccggtaacaagcaatttcgattttagctgtaacaaaaaataatacaaaattctaataaatttttacctataaaactgttagatttttcacttttttgctacggttaaaatataatgaatttgaatatgatactttgcaaatatatgtagtactattaggagcaaatgtctaatttttgtgggacatttgctagttggtgtgcacggagtgcgcataaaaaacttgtgtgcataagctatgttcccctattaaggtattaaggtatgatagttgtagagagaaagtagctgtttataagccaatgaaagatatataggctgaggtcttttatttgagtcctagtttttcccgcgtacgtttttcaaactgctaaacggtgtgtttttttaaaatttttctatatgaaagttgctttaaaaaaatcatattgatccatttttaaatagttagctaatacttaattaatcacgcgctaatgaagtgttccattttccttatggggaggtggagttcgtagcctcacctcccgaacacagccatagtatgccttagaaacacttaaagagattattcaaagtgttactccctccaggctgataatacttatcgttttggataagggtgaggtcaaactttagaatctttgattatgaatcatttttaaaatatttgtctttcaaatatggtgaccacatgtatagattagtcttaaaaaatactttaataagatcatatatttgttaataattttttacatattatgatagaaaataatggtcaaagttgtttttttaagaccgtgcccttgtccaaaacgacaagtattatcaatctgggggagtacacacatcttttcgcttatgtgtatagttataagctaaaatttgagttgattttgtgtttttctttatcatagtttattttatagcatttatttttgagtcgctagcaaaacatatataaaagttttattcattgttcggttgctaataagtggtaagaatatgtataagattagcccaaacaataactccgtaaatctttagttagcacactgctacgcaagggaagccgattttctgacgttgctgttcaccttgactgcatcactctagggcccacatattaaccgttaagttggagggagatctcaatccttgtcaccgtaatcactttagtccacctttcccaactcatttttcacgcacacattttctaaacggctaaacaaatacataattaatcatacgttaatgtttaatgagtagcttcattttgcaggtggaaggattagttcccaaccataggaggtagcagttgcgtttgttatgggctttgggcccatgagatagataagatcggcccactaatcatagccgcgggtggggtgtggcgtgttgtgttgttgcctccgcctccgccgccggccgctcgagcctcctcctctcccgccagccgccgccgccgccgccgctgcttgcttgcgatttttcagatggagagcccgaatcagaaccagcagcaggagagcagcagcggaagcagcgtgatgtgccagctggtcagtcccgaaggagaccaccttggcgccgccctctacttgcctcacaacgtcggcccgccgcagctgcaggagatcgtcaaccatcttctccacaacgtaccactatctcttcctccttactcttcttcttcttgcctgcctgcttgcctgcctgataccttttttttttaatttcatattgatattggcttagggaccaattttatttcttctcctttttttcttttcttttataaagaaagaaagaaagaaacattacaatgtatcaatctgcctatctagacaacacataagctgtctgtactcgttcctagggcccatttgaatcgcaggattgagaaaacgcaggaataggaaaaacgtaggattttaataagaatgaagtgtaaaacagatgattgcaaaacgcaggaaaaatacaggaatgaccgtttgattgaaccgcaggaaaaacgcaggaattagatgagagagatagactcaaacgaaagttattttttcttgcacaactctttggtgagagaggaaatccctttaatgtttaacaagggaaaaaatacaaggttacaattcattatgacaagtttaattataatatagtaaaggggaaatatttgagctaattgtcacgttgcatttatcttcacctatgtaatgtactcccatttggcagttgtcctgcatacttacttgtgtgacctcatcactctaaacatttactttaggaggacaagctgccatatgcattctacatcggagatgaagaactctctgtccagcttggtgcttacatgcagcaaaagaatggtgagactccactcacaagttcatcctacatttcttttcgtcgattaagaaaattaaaacaaactaggtgttgcatctcatttctgatttctatcttttgatttttgttaaatgaagcaaatgttgaggttaccctgcgcatagtatatcaaccgcaggcaattttccgtatcaggccagtcaaccgatgctctgctacaattgctggtatgtataccttggattacgttcatttcattgttttctttttccattacaattttaggactcttttatttgacatgttctcatattgctgggattacaatgggaatatcatcggacagacaaaccctttgcatccttgttttatttgtcattgacagcaccagtaccagcctcaattatgtcgattttgagctttcttataccactgcgaatgatgtaatttatcatctgcaggccatacagaagctgtactagcagtttccttcagtcctgatggaagatgtttggctagtggttctggtgataccactgttaggttttgggatctgagcacacagaccccattgttcacatgcaaaggtgaatcttagcattcttgcatacagataatttcaagtcatttttctcataccttaaataagtcgaatgcccgtaattgcattggtgcttgttttatagagttacaccatggttattgttctttacggtaacctagtgcttaccaacacttgattaacaatttctcatgagagagatcttagatgattgatgcaaaagtgtttagcaactcagtgcttatctttatcaatatgtcctaactcacaatagacctgtaagttactttcagaattaatcttttttaatggtagacctaaccttaacatgtactggataatcaaagcttaatgtttgataccatagtatacagtgtttgttccttttagatgaatttagtaggttgagactattaaaagataacataatttattacttgtaattaacacattacataaattgtttatttgtcgatattggatgttcagacgacctaataggagtttactgttgtaacattgtgataaaactcatgtttatcagacattacttccagtgcatttgagtataattttttggtactcttagtctcgttgacagttccatttgcatatcggtatatccaatgtttttgagggtgataccattaatatttgaaagttatcaaataacaccgcatcttccaggacacaaaaactgggtcctctgcattgcatggtcgcctgatgggaatcatcttgttagtggaagcaagtcaggggaacttatattatgggacccgaaaacaggcaagcaattggggactccacttacggtaagattatgacatctttgtctttcaacctgtagtttttgtagaagtatgaaataagaattattcagttgcatatttgcagacctaactgccctatgtgtcaattcatgtgaacctggaaaatatatgttagttacttagttgacttgaagataactgctccagttcttttttcttagtaccatggattcacatacacttaatgttggaaatagtatatggagttgtactttatatattgcagaagtttcttttttcttgccatgcagtactcattgatcattgcctttactcattaggggcataggaagtggattactgctgtatcttgggagccagttcatttgcaatctccttgccgccgttttgtaagtacaagtaaggatggtgatgcacgtatttgggatatgaccacaaggaagtgtgtcattgcccttacaggtcacactaattcagtgacttgtgtgaagtggggtggagatggtttgatttacactgggtaagactattacaccttctgtttctattataaggcgtattttgtttcgttaagacaagggtttgactaacaatttctttacaagtaatatattatttatgcgttacaaaagtgtaatcataagtaagtactttcaaatacgaatctaataacatcaattttgtgtcacacaaactataccctaatggagtaattattggtcaaagtcttgtcctaaagaaacaaaatacatattatatttttgatttttcaaaaaagggagacatacataggcagtcctttcagcattttgaaataaaaggataatgactttttttttcttttgtacttggtcacttttggttattgccattggatttgttaaaataggaacaacaacaaattttataatgccatcatggcaccattattccatggtgcaagaaagcactaggcgttagtcgggtggctgggtggcgcctagtgcctaataggcctaggtcagaccaactagtcaatccaagaaactagcaagcatattacataaaaaatagactatataacactgagatagcaagaaaacaccacgcaaggtagttgagtcacctaatgcaccatctaatgcgctacccagcgcctagtgcctaatgggttaggcagtggctagggctgtgttttagaatactgcattatttaggattgaatcatataccagcgttgtgatacagggaatatatttgtagtaaaatcgtattgcgcctgcatatatatgatgtatgaactctatttctgtttctgctgctatgtttgacagataagttaatcgagatctcaaaccactgtttgtgactagaaattctgaacatgacagattcagttcagattctattcaatctgtattttagatggaatctatttatataggaatgcttactgcttctactttggcaattgtgagaaagaactatcaagatagcttccagcaacacaggccacaatcctttattggtgccatacagacaattccctacatttattgatatttatttaattgagttattgtgagaaacccaatacgtaagtgacgttccgttagccaaaggatacacttttgctggtaggaataggccttgatcaggctaagagttccagttacttcccttttcctcatactccgtttactattttgtttatttataatagacagctataacttgaggcaaaagtggtcgagttcttcctagatggttaaaattaagtagctgaaagcatatgcgtaatcacttagtctgttatctcatttatcatgaatgtttatagtgttgcaaaattaagtagctgaaagcatatgcataatcacttagtctgttatctcatttatcgaatgtttatagtgttgctagaaatgatgtttaatgctatgctgtatgtttatttgtacaaaatgctgtattttacagatacagttcttaaaatgctatgtacaattctaaaacaaatgtatgtgtactgcagttctgaagattgttcaatcaaagtgtgggaaacttctcagggaaaattggtcaaaacactgcaggtaatgtaccagcatttcagtggacattcaaagatttatgcaaacttttatgctcccaagttggctttgctagtattgaattatgagcaaaatagcaaatatcacacaaccacatgctttatgaataaagtaccagagaactacaggttttatgatcaattccagagagatacagattttacgggaagttgtattgggaaatggcagattctgcagcttctgaggaattcctggcctgcatgttctacatatggacataaatgggtctggagatgctcaaacactagttaggtcccgctgaactttcaactttgcgtgggtttgtagtgtaactattgtaggggactgatactacacacgttctagtcatgcatcatccttacctacagaataagcacatgtgaatgcatattctttatgaacgacatatctgaggcaaacatttttatttccttctaatgttgatggcaatgatagtttaatctaggggtggaaacgagccaagcctggctcggctcggcttgcagtggctcgcaaaaaagtaggcctggcttggttcggcttggttagggaaacaagctaaaacttgagctcggctcggctcgttctggctcgagctggcttgcaagccttcctgttgaaatatctcttcatatatattttataattattaaaaaaagtaaaaccaaatcatcaacatgtaaactttaaataagtttatatattcaatacttcaaaatcttgatgataaattttaagttgacaaattataatgccatataaagtaaaataatcgatataaacacacgatgacctaggctcgcgagccaaaacaagtggctcacgagctagctcggctcggctcatttcagcaacgagctaaaaaggaggcaagcttggctcgtttggcttacgagccgagccaagccaaccaagctcgagccaagcccgagctgagctcacgaacccgagctttttttccacccctagtttaatcttttaagatgcaagtagcctatgaaaggccatacaaacttggtttgggctcaaaaaacaaaatagcaaatcaaatttacaaggatgcccatctacagcattctaaggccaaaccccgataccaattgctttgtgaattagagaattcattgccatgtagttgatggtttactctgaccagggggtgttagaggaagaaaaaaaacaaaatttactttggaagacgtgtgcatgctatagccatgaactgagggagtaattttgtgtgcttaattcatgaatcgtaccaaataaattatacattctttcaattgtgaactgtcagctatacccaggaaacaattttgtggaatatctttgatctgattttgcctgttttttgcatgtgctggacctattattttggtagctgtgaactattaccttgctttcaagtcagctattctatgctagttgtcactgtcatcttgttaaagtagttacacacttacactgcatattcagggtcatggtcactgggtcaattcacttgctttgagcaccgagtatgttttgcgcacaggggcatatgaccatactggcaagacatattcaacagcagaggaaatgaaggaggtatgatgtgatcataaattagtgttagaactgactcttaatattttcatttgttgcttgctgaaatgaattttttcacctgagaactttggatatccaggcagctcttgcgagatacaagaagatgaggggcaatgcacctgagagactagtttctggttctgatgattttacgatgtttctctgggaaccaacaattagtaaacagcccaaagcccgcatgactggtcatcaaaaggtatattgtcctgacagctccatgaaatgttcttgcatttgtatcattgtatgtacattttgacttgtttatgcattcagttttgtctcactgaatactgagaaaagattgaaaattctatgagtttcctccctgaaacttgaaaataataatgaatcggtgtcatttaaaattaatggtatgagtgtttccaaactccaaacccatctatagaacagattattgttgaaatcattaggacttgtgtaagttgtcaaatggcatgaacaagttgggagcgctagataaaaaccattcgatattattgcaagtcgccctcgcgcggcggctcgggggcgaaaccctagccgccgccgcccttcttcttccttcttcgtgcttcgccgctgccggagcttgtcaccggcaaagccgggcgacgcgctgggatggcggcggcggggccatcctcctcggctccatctcgccccggcgcgggcgtggcgacgatggcggcgggacggcgaggtcgcggcgacggggacggcgcggcggtggggctctccacggcgcggcggcggggctctccgcggtggtcggctctggctccggcgacgggtgacggagtcgctagatccggttgcccctctggccggggcgaccggcgacgggctcggtcgacgccgacgccgctcgggcgtaggcggatggccggtgacgggcttctccggcgtgggctcgtcggcgacgacggcatcgggtcggcggcggctcgcattcgtcggcggcggctccagtccggctctcggtggagcgcgcttcggcgccggctgccgctgacctggccgggggctgccgatctgctgcgattttgccggcgacggggacggcgcctccatctccctccctcctttttctccagatccggttcccctcttctttagttgttcttcttccagtgctcaccggcggtgcggcgcccgctcccctcttcttaggggctcctcccttcttaggctaggctacttccagttgttgccggggagctccttggtgcggtaggggtggcgtgcggagttggtttccggcgtcctgtctcgctggcgtcggccgcgccgtaggtttgctgcagttgggttcctgtgtgtgaggtggtctctggtcgagctgcaatgtgattgactgttgaggcagagtcggagctgcttgtcttgcaagctcggcaacgatgaccctcaatagacgtccaggcaacgcgatgagggtttggaggtggagcattttgagagagtctcgggtgaaaaccttgcctagtgtttttctaggttgatgatatcgacgcctgtgggtgccgtttcctccttggaggtatcgtcatgatggctctctctcgctttaggtgaaaactgggttccttttggaacgggcgttgacagcattcttgatgttgttcccttgttgaaggcttcgctcagaaggtttctgctccactagaggatgtttggtggttctggagaccttgtgcattatgttgtcgaagctgcttgcctttggcaagctcggcaacgatgagttttgtgaggtctcaatagttgctttcttttccttttctgtataggttttcgccggtttcccatttaattaaccgtgcttgttcggtttttgggcccggtttcccttattaactgggccaattctcttctataaattccggcgggagaaactcctgtcgtcggttcctcgaaaaaaaaatattattgctttttttaccaatgcagggtaaatttttttatttaagtgtgcttggaaatgattttgtcatttgcttttctttgtgcagctcgtaaaccatgtctacttctctcctgacgggcagtggctggcaagtgcctcctttgacaaatctgtcaagttatggaatggtattacaggcaaatttgttgcagctttcagagggcatgttgcagatgtctaccagatcaggtcggtttttctatcttgctgtttccattgtatgtacatgccgcaatgcctaatatcatcatttctgtccatagctggtctgctgacagtaggcttctattgagtggaagcaaggattccaccctaaaggtatctatctctgtctccgcttagttctctgtcttttacctaactggtcaccgacatgccattcagtctgtatgttgtcaatctggcactggaattcattatatcagaatacttgtctttgaggagttaattctgtttgcttgagtagtcatccgaaaactggtgaatctgacataaatattggttggaactgccaagtgtgactggtatcatacaattgtttttaggcatgcccttttaattatgtttctattaacttggcttgtaaagtccattacttgcatagcatggaccatggaactgatacgttatgctcggtctctatttgttggtacgattcaggtctgggatattcgaacacgcaagttgaaacaggatttgccagggcacgcagatgaggtacatgcatgcatattttggaacaataaaaatctgaattgaaattattatagtgtagtaacaaagattatgtatatatatataaatgtaaggtgtacgctgtggattggagccctgacggcgagaaggttgcatctggaggcaaggacagggtcctcaagctatggatgaactagttcccttagagttaaggtacttagctagtagcttcttgtcatggtggctctctcttgttcttggtgagagattttgtagggttgggttggcatttcttgtttttattttgcaaccaaaggcttgagggtttatagctggttttttttagataatggaatataatattccggtttttgttcaaaaagaactacagccaattattacaaagatccactccagaagagagtgtagtttaagacaagttgaacacaccaaataagagaagagataacccaaactgagaaaagcaaaacaaaatgtggaggctagaaggccttgtcaaggcttaggactgaagtttgaagccaatgcatagatcatattctcattccccggttggatcaatatatatatatatatatatatatatatatatatatatttgttgctaacttcaattgggtgtatacgtatattatttcttcctcctactgtaagggatgtaaaagacatgacaaaaatggttactccactggttagctagctaccatgggcattattatattaattaatcggatgtgttaacagaaagaaaataacatgatatggttgagctcgtttgagtggccttggattaggctgatctcgttttggcaactagctacggcaaccataagcatgttttgtacggaagtttttctatatagtagtatcttaaaaaattaaataaattcacttttaatttataataattaatactcgattaatcattgtgtcatcgaagatccaaatgaactaagccttacacgtccaattggcttgcggtcatgagttgggaagagagttttttagcatgtggatcgagatgaccttacctatgtcacttttccaaaagattaaagatgatgaaaaacagaagcttttctcccgatttgtaaacaaaaataaagacaaaatcatcagagtatacaaacgcgtacagagtatgaaaattgaactaaattgaaaaaaaaaagaaacaatggctaaagcatcagagtatccaaattgaactaaatggaaaaaagaaagacttgtaataaaaaaaataaaaaacaagctcacaaagagtatgaaaattgattataaatgggaaaataaataatattaagtaaaaaacggaatgagcgcgccaggnnnnnnnnnnnnnnnnnnnnnnnnnnnnagnnnnnannngnnnnnnnnnnnnannnncaggcgcttgtgatttcatgatgatacaaataatatttagcctaaaacaaataaattcaaagaacttgcagacacaaagaaaatacatacattatctctatgcgcaacagaacaacaatttaattacttcccccatctgtacaaatatttccggctctccatacgatctgccactttcacctaaaaatttctgagagttgattttagattcttcacaagttctacagtggtacaagatgcattatcaatctgcatgcaaattaatgaataaaaacatattattaatcttcaaaaataccaatattaaactcgagacaatcatcatcctatttcattatgtacttttgtaaaaaaaaagagttcctacacaagttatagtctcctctaattggtaaaaaaatatttgacgtttaggacaaaattcggataaacttttgaaacttttatcatcaatttacattagaataagtttgtaaaacataataagtttttatagtaattttcaacgcaaatctttgcataccatttcttaactaagtatttgagaagttcttgacaattacagacaattacagttcttataaaatttgatcaaatcatgttaatatctatatctatactatcttaaaagaatccataggtggtggtgccattgactgtggaatctacatacttcatctcctttatttgctctcaccaactccaagtcacaggctctcttaattcttagacttctaagaacgtttgcaaatcacggggattttggacggatgggatatttgctagtactataaacctggacagactccccgtctagattcattgtactaggaaatatccaatacgtccaaaatcctttatattttaggacggagggagtaaaatataatgggagtaagttatggagtacctgtgctgtaatggtgatgtttagtgatgaatctgcaaatggcacaacattagtgttcatggtggacaggccgagcttctcgagctcggtcagcagcttgatcaacacccccttcttctcagggcacacaaccctcagcagaacagtcgtcccctgtaaatttgcctcaacttttatctccacctcattgttgttaccatcatcgtcctcatcatcaccggagccggcacggctgcgagcatcggaaattgggggttgcgtgctccccatgctttggatgtcctgcaggatcttcaccctctccctaagatggtgcacatactcaatggtgctgccgagaacggagaccttgtccgtctgagaaaaccaggaaatcctgacggcattagtcatgactgtcgttacgaatatgtggcggcattgttattatctatcgaccgttgtgtcaactgctccctcccctaaatatttgacgccgntgacttttttaaacatgtttgaccattcgtcttattcaaaaacttttgccaaatatataaacctatatgtatacataaaagtatatttaacaatgaatcaaatggtagaaaataaattaataatggcttaaattttttgaataaaacaaacggtcaaacatgtttaaaaaagtcaccggcgtcaaacatttaaggatggagagggagtatatatttaccttagtgatttcggggacgatagatgctagagttgtaaactgctggtgcatcttctctcgcctctttctctcggcgataacatgttcttgcatgctcgaggtcgccctccttccgcctctcttcatctctgacagcggcgagcagaattttgtcatgggaccactatcctgctgctgctccagcgccgagaagttgagtgagctggacgagccattggtgagggagaagaagctgtcacgaattgcagcagctgctggtgtgtggccctcgggcttgttaatatccccgacaaaggggaggaccctcagtgatgggttatggtatccatgctgttcttcctgttgttcttggggctggttaaaaagctcgttggcaagggattcagcgagttgctgcatgctgagagggtccagatgctcaagcgctctaggatcatcatcattctcctgcataaaaacaatgcacatatagcgcccaatcagtaaagtacctcgtctgcaaaattaacctagatgccaataaactagcacaacatataatagattcccttgtgataattaacacaaaagattgataaataacttagggttcttaccagttctgcaagccattgcttggccgaagaatccatattcagttggagtttgtgcaatcctggaccagaaccaccataagaccactgatatatagtttgtgatacagttaattacttgatgccaaattgcaaaccttgatggctactttgatgcccttgatcaaattaattcagagtagtcttgacaagccacacacacagcgaagaagaagaagaagaagaagaagaagaagaagaagaagaagaggataaggaaagaaccaagggaggacgaggaggagaagcagaaacacatcagcagcaaagaagaagagcactaggcactagctaatgtaagagaacaaaatggaagctggatcaaaaggctgtactactatataccttctatactgttgctctggtaccaagagtgtgctactgtactaattattaactggctgttagcttcacccacgagcatcctgcatatgaccaaactagtttattagcatcttagcttgtattgagttcaacaactagaacatccataaaaatgatttttttttaaaacggtccataaaaaagatgatttagcaactgtggattccaacttttgagcctccatggcatctgcatttgctagcgactatctatcaaaaaaaaaatgctttctaaccttgcttcatcatatataactgttaacgttgacaaagtactgaaagtactacatgtgttttagctgagatggtttttctaaactagaaagcaattgcacacattattttttaagggcccaacactcgatctgtggttgtcaagttttccttgacaacaaatgtaatgaagttaattagttatgtttattgtttcacaaaaaaatgtattaatgatactatatctctgcaggtccaggtgctcctgaagtcctgttcttttgttattcacctaaaaaaattatgacaactgattttagattcttcacaagttgtatacggtggtggaagatccattttcaatgtgcatttccaattttccatcaagaatgctttaattaatattattatattttcgtagtgcgaccgttatgaacatgtttctatgaaaattgtagctaagactttcacaattaataccatgcatgttggagtatcattatctataaaaaaaacatgcatgttgaagaataaaactgctctaatttagggatgctcattatctatcaagaaaatgcatgttgaagatagaaaacaaaatgcaagttgaagtctgaaactgcccttatttagggatgcaagtaggttttgaagaactaaataaacgaaaacacctgattagtggagtaggccatttcttggtttgctgcaagcctgcaacactatatattggttagattttttgtctggttgcaagttgactcctctcgttgtctttgagagatcaacccctatctcatgtactccctccatttttcaatagatgacgccattgactttttctnacatgtttgaccatttgtcttattcaaaaaatttacgtaattataatttattttgttatgagttgttttatcactcatagtactttaagtgtgatttatatcttatacatttgcacaaaatttttgaataagacgaatggtcaaacatgtgagaaaaagtcaacggcgtcatctattaaaaacggagggagtaatagcaattacattaattattacaaatatgtactagctagcttgtgcatgtgcagtcaaagcctcaaagataattaaggtgatttttaatccctcaacaaggcccaattgctgtactttccgcactttaattaaagcaccaaagatgaagtgtttgtgtgaataaaaaatggggtgggttgtgtgtgtctatatatatatatgaatattaatagcctgacattaattagctgcgggcgtacaaccagtacgctgcacacgtgctaactcttaatgatctctggaccgtatcacagcttaaattccagtatatcacagcttgatttatgaatgctcaattgttcatatacaagagcaattagagtcgtctgttcttgtatcatctactaaaaacattcggttttgataacatccgttttagtcttcatcctattggggtggggaagcacattttgtgtgatggtagagttcacatgaagaattcatgcttatgtgcatactaatgcactaggttgactacgtataattcgtaagccgctgaagaaacaacggttatatatgcagttcctcgccaaccatagatgaaagtttgttatttccatctttagggtggtgttctaataagtatttttctttattttaatcaaattgtgattttgtaattcgtagtcttttgacctggtacctcatataagtatgtaatcaaggaaaataaaacgtttgcagcaaatcaaaggagaagatggcacggagagaatcatatgcatgcagtaagggaggggtgtaacatgtgtgtgtgacggccaatccaacctgagattttctttctgaagaaataaggtactctcatctggcatgttacgttgcagcttctcctagcttgtagaaagcgaattattcccctacatcatgcgtgttcgctggcttgtgattacgctaataaatgcattattaattagttccctccacatattgatattgccaaacaacagtagcaggatgcctagctacatacttgcacccacagtttggagtcaaaaccacctgggctaagtcaattggagcatatgttacgtatatgcaatgaactggatagaaatatttctatgttgatacatcctacatgatgttgaaaacctaaattaacctgatctcctcgaaaaaaaaaaaaaccctatcgtttatatatacattgctagctataggtttatctatgaattcaatctacagttatgtaatcaagctagtagttctagttgatcagggcttaacctttcttccagaaccataaggcaaaaaggcacaagaaggagctttctacagcagagtatctcctttctttcatgtagcacactaatcaagaccttaggtgcaaattgcaatgggatggtgcaaactctaagtaagcttattaattagctactacatgccaatgaatattgcatttgtgtgttttcctacaaaactatctaatggctccttgcaactaacactaatctcatactcctttagttcccccaaaacatatattacgtggtaaaaccaaactattatttcttttttgtcagttgactagcattaataaccaacatggccaacttgatgaaactgcgcctatgggtcatgaaaactgctgtacgtaccatttgttttttatgtgctatatatataaagatatatacacaaggaatagttcatatatactccctgcttcttgttaatgtttggccttgtcatacattaactgtgtcatttagaaatagggaaaatacatctagactctgaaaacaaaagggaactgcgatattattctgtggcatttcatctggttgagttattctttgtttgcaaagcttgtgaaccactcttacttgttcatctttcagttgtttaaaaaatctatataccagacggaatcaaacagaaagaatgtaatgtattctcctagtctaaatgaatttggattaaaaagcaacaaaaattaaaaccagaaaagtaatgtgctttcgttgagagtcgaactcaagacctcccgcttactaaacgnnnnnnnnnnnnnnnnnnnnnnnnnnagcttttgcagcaaattattatttataaatatttattcttttacaatcagaatttatgtttttagataatgtcagtagtttatgtaaatttgatacattaatttacgaacaggcctcgcctccttgtaaataaaacaagagacagacctaatgtcacactggaccaaaattatgatttacgtcagaacgttctttagaatacgaattcagaacgaaatctactttatttcctacctttcaaattgctctgcatttcctgtaattctctacagaaattatgcctctgaaacgagtattccacgtactaaatatcttacactagaacagcaaaagttaaagactggaccaggagaatagtgggctagaacttaaaagacaattattatgggccgtaatccatcacaatctagcttagcctgatatgcctgttgattgcctttgtctcttctttctcataacatgcgtaagttagggcccatttgggaggaccaattttgtctaaattcttgcccaatatggactcccaaacgaaatgttaagagattgggaaaaaaatgttaaagtgatggattcccaaacatggagaaaactgagatatacgaccctgcaatcagatcgacctagagagccagcagccctgcagagaagtgttttggcgaaatcgacgttatcagcaacaccaatctatcacctatctgccttagcagaatataaatggctctacaaaagatcattgttaatgcaggaagcagcttggaaaattggcaggtaagtaggagtagtatgcaagccaaaaaatctgcttagaagacattggccctgtgagtggatctgttgtcgttagcactttcgaagatgctaacaatctggaaacaaaggaatgccgcttcaccaatgagaggtgtggccgcttatctgtaactggcaaggaatgacagatttttccaaaacaacatctggctggcaatcgacatcagagagtggtaggagctgatcattatcaaatcaatgccaaagagtatactaggaaggaaaaactgggagctcttctaataacttggtggaacatttggcttgaacgcaacaggaggatctttaagaaaattttgtaaaatgaaactcagggtgtgtttagttcacgccaaaattagaagtttgattgaaattggaacgatgtgacagaaaagttagaagtttgtgtgtgtaggaaagttttgatgtgatggaaaagttggaagtttgaaaaaaaaattggaactaaactcagcctcaggtgtcctttctcatgaatgaaaacctagatgaattcgaccttgcgctggcgcttagcccagatcagatggcttctatcccagcagtagtgttttcttttatccctgtaaataggctctgagtttcttttcctgttcctagccatcttttagtacacatattgtattaaggcttgttggccaatttactccctctaatatatttggcaaatctcctgcggtccgttcttcaaaacaaaataaagaaaaaggttgtaaagagatactccctccaccgttcttaatacctaaactatgtcatctcagtttggtattaagtaattagattttgacaatgaaagttgtatgattatattcgtgatattatatatttcaataattaatttatcgtattttcaagtatttataatttttttgctaaaaatggatgtggtcaaagcttaaaattgaatcgtgccagtgcaaattattcaagaattaatgtgggtaggatacaaaggtaaaatgagcgcccaatcattatcttgaaaggaatcgaattgatgtggagttaatagaaatattgtaatatcaggcattcattcaggtgcccttaagggatcacatggatatatcaattgtcaacgattcccatttagctcaacactcagctgttgtggtcctagttcatgttgctttctttctttctttctatccttgcatcattctgtctcttcgaatgaaatggtgttaaaatgtcaaactagctaggccagagctgtttgatatcatatatatatacctttttcaacattttcaaacatcagagctactggatagccattcctttgatccaaatgacaacataggaacatttttcataggattgaattcctccaataatcctttgttcccaacgagctctaattaggattacaataattactctgatgttttcttcataatttttttagcgagaaattgagaacaagctgttataattaactatttcccttaaatttattgtacacactctgcatggtctgtgcacatggtgcacaggaaaaatatgtttaatatttatattcctgtaacatttataggcaaaatacttggggtttaagaatgcttttttagcgatgagggcttaaaaaatgcttaatttgcttttctcagacaaaattctgcataaaggggatcattcctggcttaatttattggaaaccagggtatattgaaggaaaaaaatagagatttgctccggtccaacaaaaagtacctcaaggtaccgatatctcacgataccaaatcgtttccgatcgttggatctaacaatgcccatcctgcccagctagatccaacgatcagaaatgatttagtaccgtgaagtaccggtacctcgcggtactttttattggaccggagcaaatctaaaaaaataacattcatacatgttcttattttcttaatattaaattgagttatatagtactccgtaagtgtttttccatgaaataaataaagtctagtaagaagatatatgctacttcctccgtcccagaatatagcaatataggatgggatgacaacgaatctgggttagggacggagggagtacactccaacaaataaacaatatttttttgagcgatacaagtaaataattaaatactacctccgtcccaaaataatttatttctaggatttaaaatttgtcctaaaataatagtaattctagagtactaattgccccatcaatcatctctcattcaaatttctctctattttaccctcaaccatctttccactctcacataaacaccatttaatgaggagcaccatagtctttcttatcaaaccttaatatatgctaaacaacatagaattacaattatttggggacagaggtagtagcaaaagtgagtaattaattaaaacgaaataaggatcggagaagcaggcatgcattgcatgatcatatggtgcaatgatcatggtattaatatatggagtatatatatatatatggtgcatgcaacaattaagtagaaaggttgatatgatgggcagctaattaacagggggttaaacactgtagttgatatgcatggaaaagtgatgtttgcccttaattaatcggtgtatgttcctctccattcaaacttcatcactctcattcacgtgtgctcgatggttaccgcgcatacatacacacaatcacaccagaacgaacaatatcaataattttcactttgattaatttagtacgtagtatatctttttggacggtggataccaaatctttatgtgaaagatacaagcacgaacacatatatgcatgtgcatcacctgttacctcgatcgactttcaaaagagtaaattccaacagaagctttttccagactgccaaaatcactgttcacatgtggatgtagcaaccgcctaaaaccagatgtcagatttttattaacaagcctcagaaccagaactatatatatatatgtgtgtgtgtgtgtgaaaatcgattttcatagtcgacgacacctcctaaaggtatgtatgttaacaaaatatcttttggctgaaaaagaaattgaaaaataattaataatccagaaaccgttgctccgatcgatccctagaaaacaatttgcagaaaattccacattggtgaaaattcatcaatgaagccaccgctgtcgctgcaatatatatatatatattccatcgccagtgcgatgaagccatgcatcgttgttgcaagctgccattgtcgctgcagccgtagtgctagctagatttggaggcctgccatctggatacacgcaatgttgccattaattggacgatcatctcctcaactgtcgtggatccagaaggccctgaggtcaccaacgtcggtgcctgagctcatgagcaacgtacgtctcgtccctttctcacgtcgtcatcggccacaagaaggaggagatcgatgggaaacatacatgagagagagggaggttgagcatgacggggctaaggggacagcgtgagcgtgaggggggctttgagtgattttcacaagcggttaacttacaagcaccgcctgtgacaatatcaatatggatatatttcacacgagcctcctaaaaggcttgcctgtgaaaaatatcagatattcctcctaaagggacgactgctagtgaaaatcaaattttatgggcaggtcttgatgggggagtccttttcattttcacaagcaactcttcttttagctcgcttataaaaataaaggcaatatgtacaaattaaaaatggttttctaagtgatgttaatttacatgtcggaaaataacaaaatatcaaatcaaacaagttcaaataatccagaatttcgtattagcccagctatttcattattgctttaataatttccatcggttagggacgatatagagttgatatacatgacgcgtacagttttgcatacgtgagtagaggagccccatatagcagcaaggttgtctgctaattcgtataagagcccgtacaattacaatgtatagtttattttacatccactagtgaaaaaaaacagatgtacacaataattcatgtcccgcgcttacatctttaattagacccaacattcgatctcattaaggagcactggtggagaaaccctttgtagtcccggttcgtaacccccctttagtcccggtttgaaaaccgggactaaagatcgctatctttagtcccgggtgaaataaccgggactaaagatcgatctttagtcccggttggtttgtttttttgcatcgagatgaccttttgttttgcatgaccctgttgctgcatggtttatatatataatatatataaaccatgcatatatatgtttcagtacatatatgcatatataatatatgcatatatatatattatattatatttatatatgtttcaatacatatgtatatgtatatatatatatatatatatatatatatatatatatatatatatatatatatatatatatatatatatatgaccaaaatatatttacattatagaaaatgtgtacacatgcatatagaaacatatgtagtcatgtattaattacaatccattatatgtcctagctagctatgatttcgacgtagtagtagtcgctagctcagaagctaaggacctatgaattgtgtttccgtcgtagtagaattcacccttgggatcaagaatttgttcgttgatgaattccatgagttgttcttgaaccgccgcgataaattccttgggtgtggtcaggttatccctcatgcgaataaactatatgaatgtatgaaattgattagtaattaaacaagaaatcgatacgtaatgaaattttgaatttatttgtacgtacatttagctctcttgtggtgatgatttggtctgcaaggcagtggcaatactcgcacacgtaatagccacacaagttagttcccttcttttgctttgcgcactacaaataaatgacaaacaacgagagatctaattaatatacacttgtatgtatttgaatcggagaaatataaatgtagagcatgtgtactcacaggaaatttgaaattccgcctaagtctttctctccatttgccgcggaccaaatgacggaaccgataccaagccctacatggagtttaaagctatgattcgtagtagcaattaacataacaagattttcttaattaacagaggaacttatgatggtatctgtctataagttcgaaaaccttgtcaaatgtagactcctttttatccattaagtcatatacgttgacggtgcaggccgacaggtcgaagagtaaaagcacccagtggaatttgcaatgtgcgtgggatgcattacatatgaaacacttagcaagttcatacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgctgtcgggccctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggtggcgctcatctccatgtacagctgatggaacttgtacatttgtgtgggtagggactgcaacagctcaggcttgacaagcggtttaccgagttcgtacatgtatttcacttccgccttttcgattggtgcgactcctagcaattgatccgtagttagaccggtgtcagtaataaattcttctatcatcatttctttaccggtcaccaacggctcgatctcctggtttggttgctctccaagctgagggactggtttggactttccagaagatgctttcttcagcgttcgctcatagtccgatagcttaatggcctccttggcaggtgcagacatacccctgaagaagttcatgacactcgggtctataggaatcttcttttctggacttcgaggcttgaattgtctcttgacttctaatgccacgtaagcgtcaagctcctcttgcgtgcaatcgtactctggatccttgttcttggcggcgtcaacttttcccttcttcgttgcccttgtgtgggcaggcagtggagcttggggggcccttgactttgaaggtgccggaagaggagcttgcggaggagtcagtgcaggagcctgaggaggagtcggtgcaggagcctgaggtggagacggtgctggagcatgaggaggagacggtgcaggatcctaaggaggagatggcggagccggaggagatggtgcatgagacgccgcttgtcgcccagggaagatgatgtaccgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaaatacctgaagggtccgttgggatggccatgcccgacgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacgaggcaggtggattcgtcctgggtttgcatggcgtccatgctctgtgatcctacctgccccgttgaggcgtagctgctacggtttcctgacgggctcaccattgcaggaggaatggtcggctggggatcattggaccgatgtgcggccatgcgttcatcaaataatcttatatgctaagactaaatgaacagtcatgtatgctaagtgtaactgtcgtatattagaaccctacacaatcttagaagctaagtctaattacaaatctaataatcttatactaaaactcaaatagtgatgatatatgctaagactaggtgacgtatattataggaccctagctagtcaataattatatactaagtctaattacaaatataataatcttatattaaaactccaataatcttatactaaaactcaaatagtcatgtattctaagtgtaactgtcgtatattagaacactacacaatcttatatgctaattaagtctaattacaaatctaataatcttaattgcattacaaatataacaatcatatatatataattacgtcacttgcctgggagaattccttcgggggctagctctaccactccggcttgagggacgactccgacaatgtcttttctgcaagatacaaaaagatgtattaggataaacgcgaagtaacatatattgcatttgacgttcacgtttcgttcacgatatcgttcacgtttgcgttctcgttaaggtcacgtttcattcacctacatttgttcgttcacgttcattaacctgcctataattgcatttcacgttcatgttcgttggctcgttcacgttcgtccgacaacattctcattcacgttcattcaccttgttctcgttcacgttcattctctcgttctcattcacgttcgttggctcgttcacgttcgttcgctcattctcgttcacgttcattcaccttgttctcgttcacgttcgttcgctcgttctcattcacgttcgttggctcgttcacgttcgttcgctcgttctcattcacgttcattcaccttgttctcgttcacgttcgttcgctcgttcacgttctcggtgtgacggcaacgaaacggcggcggggcggctcggcggcggcgtggcgccgcgcgcggcatcgggccggcgcgtggcacggcggcgtggcgccgcgcgcggcatcggcgtggcgcggcgtcgtgtcgtgacgaggtcggcgtcggcgtctgaaactcgagagggagagagagagagatcgagatcggagagagagatcgagagggaggcggcgcgcggcggctctcaccccagagatgcggcagcggcgaaggaggcggaggcggcggcgacgacgacgagcgcgagacgacggcgagatacggcggcggcgtcggcgtggggatgccctaggcagtggcggcgaaggagaagccgagagagatcgatcgggcaaaaacttctaagtgttggtggagatgacgagggcgcgcatcgggaatatatatagccctagatctttagtcccggttgatgagaacaagcgggagtaaagattagatatctttactcccggttgttgagaacaaccgggactaaagaaaagatgcttactcccggctcgtctcacgcaccgggagtaaagatatctttactgccggttgttctcatcgaccgggactaaagatattttcccgctgtttctaaattctttttaaacttggttagggttaagaaccgggactactgataagcgcactgaatattattttccattacatatgtttttctaaaatagaagataatgcattacaattatttaaagtataaagattaatgacaattacttcgaaaaattattgttgtctgtaataaattaagtggataaaacgtaataagcaaatatatgatttaaaattaataaaaattctaataatcatatatacttagcatatgaatgatattattaaattggtaaaaactctaattaacatatgtatatacatacgacatgatttaaaattaataaaaattgtaatcatcatatatacttagcataggaattatattaaattaaattgtgaaaaactctaattaacacatgtaaatgccacatgcatgatttaaaaattttaaaaattcgaatagtcatatataattagcatatgaatgatagtaaattaaattgtgaaaaactctaattaacatatgtaaatgccacatgcatgatttgaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctctaataatcgtgcgtaattaacatatgccatacatcaattgatttatatggataatcaatacatccaaaatagtttacatcgtgtacacaataattacggcaatacatcgacggtgacggttgaccgcacgtactttctcctcactattgttccctccttgtgatcgctacgtgagtaaggggtgtcttcatttgataggaggatgctagggtcaattgtcaccgtgaaagggggttgcccatccaactaatcgtaatcctcgtcagtcttgtcctcaactctgatgatttttcttttgcctgggagaaccacgtgacgcttagactcgtcaggccctctgcccttctttcctttgctagacatgtccttcacgaaaaagacttacgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagaggaccatagtcaagttcccatatgtcctcgatggcaccgtaatacgtgccagttgttccatcgtgtcccatggcaccgacacgaatagcgctgttttggttcgtactcatcatgtcttgggctctcgtgtagaatgtgtacccattgatctcatatccctggaatgtcgcgatcgacccagacgatcccctcgctaggaaggcaagttgttggttgatcgactcattacccatgagatgttgtcgtatccacgcggggaaagtatcaatgtgatgccgtgtaatccatgcatcggacttaccgatgttcctggcgcgaactagagccaagtgctcctcgatgtaaggagctaccaatgaagattgttgcagaactgtggaatgggctttacgaaataaattgttgtctaccgtcattattgctttccttccgagagttccctttccccgtagtctcccttcatggcgtgattcaggtaccccgattgggcgaagatcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacacaggcccgagaatactgatctctttcacaaggtgacaaagcagatgcgtcattatattgaaaaatgaaggtggaaatatcaactcaaaactgacgagacattgcaccacatcattctgaagggcttctaatatatccggatcgatgaccttctgcgaaattacgttcatgaatgcacatagctttgttattgttgcccggacattgtctggaaggataccccttattacaactggtagcagttgtgtcatcaacacgtgacagtcatgagactttaggtttgtgaacttcttctccttcatgcttattattcgtttgatattcgtggagtatccagacggtacctttatgctctccaagcattcaaacatgctttccttctctgccttgctaagagtgtagctggctagactcaagtaatggcttcctttcttctttggttccgggtgaaggtcgccgcgttgttccatatgcttcagatcattatgtgcttccagtgtatctttcgactttccgtatacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgttgcgatgtttagacttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggattgtccggataggttgctaagtgcaggccaatcgttgatggttacgaacagcagcgctcgtatgttaaactcctcctgtttgtcctcgtcccacacggggacaccttccttcttccacaacagcttaagatcttcgaccagtggtcttaggtacacatcgatgtcgttaccaagttgcttgaggccttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctgtctatgtttcgccactgcgaaccatcggcggggtgtcttagcatcccatcctgttgacgctcttcagcgtgccatcgtatcattctagcattccccttgttcctgaacaaatgccttatctgtggtattatagggaaataccacatcaccttagcaggaattctcttctttgttagctgcccgtcaacttctcctggatcgtctcgtctaatcttgtattgtagtgctttgcaaacagggcatgcttctaggttctcatactcaccgcgatataggatacaatcattcggacatgcgtgaatcttctgaacttccagtcctagcgggcagactatcttcttagcctcgtactcgggcaatttgtttccctccggaagaatgttcttgacgagtttcaataaatcgccaaatgccttgtcactaaccccattttttgccttccattgcaagaactccagagtggtatccaactttttgtgcccctgctcgcaacctaggtacaacaaagttctgtggtcctctaacatcttgtccaatttatgggctcccttttcactttcgcagtccttcttggcgtcctgcaacatctgaccaagatcatccgcaacgtcgttaccatcagcatccctttcctcctcgcccgtttgatttccttcaaatccaacgtactgagcaaaatccggaatattgtcgtcttccatttcatcttcttccatttcaacaccttgctctccgtgggatgtccaataattatagcttggcatgaaccctgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgtcggtcagcgtacatccattgccgatccatctacatgagtcgaaaaaaaatcatacaaaaataattattcttacaataatgacagtcatacaataattataagataattacaaactgtttcaacagtcatacaataatgacatatctttattcatacaaaaatcataaaatattacaccaaataattcttatttactatttctaaagttttaaactaattttaatgtgttttacttcttttaattttcagtttagtttgttttctagtattcaagactaactttcactatagttttccttctcaactattttataaaaccttctttagcaaatcaactaagtttctatatattctttcttccccacacaaattttctccctcatcaacttacaactaaattttggagacaaaaaagtgtgcaaaacatagctgcaaatgtaatatgaccaaaaaaaacattggaggatgaagttgcaaaccttttaggcacctccgatttgtatgtaatcaccaaaataaattcactagaaattttggcatgacctcccctcttttttgaagaaattttgaagcttgctcgggcagctggaggaggaagaagacatatatatataggggtgggactttagtcccggttggtattaccaaccgggactaaagttacgatctttagtcccggttggtgttaccaaccgggactaaagatcccggggggcctgacaggccctgacagcatttgacccgggactaaagatgatctttagtcccggttggtgttaccaaccgggactaaagatcaaatatgcccgttaccctttttaaccgggactaaagatcatctttagccccggtttttattgcatccgggactattatggaattcggccgaccgacgaaagatggtttctccaccagtggaggctttgctgcgaaatatatatatgcatatatatcaaatgttgtacaaatgatggatatatttatgttgagatgttgtagaaatgatgtgaggaatgagatttannnnnnnnnnnnnnnnnnnnnnnnnnnnnnnnnnnnnnnnnnnnnnnnnnnnngacgtgactatcctggcgcct

SEQ ID NO: 18353 - DNA, 1142 bp, Oryza sativa
  unsure (1)..(1142): unsure at all n locations
ggaaaagagtatttaaggaaatgagaggtgtggtttggaaaggaggagagaagagaaataataggggaatttttggggggtagaagaggtagtgttgaggtgttgtaagagggaaagaaaaaaataaatggaaagagagaggaggattgatttgaaagaaagtttaaatagagtggaaggtgttctgtttattttagaaagagtatagtaaagagagagtgtgtgagagagtgtatatggggggggnagggagatagagaggggggagtgaggtagagaaaaagtggttatgngagagatggatatttagtatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatacataaatacatatatattatgcatgtacatatgtattgaaacatatataaatataatataatatatatatatgcatatattatatatgcatatatgtactgaaacatatatatgcatggtttatatatattatatatataaaccatgcagcaacagggtcatgcaaaacaaaaggtcatctcgatgcaaaaaaacaaaccaaccgggactaaagatcgatctttagtcccggttatttcacccgggactaaagatagcgatctttagtcccggttttcaaaccgggactaaaggggggttacgaaccgggactacaaagggtttctccaccagtgctccttaatgagatcgaatgttgggtctaattaaagatgtaagcgcgggacatgaattattgtgtacatctgttttttttcactagtggatgtaaaataaactatacattgtaattgtacgggctcttatacgaattagcagacaaccttgctgctatatggggctcctctactcacgtatgcaaaactgtacgcgtcatgtatatcaactctatatcgtccctaaccgatggaaattattaaagcaataattgatgaactactgtaccatactatgaggagcatcact

SEQ ID NO: 18354 - DNA, 783 bp, Oryza sativa
  unsure (1)..(783): unsure at all n locations
cgtcccttgaaagtgatgttgctncgtctgcaannagnccancacagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaagatgtgcccatcattcatgacgacaaagaagcaatcttggaatcatgtctttgaaatccatgaaattgatggtctaataagcctccatcgaaaaacttttataacaccctcggtaggccgcctcaaatttttttagaggggatgagtttcatcccattcaagcatcaaggtcgcttgactgcctccattctgaaa

SEQ ID NO: 18355 - DNA, 779 bp, Oryza sativa
  unsure (1)..(779): unsure at all n locations
cgcttcattgacctactagatggtacagnagctcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgcatactaagcagcagatactagatgcagcaaacaattcacaacaatggggagagcacggaacacttaccaaaggcttgccagaagataaatatacacggggaacgtctggatcccactccacgatgttgtttgccccaaccctgacacccttcaggtcccggaagttggctccctgaaacacagtaaattgattatgactgcagaaagaatgagtggacaagttcacaaaggaccaaagctgtacaactgacaaccttctttactggaatttgctgcacacgctcatggtcattcttatttagctttaagggctggtgatccaaaagcttgcctagatctggaccatccttcctttcaaagaactattcagcatttctagaacatttggggaaaaatgattaaattggtgtccagg

SEQ ID NO: 18356 - DNA, 797 bp, Oryza sativa
  unsure (1)..(797): unsure at all n locations
aagcataagagcaaagtggggggcaatatacaatatgcaaaagaagcaaccatggtgcaccatctcaagccacattagagaagtctatgacaattaactcattcctcaacttgcaaaagcgggtttcatcaagaggcttggtaaagatgtcagctagttgatccttggttcttatgtggctaatgactatgtcacacttggcaacatggtctcttaggaagtgatggcgtattgtcaatatgcttggatctagaatgttggaccgggttattggctatctttatggcactatcattgtcacataggagtggggttttggtgaaggatatgccataatccaacaagatttgtttcatccaaagcaactgggcacaacaactacccgccgaaacatattccgcctcggcggtagagagggctacggagttttgtttcttggatgaccatgacacaagggatctaccaagcatttggaaactacaggatgtgctctttctatccactntgcaaccggcataatccgaatcggaatagccaacaagcttaaatttagcaccttttgggtaccacaagccaatagtagaggaatgcttaaaatatcttagaaatcttttcacggccactaagtgacacttcttaggagcggcttgaaaccgtgcacctcgggttcaaaggtctaaacttacacatggggcttgttttataggtaattaacgacataaccatcgatagggagaccactgccgcgttttataaatttcagaattgtgttaggatcactgagggtttatttgcaa

SEQ ID NO: 18357 - DNA, 831 bp, Oryza sativa
ggtcaccgacatgccattgtgtctgtatgttgtcaatctggcactggaggttattatatcagaatactgggcgtttgaggagttaattctgtttgcttgagtagtcatccgaaaactggggaatctcgcataaatattggttggaaactgccaaatgtgactggtatcatacaattgtttataggcatgcccttttaattatgtttctattaacttggcttgtaaagtccattacttgcatagcatggaccatggaactgatacgttatgctcggtctctatttgttggtacgattcaggtctgggatattctaacacgcaagttgaaacaagatttgccagggcacgcagatgaggtacatgcatgcatattttggaacaataaaaatctgaattgaaattattatagtgtagtaacaaagattatgtatatatatataaatgtaaggtgtacgctgtggattggagccctgacggcgagaaggttgcatctggaggcaaggacagggtcctcaagctatggatgaactagttcccttagagtaaggtacttagctagtaacttcttgtcatggtggctctctcttgttcttggtgaagagatttgtagggttgggttggcttttcttggttttattttgcaaccaaaggcttgagggtatatatgcgggtgttttttagaaaaagggatataaaaattccggtttttgttaaaaaagaacttcaagccattatttccaaaggtccacttccaaagagagtgttgttaaagaaaagttgtacccccaaataagaaaagaattacccaactgggaaaacaaaacaaattgg

SEQ ID NO: 18358 - DNA, 623 bp, Oryza sativa
  unsure (1)..(623): unsure at all n locations
gagatgcggcattggtcacctgagtaccncgctcaaatagaaaaaatactccagcatgtaatattatttgtgttttaatataagaattatgtatttgtaattagacttagtatataattatttactagctagggttgtataatatacgtcacctacacttagcttatatcacgatttataattagacttagcacgtaagggtgtgtagggttctaatgtacgacatttacacttagcactgatgaatcccctaatgatttttatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcaccttccaaaaaagcacttgctgtatccccgaggcatgctagctttatttgttggggcatacaaaccccatgg

SEQ ID NO: 18359 - DNA, 640 bp, Oryza sativa
  unsure (1)..(640): unsure at all n locations
gagagtgggntttgactacgtaagagcttcatagagcnacaccagnncatcacacacgagctggcaacatgtccgatttctccacaacgagagcatgccttacgttccattttatcctggttgaaaccttggggagatttctcatcttcatcttctgaggagacttgatctgaatcttcactatcagacactctacctccattagctaaaagatgctctgtcaactgtggtgcacctcggaaggtgtttcttctctgacgtcttgtcattcctggtggaggccattctgtgctggtaatgatcatcttacgaacttcaccttcggttcgcattggtgcttttcttttctgctgaggacagttccttgcgtagtgcccttgctcatcacacataaaacagatgatacttgcttcttttgggtcaacatgtggcatggcatgaggggccttctgggatgttggctgagcccctaactttgtgtggtaagtggcttgtactcgcctccaacttccccctgaaggttcattttgactccggtttaaaatttgaattccatactggtgtaatatcttattagccattttttctgttaaacaagtgttggcccactcccctacaactcgtgttttgggccccatct

SEQ ID NO: 18360 - DNA, 8538 bp, Oryza sativa
  unsure (1)..(8538): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcactcggagacacaagcagcagagactgtgtggcctgttgattatcgcttctgtctcaacgcgaatgcacacacacattgatatcgatcagcaatccacgatcgatcgatgggggaaaatagctcaagttcagaggtgagactgtgcctgcaggggctagctgctgtagactgtagtgctgttgcagtgttgctgatctcatactatagcagagtggcgagtaagtgccgtcagtctatcaggatgctcaacaacagggatatcgtcaactgtatccctatactccctgcgtcacaagaatactcaattcttgaattttcgtgtacaaagtttgatcgtctgttttatataaattttttttatgattagcatttttattattgttagaagataaaatatgaatagtactttatacatgacttacctttttaaaattttttataaattttttaaataagacggacggttaacgttagatacgaaaacccagaaattgagttttttttggacggagggagtatgtcataacctagctagctggagtatacctaaatgatggacgacgcacagatatactcttgcatggcttcaattggcaaacgggacagagggtgtgtgcccactgcgacagaaacagtaaattgaccatggtcatatatatatatatatatttgagatggataagacaagagaatccggctggcgtacatgacaaatatggcaatgtcgcgttttccccgttgccagcgtcctttcaaacctatctagagtcgtgcgcatgccattaccattatattgggaccagaaaatgatcaaaaaacattaaaaaaatgtatactggctaggaccaatggattcaataatatataccacaattaattagtatattgcacaggagtgatatgcaaaccaccatgttgtctggactctcgtagcaaccctgtcaccactataattctactttttgcgtacagtgaaatctacaggttgatcccctcggtagagttagccgacataagtccagatcatggaattattacgaacagttctagtcctaatcatcaaacactatattgtgttagctggccaatctgtacatatcattatatatctaaaaagatttgtacatatattaccatatacatatgtcgcgagataattatatggtatgatgaatgcctctcctgtcttagtcgtcaaacgcggtgcattgtgttacagaggaatatctatatgattgataggtcgcaacatacaaacagaatatggcgctatgtttcaatttgcacaggtgtttttatgtttttcaatataattagtgtgggctaaaaattgtttataagccgtaacggcttattagcgatatcagaaaatattttgtgtgtaaaacttttatatatatgtattcttagtgccttaaaaaccaatactgaaaaaatctacgttgaaaatatctcaaagtcaactttaaaattaagttttacaatttaaaatttgactttttctttggttttttaggtaataaccaatggagctataaatcacttttcggtgcgttaccctaggtaggtcccatggaacaaaccacaatatattattatacagtggtgtgagtgtgtgacatatataaccatgtggttaggattgttgtagtagccagtacccaattatttcgattttctgcgttcagtgcaatctacatattgattctcatatatgtcaatatcatggaattatatatgttgagcagtttgcagtcttagtcagcaaacagtacgtacatttgcttttagctagctagctagccatacatacagtatttacatatatagtatatatcgtgaatagttctctagtcttagtcatcaatacatacattgtatttttaaatatgtggttgccaattaataactttttggtatgttatctcaggtaggacccaaagaacaaaccgccggccacatggctaggaaccgtatcctctgacattacacactaatatcatggtgtaacattcttgaatccagaccatccaaaataaatcaatggctatagattaattggcatacaagtaatcaaattaattagcagattatgtagttaaacattaccatacttaatgagtagaaaatttttttagcactaaagtagtcccttcatgttcattaacatgagcccaccaacttgtagattataagagaattgtctttttcttatggaagatgaggcaacacaaagaaaattgatgcacgagattcattccttaacaggttcatatgctaatcattgcgtctaacaggtaagttaaaccattatcgtcatgtgctagttacttgccgattccggcctgtagcatttagcgatatttgcctccttgataatatatttgatctaaaggaatttgtttaactacataatctactaattagtttgattaattgtatgccaaataatctatgaccgttgatttagaatggatggtgtggatcaaaggaatgtcacaccatgacattagtgtgtaatgttagaggatacggttccacatggctagctagctatgtcaaaacattacattgtgttcatacatataacatatatatatgtacactatatatgctcgtgaaatgttctcgtcttagtcgttaaaaagtacaatgttgtattatgttggagtagtacaatgttattgtgtttttaaaatgtgttccttctaagataacgtgtgtttttcttaattctctgaaagcacgatacagcggcgcccgtatatatttggatcatctgctagctcccctagctagcagatttcatctattcgtcggaggcagcattcaggcatgcatatttctctctgctcctccattgaaatttacacattaattcattgcttgcgccagaaagggagaaaaaaaataatgaccagccttaggacaaacactaggatcagaaatgtccagcaaatgtacacgcatatgattaagaaagagaaacaacgcatatgccgtttgtgtacttattgcatctgacaatgatgcttctcgtctcttttggggaaaatcaaaatttatacttttggagctaattttaagatactttcaatgtaattctttttagtgtgggtttttaagtcgctacaaataaatatataaaagttttacctctaataaagtcttgtttggatccagggactaaacatatcggatgttggaacactaattagaagtattaaacgttctataaccctgaactaattcgcaagacgaacctattgagcctaattaatccatgattagccgcctatgtgatgctacagtaaacatgtgataattatgcattaattaggcttaaaaatttatctcgcgaattagctctcatttatataacactggtggagaaaccctttgtagtcccggttcgtaacccccctttagtcccggtttccaaaccgggagtaccaatccgggactaaataaccgggagtaaagatctatctttagtcccggttggtaacaccaaccgggactaaagatggctcagccaaccgggactaaagatcgagctgacctttttttttttgcatggccctgttgctgcatggtatattttatatatatatatatatatatatatatatatatatataaaccatgcatatatatgtttcaatacatatatatgcatacatatatatatgtatatatatatattatattatattatatgtatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacatagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgtgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttcattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttgtggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagaaggcggagccggaggagatggtgcacgagacgccgcttgtcgcccaaggaggatgatgtaccgcctgcgccatagaataatggcatggcatgtgtctcgtagatgcgtctcaccgtctcctccagggtaatccagctcgaggtcctcgtacgcgccttcgaccaactcaactttgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcatcctggatgctctggagtctgcagggcgagtgtcagctcgtccctatctctgtctggttggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcaatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcgttgtggtccacagcatctctttctccgaatctgggacaaagctctcatgatctccgcgtgcccttgttcttcgccagtacaccgtactaacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaaaaacatctactaagtcacgagacatttatgttttaacaatctaagtcatgtatgctaagtgtaaatgtcgtacattagaaccctacacaaccttacgtgctaagtctaattataaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttaatgaactactgtaccatctatgaggagcaagngcaaanngacgcccc

SEQ ID NO: 18361 - DNA, 14218 bp, Oryza sativa
  unsure (1)..(14218): unsure at all n locations
ggttagggttaagaccaagactaaagattatagcactgcatatgattttcgcttacatatgtgtttataaaatagaagttaatgcattaacattatttaaagtacaaagattaatgacaattacttcgaaaaattatttttgtctgtaataaattaagtggataaattgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacacctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtccgctcgccaggaaggcaagttgttggttgatcgactcgttacccatgagatgttgtcgtagccacgcggggaaagtgtcaatgtgatgtcgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtattctcccttcatggcgtgattcaggtaccccgattgggcgaaggtcttcgataaattctacgcaaaattcgatgacctcctctgttccataacccttggcgatgcttgcctctggacgagcacggttacgagcatacttcttcagaacgcccatgtacctctcgaaaggaaacatgttgcctaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcaaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctatccaagcattcaaacatactttccttctctgccttgctaagagtgtagctggctggactcaagtaatggcttcctttctcctttggttccgggtgaaggtcgccacgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccaatggtcttaggtacacgtcgatgtcgttaccaggttgcttggggccttgaataataatcggcatcattatgtacttcctcttcatgcatagccagggggggaggttgtagatacacatcgtaacgggccaagtgctatggcctctccaaaaggattcatgccatgcgtactcaaaccaaaccgtatgtttcgtgcatcctttccaaattctttaaattttctgacgatgtttcgccactgcgaaccatcggcggggtgtctcagcatcccgtcctgttgacgctcttcagcgtgccatcgcaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttcctgtcctaacgggcagactatcttcttagcctcgtacgttgtctcgggcaatttgtttccccccggaagaatgttcttgacgagtttcaataaatcgccaaatgccttgtcactaacctcattttttgccttccattgcaacaactccagagtggtatccaactttttgtgcccttgctcacaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagttcggaatattgttgtcttccacttcatcttcttccatttcaacaccttgctctccgtgggatgtccaacaattatagcctggcatgaaccccgactcaaacaagtggaaatgaatagtcctggatgcagaatactccttctgattcttacacttattgcatggacaagaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttagagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagccccggttggtgctaccaaccgggactaaagatcccgggggggcctgacaggccctgacagcattcgaaccgggactaaagatgatctttagtctcggttggtaacacaaaccgggactaaagatcaaatatgcccgttacccttttgaaccgggactaaagatcatctttagcccctgtttttattgcatccgggactattgtggaaatcggccgaccgacgaaagatggtttctccaccagtgtaattagttccgtaaatagtttatatttaatactctaaattagtgtcaaaacatctgatataatagggattaaagtttagtctctgatccaaacaccacctaagttgtttggcttactagggcaaccgataaggctcgaagtctactagtataccggaaggctggcatcacatgcgcatcttctttttttttttttgtccactcagttgcacagattggcacagaggaagaagagcaggatcagctggccggccggcagtctggcgcccgtcggcagggccgggtgccctgaaggcctgaacacatactgtggcttatattatcagtggcagctagacatgctcatctgatgaacaagctgttttctgcatgctcctatcattgctgcgcatatatactaactattcatcttcaaattaccaattcatccacatatacaaaccgcatggtccttctgtcaagtacagaatgaggattgtattgtacccggttatatattatactagtagattaggatgcatttccatctatatcctagacttgtttgaaaaccaagccttatatatcccctaaagcttaatacaatcgtctagttacatactagtaatcttgtatgtatccctatacgattcaacaatacatctacgaggcttccacacacgtgcatgatacgtacatgcacagaagaaaatgtatgtgtactcctatataggagtagtagttaggaataattgtctaaattaatctctctgcacggacgtaccgtacacgtattaatgcctgaaagcttgatctgcggaaaacatattctgatcaaccgctgcaaagcctggatcgtgcagtgctaattaaattggacgccggcgatttgtgcgctgaagcctggaggagagtacactgatgctagcttcatcgtgatgcgcatgcaatgaaccctgcgcactgcgcagcgtccgtacgttatccgacatgatcaggccgcatgcaggataggatatgcatctatatcgataaatctgcagaactatatattaactactataccttcatcccgacatataaagaattttgactaattatccatatacatagtcgaagtccttttacattttgaaaggaaggtactgtaataaattttggagacaggatcattcaaataagggcctgtttagtttccaaacaaaatttttcacgctgtcacatcgaatatttgaacatatacgtagagtattaatctagaaaaaaacaattacatagttcaccaggaaattgcgagacgaatcttttaagcctaattgcgccatgatttgacattgtggtgctacagtaaacatttgctaatgatggattaattaggtttaataaattcgtctcgcagttttctggtgtaatttgttttattattagactatatttaatattttaaatatatgtccgtatatccgatgtgatatgcatggactaattttttttttgccaactaagaagtccctaaatatatttaggaagatgaaatataggaagagccttctttaatttcagacaatgattagtgcagagcagttgctgataaggttaggtctagctagctagcgctgcaacgggctttgccttttaccctttggtacggtgtggagacgaagcacttttgttgctagctgctgagacagagactggctaatgacagggagcggtgtgacatacaaaccaattattcagagaatccgatcgatggatggatggatggatggatcgacctccggcgaggattgttactagatccgtctcatcgaacatgattaggacaacacaagaaagattgatagatagatatgcccggacggccgggaagatcatgtgtacgggaagagtatggcaaaagttaggtcaagccctgcaacaattttgctgctatttaaccttcggttggtgatggtcccgtttcttcgacgacgtgttcaacaccgaatgatttccgctgattatttgctacacgctttcagaaatatgtcttcttaaatgaaaactctcttctaatacttcctccgtactcgtaaaggaaattgtttagaataatatttaagtcaattcctaggaatataaatcataaataactctcaagttgttaagtttgaaaatgtaaaaattatatgaatagatttgtcttgaaaaatattttcataaaagtaaacatatatcacttttcaataaatatttttatagaaacaagaagtcaaagttgtgtttcagagaccgtatcgctgtccaaaacgacttactttacgagtacggagggagtacattgtttagaccacttgctctaaatagttttcttttttcacaactaacaatttttgctattcttatggacacagatgtaaggtggagctatttcttcattacagataattaacaattattgctattcttatgaggaaattgttctctatctgtcatatggtgatgtatggtatggacatgcacactccttccgtacggtaggtgcaaagccataagattgttttttttttttacggagggtgtactatacttgccatggaagaatacgctataaacctgtagaagtagacaatgaacacatatataaggtggagctcttttttcattatagatcaaatctggagtacaagtcaatcatatatatctcaccctgcgcccttttatatatagcggtcttaggaggagataaattttatctctactctggttaagattggcacacaagaaacttatctcctagagattgattttcacaacaaaattgaagtttgttgtgtatgtaaaatgccacatactcttccatgggatcttcagtactcctagatgggaacggtcttgctctcctgcccagccttgtgcacagataaaataaaaccgctgggtcaggacaaagcccatccgggaagcccacaatacaggctaaatcctacccttctacaggcccattgaaggctgaaagatctggccggtacccgggccacggtggcctctagcaagtcgccatgttttggaccattgagttggtcacgattttgacagggaataagatcattttgactccctcaactgaccaccgaatctaaatcatatccctcaactgcaataccagaaatcttaacccctgaacttataaaaccggtgcaatttgacttctttgatggttttggagagcagtttcactgacgtggcgcacatgtgacagtgttgacttagtctttgtccaacgtggcattgacatgatgtttatgtggcattaaaataaaaaaaatatacgggcccacttgtcattaaaacaatatgtgggatccattgacatgtaggccccacatatcatcttctctcactacccttcttcttcctcctctttcccttatttctctccctcccccttgactcccccttgacatggccggcggaggcgggggctcggtggcggcaacggcgggcaggtgccggagtggtggcggcgctgggtagttggtccttgtattttcatccatctcatctgcatttgcatctgtttctccctctcactcttgttttgtgttcgtcctcgtttggtctctgtttcttctcgatttggtttttctgctatggagcccatgaatcagcgagcggcagagctcctctagctcagcccctaacaacctataaactcctgaagaaggcacttacgtctgcgccgagcgtccatctgtacacacgtagtctttgttgacgatttctttgcctgttgctggaattgagcagcttgaggatgttgttgattcggtaggggtggagatggatgaggagtttgcagatgggtgggggcgtcgggtcggcgttgtcgggggcggaaacggacgagcggctgacgggtgactgcaaacataagagcggcgcaaggaaggtggttcatggcgagcggggacgccacgggcacacacgcgctggtccttccttggcttgatggcgagcgcctcggcgtcgtctatctccggcaccactgggagcagcagtacgagggaagcccacggcggctgcctcctcctcggccgtcttcccattggtgaagcccacggcggcggcgtttctcggcctcgaggcagcggcgcgaagcgagtggtctccggcccgccctcccgcctgccgcagccactccgtccatcgcccgccgtcgccgccgccgattcgaacgccgctccccacgcacgaagagaaagagggagagatagagaagggaggagagggaggaggaagaaggataagagaggatgacatgtgggacctacatgtcagtgggttccacacatttttttagtgataaatgggtcccatatatatttttttattttaatgccacataagcgccacgtcagttccacgcgggacaaagactaagtcaacactgccacgtgtgcgccacgtcagtgaaactgctctccaaaatcaccaagggagtcaaattgcatcagttttacaagttcggggggtcaagatttctggtattgcggttgagggatacgatttagattcggtggtgagttgagagagtcaaagtgatcttattccttttggcagagaccggcccagctctctcctctcgaaccgtcacctcggcgccaaaacttaaccggcccagttccgtgtcacctctcgcgcagccgcgccacagggcacaggcccagcgggacaccgagcgcgcgatatcgcggcccagccgctcgtcgccacacgaaacccacacgcagacgcaacgcacgtacggggaggggacggctggtttcgttcgactcgacttggtcgcgctccagcgaatgatgtgcgatcgatggagcacctgtgatacgttttgtacgcacgcaggcgcagcggatgagatgaagttgcattgcaccgataccaaaccccacgggatcgaaccagcaaacccccgcgtgaaggcgtgatttcgtggcggcacgtccgcaggagacgtgagcaatgaacggtcgcaggcgctgatcagcaaagaaatgagctttctcaagccaatttgcgaacacaatgaacggaccgagctcctaacgagcttgtgccagcctgtgcctctcctgaggctggagcccagccaaacagtttcagcttcaacagaaataggagcggagctgggtggagcattctcgcaaaatgaatagagaggtggagctgggtttaggctgctccacaactccactccaaacctaattcctgaagcataatttaggagttgtaactctactaaataggctctaagctcgcgagcttttatcaaagttcaactcgagctcctaacgaacctagcaatatattacttttattatttatttgacaaactaatagatcaaatatgtcattagtatgcatccacaaagtgaagtgtcttgtgtttatcttattatttttttttctattttggttattgcgatcaaataagcgaacgatcaaacgttggacatgaaaaaacataactacacttatattgggacgagggtaatattttgagacagagggattactacccatggggccttgcctgcccaatggcgagcgacgtgtacaccgtatttgccgcaggtgtagtactccctcgtctcaaaaaaaaaatcaatctagtcctctcctaggacaatatatgtggacacccactgtatccacatacatcaatataggaggggtcacatcccctattaagtacttgccactgcccattgctgtcacggcctgcagcgttgaccaaatttatggcccagtgtacgatggagacatgatttttgggctctgacattgaccaaaagtccaaaaccctcccgctacgtgaggcatcatgcatcaatcaatcaaatcaatcacacagaaccgagatatcgcgtggccgtgccatgccaccatatccttgcccaagtcaactcccgctccaggtgggtagtggtacgaatcgaccacgaaaaagattgcgtacgtgcaggtgcaggcgcgcgcagctgctcctgcaccttcggaccgcgaaaccaccgcggccacggcacacgacacaagggttagggcgcgagtcatctcgagagaacgcggaagcaaaaacatgcgtacgtaggcagggcgccacgagacagggatcagcgacaacgactacttaaccatcgatgagtagtagtagcagcaaatcttcaagggcacatctgttactgcagctaagctccagggttcaacgacatcatctctcttcctcctagcgtggattgagcgcaagtgcgcaaccgcggaagcgactacagacagcatctcgagcatggcaacgcttcttgctcttgcatcttgagtggaaggacaggttcaagtgcgtgtttcctgttgaacagtactacattggtcgtggaaggataaaacatctaagatataagtggggagcccctcatctcattggctagctttagggtgggaaaagccctttacgattctacaattggtatcggagcctagctagttcaacatctctagcccgagggacatagtaagtgaaggcctgatggaccgtggggggtggggggaggacggtgaagggctaagggacaccaatgtgtgaagggtgagattgttgaatagtcccacgttccttgtggaagggcaaaggatctaagatataaggcttctcacagtgcaaggcacgcaatagagggcttagcccaaaaaagtgatccaaagacactcaagcccacagtgcaggtatcttatttcgagtaacctaatgggataaagctacttttgaagactacaatgcccacagtgggcgtaccctagcacatgggggcactggcaggcgaaggaaattaattcctcacctacccttctcttcctcgcgacctcgccccttctctttctctcagccgtgccgcccctccttctcctccctcccgcaccgccgcccctcctcacctcccatgccgcggcggcgcggcctcggtgtggcggagctcgagcggacgccgccgcacaacatgcgacggctgcacatcgggcgcggcgacggcgttgtcctcagtcccgtcgaccgcgccgcctcctccccatcgaccgtgccgcctcgtctcggtcgaccgcgccgcctcgtcctagtcgaccgcgagctcgcctccttccttcacgcggcggaggtgaggaggaggaggaggtgggggagtagatccggcgggtggccaccggcctcgccgctgatcctaaccccgccggtgccgccgtggtcagctccatcatcaatcgacgtggcggcggacgggtccgcctttcccgccgacgggggcggtgggaacggacggcaccgaggatgaagagggtgagggagaagggcggaagcgggcgagcaggaagcgggcagcggcaagcttgagggcgacgaggagatgactccgatgccactgagcttgggctacgacgcgccgatggagcccaggcttggaggtggcggggttccctagtcgtgctggcggccgacggcgtggtcctcttgtgtgattcctcttgtgttcttgtgtgattcctcttgtgttcttgtgtggtcctcgtcggcgtggttctcttgtgtgattccccttgcaacgtcgtcggctcgccgccgcgatctgttgattttgcttgctgattttgaggattctcgacgcggctgaatcggtggcgggagaaggaaatcggtgtggcgggatcgccaggaggtataggcgcaaggtcacgggagggcgaggagacgcagcccatagcgcgcgttcccggggatttcggcgtcgcgcgctccctcacttggatcaggttctgcgctcctctgtttggggattagcaccctaggatggtatcgctcgctagctccacgtcggcccgaatcctatgtggcacaacgagatcacgcgccagctcaccgcactgtgagaggcctaagtgggagagcccatcacctcattggctagtttttggggtggaaaataccctttacgatcctacacttccaatcaattcagacgtatattttagtctatcattttgattctgaattgttgcattctattttatcgcaatccgatgccgtggactgttgtgacgttcaactcgattttcggcagtagtgttattgatttacgtaaaggaattacaattgttgtgatcaaaacatctcagaaaattaatggtgtttgtatgtggtctttgttaaatttctggatcgtattttctggttttaactcaatcccgcaagcttatgttcctgttccgaattgttcacctatcgatttaatcaatttgtcagtctgaattttgtgtgcgatgattagtctgtagttctgccctttgcatgctctgctgcctgaattctgtggaacctaatgggccagatatttccatcaagacaggggcaggccaattttttacccggtttccaagtggttcccaagtaggaataagttcatcggaggtctctcaacttaacagcgagatttttttaggtccctcaaccacaaaatcagaaatgttcgcccctaaattcattcaaaccgttcaccggaggtcacttggcagtatttttgcccgttttactgacgtggcatcctagtcagcaaaaaaaaattaaaaaaattcatatggcccacatgtcagcttcacatatctctttttctccttctcttcagtcttcttctcctcctcttcacttttctcttcaccggcggagcagcggtgggcgagaggttcggctgctggcggcgccgaacagcgacgcaagagaaggggagggcgtcggcgacggcggaaggtggccggagaagaaggtcgccggcgagcgcgctcctgctcctgctctggctgctgatgcggccgggaggtatcgccgatacaggggctcgtcgttggtcgtcgtcacgggaggtatcgccgtgcgctggggatgtcaaaatgcagagagttcgtgtcttagaagacggccatgagcttggcttctcccagcacatgcccctcgatggcgtccatcagcttgtccttgatcacctgtaagcaatcaagaatcaatcacagttaattaatccttaaacagcaaagatactcgctaaaagattgttcgatcgacttgccttgttgccgaggtgcacctcgtcgtcgaggacgtagagcttgaactggatgcggttgatgaactactgtaccatgtaatgaggagcgaagcgcaatnngaacncccct

SEQ ID NO: 18362 - DNA, 13701 bp, Oryza sativa
  unsure (1)..(13701): unsure at all n locations
gtggcctcctggatgcgtccatgaacccctccacacncgcggcaggacgaaagcttgaactggatgcggtggccgcaagagggagggatgactaccactcctgccgctccgccgaggccgtgacctgggccagggccggcgccgccgcacaaccacactcgcgccgagcggccgccagccgcgcctagccgcatcggcgccgccgtcgctcggccgagcttggctgcatcggagccaccgccgccgcgcctgcgcagtagcagccagagcaggagcaggagcaggagcgcgctcgccggcgaccttctactccggccagcttccgccgtcgacgacacccttcccttttcttgggtcgctggccggccctgccggcagccgaacctctcgtgacccgtgggccgtggctccgtgctcgttcaccgtccgcttcgcccgcatcccgcccaccatgctctgtccgccgcccgctccacccgcagctggccgccgctccactgccgcgctcgcccaccgccgctccgccggtgaagagaaaagtgaagaggagaaaaaagatatgtgaagctgacatgtgggttccatggaaattttttttttgctgactaggatgccacgtcagtaaaatcgggcaaaaatactgccaagggacctccggtgaacggtttgaatgaatttaggggcgaacatttctgattttgtggttgagagatatcgaaaaatctcgctattaagttgagggatctccggtgaacttattccatcccaagtgaaagtgacaatagcactaaaagtgacgggtcggcccgtcctgcacctgaagtccacaatgtatgtcatacctttttttctcgaggataaccggagttgtgcacgtcattactactagtatagtaataataacgtatttcttccgtaaaaaaatatatacgaaattacccccttaactattgcgtcggtacgaattacgtccttaaagcataaaaccagacatttggcacctcaaactttctaaatcgaacgaataaacccccccccccctaacttgacccatagcagttttggatcatacgtggcgcacacgtggcggtccaatcacctttaaaaaaaatagaaaatagtgggacccatctgccagatcttccttttccttcctctccgctaactccggcaccaggagttacgagattccccgcagcggcaaacgacatcgagggcgaggtggcaaaggagtagatcgacgacgagggatgtcacccgccacccgtcggtgtctcctcttctcttttcttccacttcctcccccttatctctttcttctttctcttttttttcttcagatttgtgcatcctttgacgcaggacaagctagcgaaggatagggtgtgtgtgcgcggtaggtggggaggggccatcctcgccgctaacaaccagtagagagtggggggacctagcactacttcaccttggccagatgacgtgggcgtggggcttgggttgccatggcatttaggtagaggaggagacgacaagacagggaagcacgggagggagagtaatggcgtacttcggggtcgccatcaccatcaccaccgcgcccatgacagagacggagacggagacgaaggggagggcagcaaggtcgtcgccgaggaggaggtggtggcgtctagggtgcatgtgcaggccgcaacgctactcctctcggcgcccgttgttgcctcattggcgaaaagagaaagagagaagaggagagaagctgacatgtagtgctcacaaactttttttaataaaaattggttgactggagtgccatgtgtaggataaaacttttcgaattgagttagggggtaatatattcggtttacatagttaagggtgtaaaatatttggttttcgagcttaggggataaaccggactaacacaatagttcagaggtaatttgttctttctagtattataaatttgatataatcagtacaataaatctagatagaattaccaactgccgagctctgatttttttttctttttgccaaaggtggagtaccaactgccaaaggcattatttcctgcacattcccagtaacgagaggctgtgccgctgtacgcggtgcgccacggcaacactacacagtaccgtcattctatagtaagggtgtgtttggatgggaggatttgggttgataggacatgacgaccctttttttgggtgtttggttgctgggcgaagactggataggatggctcgaaggggaatattcccctcagattttggacagagggatctggccgaatcggtcagatgcggccacccgagcgacggacgagctggatgaggggtcgcgtcacctccatggagagagaaggggtgatgacgacgccgatgcgtgcccagcggcgacgacaaggaggaggcgttgcggccgacgagcgccgcgtcggcagtagaagggtgcagtggcgaacgtcgcggcggcggtcagcggcgagagtcacgtcggcgggaagagggaatggcggtgagctcagagatccggcgcgggagatgagcgccgctgtgatgacgattagaacgcggcaacggttacaacgacgatgagaacccggtgacgacgacgacgatgcgggcggcgagcgccgcgtcgacgggaggaggcggggcgggaggaagcagcggcgggaagaggcgagcggcggccgacaggaggaggcggtcggcgggaggagaaggcggcaacggtgagccccagatccggccctgttttttttttctatgtgtatttataatggaggtagtggtgtaaaattgtattatgtaatttgatggattatattcaccgtctcaagtgagaggtgaccacacctacaaatccaccctactctcttcgaccaaacaaaaaattggatcaccaaatccaccttcattgtccttataatcaaataaaaaactggatcgtcatattcacacaatcaaacaaaaaaactgaaccgcagtatctaacaaaatatagaccactatatcccatcaactttaacagtgaaccaaacacaccctagactgcagcaaactgcgcatgcccctgtggcctaggccctcgtccaaataatctactgtgatctttcagcctgcggcagatgatgatgtgccactactattatatcaaggcaccgagattccttctgcaaatcctgcgatttcgcaggcagtatccaaagaacaaatggggcacaacaaaatcctgtagattaaaccacgagaaaatcagcaggggaatgttgcaaacggaacatgcatcgtagattccttttccgaatgcatcagatcagttcgtcctttggccattgggctcgttgctcattattcaccatttgacccaagcattacctggaggactatagtagggctacctccgtcctaaaataagtacagtcatggagatccgtgtctaacgtttaaccgttcgtcttatttgaaaaatttataaaaaaactaaaaaaaagtcacccataaagtactattcgtgttttatcatctaataacaacaaaaaatactaattacaaaaaaatttttaaataagacaaacggtcaaacgttggagataaataatgcaaaactgtgtttattttgggatggaggaagtacttctttcatcctattataagatatcacacatcctaatataaataaccgtttgtttaaacctgtaatatgatgacacatccggtactagataaacttattttgaaatagaggtagtatctcgtaaatagttcatctctaattggttgatctactgctgataagtccactaaacactaaatgatacaactgaaataaattgttggcaattattttttattatactattaatagttcaaatgccaatggtggaaagtagaatatgattagagaaacacaattaagtactatgtctcgagtttaaattttaacagcaatgactgatagaaaaaaaaggcaaacaatgaaagccacatgaaacagcaaaacacaaaaacaacatgtgcgtgcacaagaaacgcacatcgcaacacgagatggtcgtttttctgccccgtcctattgtgcagagaggacacggcgccgcgttggagcgcacagcacatgatccaactccagttcggagtgagctgcgaagcagtagtacacagtacgaacgggacagggcaggcagaggcagtttcagcgccttctcccaattttttttcaagaaaatccaagaaatatcatcgacgagaaatactatcaacaaacctaacttagaaatgctatcatacaatatttttgtctcaaaaataccataaccgttaggtttttggtgagaacgttccgttaacgttgtaaaaagaccattttacccctataaactgttaaaagttttaaaactatctatccgttagtgtaggttgctctttacatatcgtaagttgaccgaaatgcaaaaaatttaatcaactttcaacaattcatgggagtaaaatggtattttcatatacagagagttgctaatagaaacctaacggcaatggtatttctggggcaataggaattttacaaaccttgaaaaaaataccttgaagtacccaaatttttacaataaattttttagtaccataagattaatacctagatgtactaaattttacactagaaaatatgatacctccagatatcttctaaaggatggtaaaattaactctaggacaaaaatgtttgtataatggtattttatgaaagattgattcgttaatgactcttggagttaatgatatctcttggattgggtgtttgtcaatggtattttatggatttttttttggttgatatggaatgaggaaatgtgaaaatccattgtcgcattttgatcggccttggatgcgactgggcatccaaagaacaaatcaacacggacatatccaagctcaggagaaagaagcagtaaactactctgatccactcgaccactcgtagacccacccccaacaactctgccggctggcctccaagagatctcatggaaaaagtgccgtcttttgtagcaagtgaacaaagaaaatatccttgctcctctaatttcaattacaggtcagcagttttggcactctcagattcttttctaaagaatttatttgcacccttttcacatttgttttttaccataggatttgaacctcttgttcttctatattttccccttttccagaatgaatcgttttcttaatccttatgtacaaatttaaaacaactcacattaagtatgagaagatgtggtatactccactttcaaactgctactcaaccaccaagagaatcagcacattctcactaggacactacaaacagaggatcagatcaaggaagcacatgctcagagcttcagattaccagacgaagtataaaactcctacaatgctactactactacctcatatgatttcacaagctaaatccttattgccggagaaaactactaactcaagaggaggcacctactaagctagcactagtaactagtagtaatacaggcatcaagagggtaattaaggacataaaaatgaagacaaagaaaagttttctttttttttttggttcaagaaagctcctttcttgcactgcatcatccccgccgtgaaaagtgccatggagatgtcaccaaacagggaaattttgaacctttcccttttccctcctttcactctcactctcactatcactcactcactcactcagctgtttcttggcctccgtctcctcgtcctgtccgtcctcgccgccgcctttcttggggctctccaatgccctcttctcctcctcctcctcctcctcctagttgtcgccgccgccggtcgcgttcccggccgccgccgacggcgggcgcttctcggcgcgcgccttgagcacctcgaggagctgttccatggcttgctcgcgcccgttcctgcggttcttgatcagcacctcgctcacgtccgccggcgtgatctccgccgcgtcgatccacgtctccagcccggccatggtggcggcggctgcagcggaggaggaggaggcggaggagtcgtcgtcgaggtagttccggaggaggatcttgagcgccgggaacgtgcagtagctcatgaagatgtgcatgtccatgcggccggagcggagcagcgccgggtcgagcttctcgatgtggttggtggtgaagacgaagatgcgctccgagccgcagcacgaccagaggccgtcggtgaagttgagcaggccggagagcgtgatcgaccgcgccgccgcgccggccggcgccgccgccgcgttctggtcgatcgcgccgccgtcgatgctcgcccgcggcttcggcggctgcgccacggccacggcggtggcgcggttggtgaggtcaacggagcagtccatgtcctcgatcacgatgatggacttggaggtcgtcttcatcagcagcttccggagctcggcgttgctgccgacctcggtgagctcgaggtcgtacacgtcgtagccgaggtggttcgccatggcggcgatcatgctcgacttgcccgtcccgggcgggccgtacagtaggtagccgcgcttccacgcgcggcccgtgcgctcgtagaacgcgctcccgtcggcgaagtcgcgaaggtcggccatgatggcggccttgcgctccgggtccatggcgagcgtgtcgaacgtgctggggtgcttgaacgggacggggtcccacggcaggccgcgcgcgtccatggcgccgccgcgcgcgttggtgtagagcagccggtcctggctgcggcgccgaatgtccgcggcgccggcgaggatgtggtcgaggtacgccgggagcagaacgccccggtcgccgcggcggatccggagcgtgaaccggcgcttctcctcggggagcgggcgccacaaaaagccttgcgcctggcgcggcgcgacgacgtgctcccacgtgacggcggcgccgcggaaggcgtcgagcacccggtcgctggcggcgagtccgaaggtgaaggacgacgcgttgtgggggcgcgacagggtgagcctggcccccgcggcgggcgccgccgagctgctgaggtagagctgcacggcgtcgtagatctcgttggtgcccatcccctccgtctccgtcacgtcgaagtagcagtagggcgagaaggcgcgcgtcgcccgccccagcagccgcgccaccgccgcccggagctccgccgggaacaccgcgtgcaccaccccctgcaagaacgccaccgcgcccatcagcgacgccagcgacgtccagtactccctcatctctcctcctcctctcccctccacaatgcaatgcaacaagaaaatctcgaggattttggaagcgaagaggaggaggaagacgatgatttataggcgaagaagccggagacaacgcaaggcaaggtcgctatcaacggagagagacgacagtttttttcttcttttttttcttgagaaattattggcagggagaaaggatggatggattcttgatgcagttgcagttgcagtgtgattgagtgcggcagagatggatggagacaaagatgcagattaacacatgatggagagatctcctggattgagttcagagttcacagttgagagagagagagaaacaggggagatcttgctcggtttggactgcgagggtggagaggagatacgctgatactcccccgtccctttatacaaggcattttaatttttaatattttgtttgcatttttttttgactgtttgtctcattcaaaaaatttatataaatataaaaaataaaaattgtgcttaagtattttggataataaagtagccacaaataaaataaataataattttaaatttttttaataagacgaatggttaaacaacgcaaacaaaatgttaaaataggaacggagggagtatgaactactagtacattgtaatgatgctactgtacaatccttttggcagagggttcaattggtgcaaggctcccgttgaaatagagtaggaaaaggttttttttttttttggaggattcaactttctaaggacttttattttgagccccttgattcagaataagaagatagagaattttctatagaattataatcctatgaccaattgcatagaaaaaataaccaaaaggttagatctcttggaagactttcctttgatttattttccctgaggtgtaatcaaaaggctcatctttctgttagctctgccttttaatttccgtagaattgaaagagcgtgctacttcaattcttaccttttttttgttttatgttcgttgcatttttttttcggtccagtgttttaatactcgttttttccctaggtggctgacaccgtgggcttggactcttggaccatggattcttgggagttcccttttttttttttttggtatcaagattcttgggagttggaaggcactcaaccatgaacagtttaggtgtcccaatgagatgcacaattgcacaatacacatactattcttaaggcctcctataggttggtcttcaaacgatcttaatggttttcatcagttcagttactgctaatagaaaaatgaacaaagcaataaaaaaaacttttgcatctgagttatgagggatttaaaaaccaaggctgaaaaccagagcacaattcataaaccaaaaataaactctaaatgtaagtttaaaaatcaaaattttgctgataaggcactgtttagttcccacgcaaaaacatttcaccatgtcacatcgaatgtttgagcacatgtatggagtattaaatatagtcaaaaaaaataaaaccaattacacagattgcgtgtaaattgcgagatgaattttttaatcctaattgctccatgatttaatattgtggtgctacaataatcatttgctaatgacggattaaataggcttaataaattcgtctcgtagtttacatgcggaatctgtaatttattttgttattagtctacgtttaatacttcaaatatgtgtacgtatatccgatgtgacacgctaaaacttctcaccctggaatcctatcttagtataaagttatcccccactaactccttaagcttaacattcaaagatgccacatcatcatccactaacaagataccacatcatcatctactaattaacaagatgccatatcatcatccactaacaatcatcacatttaaacatcgtgcaaacatgctatatctttatagtttttataatttaagagcttttcaaatacaaacatgttaaattatcatccaacataattcacataatgtttcaatgtatatctttattatgttttatgatatcctatatacttatatatagttcatcctcacttagttagtgcttaaatgattaatctatgatccaaattatatttctccttttttcctctaattaagtcatatcacatcaattttttttagcctttagatgattaatctacagtctaaactatctccctactttatctcttccataaagtcataccaccttactttttacgtttgaatcactattctacatcctatttaaatttaaattatcataaaccacattagtttatataatatgatgttatctagctatcttacccgttatttttttattattatcatactaaattcccgcagcaatgcgcggggtttcacctagttaaacagggcctaagccaacaagcagacggtgtaaaccgttaatagttttatataaaaaaaatgtacaaataacctcagttgtcaattccggtaagggagattgatatgtacagtggagtaccttgcttggggggatattgcaaaaattgctttactatataatattccttttctgaaactatttttttttacttttcattcaaccgctctgaacagaccagtacaacattggattctttttggaaagaaatgggagtttcttcaccatgaaagtaaaatggtcggtttaccttattttgagaaaatagtactactaatggctgaataacaggtcccaagttcacacgcatccacactgtatttcacaactcacaagccatgcatgtctccgtcaatctctctctggcattgtgtttaggggtgcgcagaaaaagaccgaaccaaaaaaccgaaccaaaaagaccgagatagagaccgaaaagactgagaccgagaaattcggtcatcaattcggtcctaggtagtgaaagaccgaattttgttcggtcaattcggttagtctcctcgtgtaaccgaatagaccgaaaagaccgaattatcaaaaatgtctagatgcaacctcaatccactatgtttaataggattaaactctaattttcacattcctacttcttctaggcatgcaacctaataagagtctttacttataagtgtttacggatcttttttgtgatttttgtgttgaaaatttccattatttctttgcatatatgaaaatgttgttgaatttcggtcaggaccgagaccgagaccgagaccgaatttgtcgggcctgacatttttgcgctgaaattcggtcttcacttttcaaagaccgaaaagaccaaaagagcgaagaccgagaccgaaattttcagttagaccgaatgcccacccataaatttgtgtttgcatgcgggggtgtttagatacatgggtgtaaagttttgacgtgtcacatcaggtattatatagggtgttgcatggggtgtttgggcactaataaaaaactaattatagaatccgtcagtaaaccgcgagaagaatttattaacctaattaattcgtcattagcaaatatttactgaagcaccacattgttaaatcatagagcaattaggcttaaaagatttgtctcgtaaattagtcgtaatctgtgcaattagtttttttaaatctatatttaatacttttattaaacgtttgatgtggcagggtgaaaaattttaggatgggatcttaagagcaagtttaatagtatagcccactactagctccaaatcatctataatcaatgtaatagccaattcatacaatagttagttattatactattaatacctagttacacctgtcatatatattacgtcttaaagttcgtgctgcagctggctatagatctgtaacccgctactcttctctctattttttttttttgcccgctattgtacctgctctaaacaggcctgcagtcaattcagctactgcatgtacgacaaaagataatatttggcgacaaagattgcaccgactcgttgtggactgtaaatgaaaggtactagtactaccttcctgcttcctgcaattttcaatgcctagttgtgccttggtagtttgccgttgtctcatttcgctaatattgctactaccatttcagagtttagtagtagtagtacattgcaactcgcacgagtggtaatcattccgtgggcacacgttagggcattagcaatgcagctaccgcacttgccgttcctgagctgccacctaacccaagtcctttgagagtcacacactccacagtagaggaggaggataaggctaggaccttccgtgtctctgttgctctttctcatcacttatcatctctcaacccctctctctctctcctctctacatgtaccggcggcggggcgtcccgaggagcggcggtggctctgggtggcatcggcgctaggtggcggggtggcccaagccacgacgacaccgggcggcggtggcagggcgtcccgagcggcggcggtggcaccggtcggcgttggcgctaggtggcggggcggcccaagccgcgatggcgccggacgccaggcggcgagcgggtcgagcggcggcggcggcgctaggtggcagggtggcccgggcggtggcgagcgggtcgagcggcgggacggccggagccgcggcggcactaggcggcggggcgggtcgagcggcggcggcgccaggtgcgggttgagcggcgatggcccgatgcctgcgccaagccactcgtgttttttggttccaagaacgagtatcgaagtttggctccgagtacctcgtttggctccgcgagttgccgatgtggcatcgaataatcggttcttggctgctaggctgaacgccacctcggtgcgttgtgaacgcccttatggccctttggaaacgtaccatagaagaaaacatggtataaataagtgaaacagaaggatcgaaatagcatgtttttcttaagagcgatgttccggtgttctctactgttagtattatattaccagtattattagggataaatcagtaatttactaatacaatgattaggttattttatcatttatgttttttcctggctaaatcgatctatgagcacccattgtgttggtatcgcttatattccattgaaaaaaccaaaaaaagggaaaaaggtttagtcatggctaaaagatgattatacctctcccatctttttttacaataattttcctccgtgttttactaccgctaactgtggtaatactataaatagatccgaaccgttcgattaaataacatcaatagttcagattgctttctactcactgcattggatcacgtcatctctaatgggctcatgcccttacctgtgatgggttaagcgttggtcacagatcagtggtcactgatgcctctaggtcacctgtgacgagtaaagacccatcagaggtaagagttacctttgacggactacaactaaaatccgtcacatgtaaccttcatatgtgacgggtaaatattttaactcgttgatggtaatccttatctgtgaggggtccgagttgggacctgccacaaacctcaaaaatggggaaaaatattataagcctagctagtcgcaaaccttcattaggcattcacaaatcacaaaaataatcacattcacaatcatttgtgcacaaaacagaatcaccaaaatcgtccacaatcacattcatctggccaaagaaaaaaatcacttcacattcacaatcatttgggcacaaaacaaaatcacaaaaatcatcacaatcatattcatctgggcacagaacagaaagtatcaactccatctagcggcaatggatctgaggggaagggatctagcggcggagctcgatctggaattcaccaccgccagatcccacgattggggcccggatccacccacaagctccagatccggccagcacctgcaagctccagaatggatctggcaaagacttgccatcaatatgaaacgcatcacaaaattaatgagaataaaatagatactttccattgatgatgaaatcctaaagccactgttggcggtcgtcgtcgtcgtcgcttgagcggatctggaggtggtggctgctgggaccttggggcagagggcgaaggaggaggtggctacagcttggggccgtccagatatagtggtcttcgaccaccttgagaccagatctggcgccaaggagctcgagacggcggagagacggtggccggtgaccttgggattgagggagaaggaggcgactgctggagcatggggggcatctagatcctgtggtccccaaccacctggagaacggatctggcagctaggagctcgtggcgacaaagagaccgtgaccaatgatcgaccttgggcattgcacaaaggaggcggcttgctcgagcttctagaggcccagggcgagcgaaaggaa

SEQ ID NO: 18363 - DNA, 3789 bp, Oryza sativa
  unsure (1)..(3789): unsure at all n locations
naagaagaaaaagggccgaattgatgggtggtgggcccccctgggggtatatataggggtgtatcttgtggacgagtgatatctcgactagggtatttagatggtatgtggatcgtcggtacagggtatatgcaagattgaagtaaaagagatggagacaaggatttttatacagattcggaccccttatctcacaggtaatagccctacatcctgttggccgaagccggtgtttctctaattcatctgaaatacacaagtacaatatttaggataacctatctagctgtcgtcgacttggcgacatggataaccaactcgtagtcgacgacagggtagtcttcctcctcgaatatgagctcgtcgagatcagagatggcactagatccctcttgccagcctctgtaggcactagattgggtatgtctaggctaatctctgatgtcgatatctggtggcttgtcttggcgtgtgttggcttgtattgatctatgttgatcttgtggcttggcccctctcctcctatgggggcttgtatttatacccatatatgtccccttgtccaagtagaactagggacatcaatatggatacaatccgagtagttcttatcatttccatatagaactctattcatcatttcttatccggaactccttttatataagaggtatgatcccgtataagacttggtacatggtgagccctgccgagtttagtcaactactattagctatgtggtatctatcaacgtttgatgtcgcgattccagtatttgcatagtatgaggatagttggtactaggatatatgcgagactgaggtaaaagagatggagacagtgatttttataaaggttcgggcccctgaattgtcaggtaataaccctactcctgttggccgaagctggtcgttgctcttattcaccataatcacaccagtacaatatttggggtatcctatctatctgttgtcgacatggtggcttgaagtatcatcacgtagtcgataacagggtagtcttcctcctcgaatctgtgtccagcgacatcagagacaacgctagaaccctacggccggcctccgtaggtaccggatagggtccgtccaggcatatctctgacgtcgatatccggcgacttgtcttggcgtatgttggcttttgttgttccgtgtatgttgattgtgtcccctcttctcctaggggaccttgtatttatacatataggtgtccccttgtccaagtaaaactagggaaaccaatatggatacaatccgagtagtccttgtcgtttccatgtagaactctattcatccttccttatgcggaactccttctaaatccgaaggttgtttccgtataagacatgttatgtggtgggtcttgttgagatttagtcgactactattagatatgtggtatccataacgctgacagtatccataaccatgacacacctcacctcaaacgggttagggcttaaacctgtcagaggtgactaaacctcacctctaacgggccgggaagttgcggcccatcacaggtatctagtcacctgtgacgggccacaaccggatggctcaccgatgacggcatcccgtaatacctgtcaaaggtgatggtcttcagtgaccagcacttcggcctgccacaactatgccgtcagagatgtgaggatctggcgtagtgactattagtagagagcaacgtagtaagactctttttaaaaaaaaaaatccggtgaaaacaaaaggagagaagccctttaattgtaacacgggaaagattgaaccaaagaaaagtttttaagatgttttatcttaggggaaatatcctgtgaatattagttaagtgttgaaaactcgtaaaaatcatacctaaaagtttgtaaatccatgaaaaatttttactagagataggtgtatatatgaaataaattctcactaaatcttaaatccaaactcaacttcatttgagagaaaaaaatgacaaatttcaagtaaatggtgtctcctgtccctattcattcgaaatttgtcttttgttacttccaaataaaataaagtgcctatttttctttggaattgatcgtaggaatataatcttataaaaaaaatatcttctttctacgaatcaaaggagcctctagggaaaaaaatcctataagaattattttctctaaaatcctttgtcaatcatgaatcatccaattcaaaggagcgcacgcttgcactctcaacagcggtgagaaaaacaaagggacgtggctgcgtgtagtaacacataaagccatatttacttttgagaccaacttcgacaaatggtagtaagccaaaaataatcatggtggtgatttcgttttcacgcttgcagttcaaaattgcagactgaccgtatctcaataatgtaaagatacaaacataccggtcgatcggtatcagtcagcaaccatggacatcaacaagttgcgagtgcgagacatttttgtcaattttagtaccaagtagttcatgtagcaacatcaatagaagaccactcaggacacacaccaagtgtgtgtttgtggtgtagatagcatggtagagtacttttgaacagtggcctaaacaattttgcacatcagtcctctgctgttctctcttaaacccttaaaatatgtatctccaactatttaacttgatggagtagcttttttttttttcattaggaacctatggtaaaagataaaaccacataaactcgccttgagagaaaaaaaaagaattggacaatcaaaggatgaactaagaaggaagtgaaaaacaaaaatcaaggccatcgataacattaagtcgagaaaaagacttcatgtaagactacttttcactttttcactttccgctcggggttggctacagcctctggtgtggattagtaagaccacttttcacttgagcatcaacttaagacttaacatagtggaacatcagtgtgtttagtggtggatttaccataagcgtggcagggggctcgagcctccattatcggcactaagagtacataagcctccaccgagttttcttaaaatttcctgccatagaactatagaagaagatctcctattggtaaaggggctgaaatttttgtctagtttatttagtttttgtacaatttctttttggatttggctgtgattgttttaagctagactgtgcattgctaaatggttgaactggcaccgacacaaacgacaacttggctcacacttatccgttcctggccggtgcaagcatgggtacaaaaacgaagtgcacaagtacattcagggcacacgcaatgcaatgtccggatatactcttttcgttcctaaaaatcaaatatagtacgatatattttaatattataaataaatctgaatagaaacatgtacatattcagtattataatgtattatgtctcatattaaatttgatttttatggaccaaagaagtacagcttagctggatgacagggattagtcgtatatggtcctcggtagtacttaggggctgtttggcaggactcctctccaagaaaatagctccatctccaagttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaacgattcgcttctattcctattanctatggcngacacatatggactcct

SEQ ID NO: 18364 - DNA, 1107 bp, Oryza sativa
ccatgggggggtttccctcctcccgcaacgggcaaggggcgcgtctgcccgcctcatgttgccggtcagtggcgcggcaaggggccgggctgcccgcctcccgctgccggagccgccttgcacccgcctcccgctgccggagcagccttggggcacggctgcccgcctcccgctgtcggagccgtcctggggcacggcagccctgccgccggagccgccgtggggcgcggctgctcacccgccggcgccgcactggggcgcgggtcccagccgaccggcgctgcccagcagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcattttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcctggttatcttgctccatacaagggtgagagataccatttaccagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagtttctcgaacggcatgtgatgagtcaactcccgaaagaagtgcacgaactatgtatccttttcgtgatgg

SEQ ID NO: 18365 - DNA, 14092 bp, Oryza sativa
  unsure (1)..(14092): unsure at all n locations
gagcgtcttttgatgctgtgcgatgcccnagcncancacgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccagtctactgtgtagctcgatcgtggccgttttggcgttttgctgcaacattacctctcgcagcaggattgaaataggtgcttgcatcgtcttgaaaaaagtctattttataatttttttattttttattataaaaaaattagctattcgagctaattttgtaccgttcttgaaatagctacttgcatcatcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcattttttttagaggagctctcccaaacagccccttagcactgcacacttggtgcgtacgtgtgcagcggcaaactggcaaaggtgcagccaacaaatgcacatgcttgcctgcctctctagctaatgctgtgtttggatccaaactttcaacttttttcatcacatcaatctgtcataggcacataacttttcagtcacatcgtaccaatttcaacccaaactttcaactttgaaaggaactaaacacagcctaagagcctgtttgggggagcttttagatgctccacttctcctagaatcagaagctccccccaaacaacctagcttttggtgcagattctaaaaagctgtaattgtagaagtcataaactgaaaaactcagcttttctagattattaaaaactggctttcaactgcttctgaaaattttgagctctctcaaacaggccctaagcaagtagttgcagttcattgtccgtcgtcaacgtagaggttggatatacggcaggcttgtcaggaaagggttttagtggaattggaagtgtagttcctgttttttcctacgcaaaactttgtatcgttggattgcttttagaaaataccctatgattcactctgctccacttttatagctccactgaaatgcagtaacagtaaatgaaaaatagagaattcaagctcatagggattttaggtaccgtagctccatttggatgaaaggaataagtcaaaggaaaaaaaacattaggattagtcccatattaataattaatgatggaggagtacaacttaaaatgtgcgagcggttctaacttttgggttgtgtttctagttgcataggcctatggtgggacatgcccattgcaacgtgagtatccgatagttgacgggtcgagctatgcattccgttaagtggtacttaaggtctgaaggcttgaaagaacttttagagcttcatggttgagggtgtgtccataagagcatccacaatgtattagtaccccttaggtattaaggtaggtcccacataaaagcataagaccaaacatcgatttgtgcaatgtataacctacttcaacaatacaatgggatccacatctaataaaatttgtatttctattggtcctcttcatggcttgggtaaaagagtaatgcttgtttatatgaatagcctggcctcatgggaagacccggcttgttctttgatagcctaaaacttgttttttgcaatgtatagtacccttgctatagtagaaagattcccttagtgctccccttagttcccacaccatggatactctaataagttttcggaggttgttaggcacggttgaggtcaggtgtacgaaataagtctttgcaaattattggacacgatatatgacagtgaagattgttgggtttactcgtacatcagatattgatgttaggcaacacagctgaaatggtgggggatgagacgaggcttttgggtaatgtaggcttagcatctagagttgtagttttgattggctttgtgggtttatagttggtgggctaggctatatattataactagtggtatcagagcacaagagtaataagtgtcattatagtcgatttttttcttaaaagagctagtgtttaaaaatataatgtgatgaaataattctaaaatcaactctaaaattagttttaaaattcaattattaactgcagctgataaagataataagagtaaaggggtatccatcattttcttcctatttttttctttagggttttgttatttcttggtctgcgcatatattgggtcaccggcaaatactttatatattatgaaatggagagaatagctgggaacttttgtttccgctaaaagattttgtttttggtacatcaaccattcacccactttggttggtttagttcttgttgttccatcctacatgcacaatcgaattgagctttgttccatcatattatgtcttttcttcagttttatgacaacttcacttttttttatttttttagttttttattggttatacgtcttagagcaaatgccagaaatgtgaatccttttcatcagtgttaaaaaaaaaacacaatcgaatcgaggagcgatattgtgcagtcaatttgcctactcctagatcagtcaaaacggaaggacgtcgtgtactgctactacaagcttacaagggccagcaatgacagtgtggtacagtaaatgctgaaacggctgctttgtcgctcgtcatccacagaccgggataatgcatccactgccactttgaacaacgtgaggatgcagacagttcgcaataaaacaaaggatacaaacgctgtcacattttctcacagtactcctacactcgacgcgacgagcatcgtggtagagtagcagccgccaccaccacggattgagatcctatgtagttcgactgaaccgtttcttttatcactgatatatgatttgatgatctttaaaaccacatatcctgatcccaggcgtggtgcagtgaaatatcctgatcccaccactactgtagcaatatgccaaagaactgaacggcagatcgttctcaattcgtggtggtgccactggccagcttgctatgaaccactcactgctagagatagcagcagcagtagacgcatgtgtcgcagcaggcagagatagagagacagctactctggactggagccaaggcagctagccctactagtatcccgtaggagtggaagtggtaaagaaaacaagacggcatccaaaccaacagggccactgcagtgcagacgaccgaatctctcagagcagagcagagctgcactgtgctgctagctgcttggtgcgtcgagacataggatccctttaggcattgatggacggcagcaggctggcccctgcacggcgcgacgccggcggctttcccggccacgagttcgtacgcctgcctagctttgccagccgccgcgcgcgttggggccgtggccgaggaagaagacgtgctagctcgcctacacacgcccgtcgtcctcttcttgccgacaatgtgcgtcgcagtagtagcagtagtagacatcggttgcgactggatcggaattcaccggtcgaagagcgtatagctgtgctggtaattctgtgggaatctccgatcgaggtgcgtgtgcatgcatgccacaccgtggcccatccctggcggctcgctcaggcacatctcgggcgcctgcattagagcaagtttaatagtttagccagctaccggctccaaatcatctatagctaatctaatagcccattcatacaatagttaactataaaaatatactacaccattaatacccggtcccatctcttatatacacataacgtcttagagtcagtgttgcagctagctacaaatctgtagcccgatttcttctctctcttctcttttctttctcgatatgtgtttataactggtttatagcctgctattgtacttactcttatgcaggaggacaaggataatagtaaactactacatccctcttaaaatataactttttttctataaatataaacacatttcattctctggtctagttgttgttttttttttcattaggaaccgcagattttttagtccatcacattcacgcatttacaatccatgtgactgtattaatacttttaaatggtattttattaatagcaatttatgcttcacaataatatatattttgtatatcgaagtctacagctaaaattatttatattttaggacggagagagtataagttagctataaacttatacggagaagagagacgataaaaaaaatcaatggtgttgactctcataaacagctaactcggcacgtgctacaagacaaatattaccttcattccaaattagtggtcgctttgattttttttcttacaacgtttgaccattcgtttaatttaaaaaatagtgtaaatataaaaaaatgataagtcatatttaaagtattttttataataaagcaagtcacaaataaaataaataataatttcataattttttaaataaaacgaatgatcaagaattacaaacaaaaacttaaagcaacgagtattttgggacggaggtagtacattaaatacataagtaaaaggaagagagaagagaataaaaataaagataatcttataactaatcgattatatactccctccatcctaaaaatattcaatctatgagagaatttgacccctcatagtacaacgaatctggacatagagatataagtttatccagatttgtgatattaggaggaaatgcgccctcttctaaggtttagtttttttttcgacggagggagcatgttggttttaattaagataaactaaaatagctggcagtgcgatcgattggtccttgggtgcttcaaccaagtgtataatcatgatcctacatataacccatacctagctagccgggcacgacgcaggcaggaccagccatagacctcgcttgatcagttgctctcgttcacagtgtcagtgtgcatcatcaggacatggcagggcatggaggcgcatctcacacaatgattggctcttctgcaacatcctccccctcccatttggcccattttctcccttgttcgcatctgcgcagtgccgcagaatgccagaatcatgaaaggccaccactggggatcattgggacgcatatctatctatccgcccggtgttgtgttgggactgtgatgaatcgagcgactgcctggctcgtgtcggcgggatgccggctgatggatttcatcggccgtgtttagaccctgtaaaaatttgactattttttttaagtatacggacacacatttaaaatattaaacgtatactaataacaaattacaaattccgactgtaaactacgagacgaatcttttgagcctaattaatccgtcattagcacatgtgggttactgtagcactatggctaatcatgacgtaattaggctcaaaagattcatctcgcgatttacagtcggactgtgcaattagttttttttatccacatttgatgctccatagatatgtcaaaacatttaatgtgatagaaaaattgaaagtttaaaaaataagttggaatctaaaaacacagccatattcaccatcgatcgatggagcggagtagggggctaggggccccgcgggggaataattctgcccatgattaagctgcctgccggcacgaagcgagattgtgcgcccggaaatgattcgcctgcatttgcatgcatgcccccctccccgggctgagcagagcagtgagctgagcgggaggaggaggagcagagcagcactagccaatggagcggggaaaaaggcagccgagatccaaggctttttgtggttttgagaccggggataatcgggagagagaacggcttgcccgggcagccagggtgggtcagccctggggcatcttgctgagcgcatgagcctttaccatggtgtgagtgtgatcggatccgaggatgaacgccggcgtcgctgggtttgccggaccgctgtcgatgccgcggctgatcgagagagctcgagattgggtcagtttgcaagagtttcagcaccaattttatttctgttgaagctgaagtctagctaaactttaaaagaaaaaaaaatagagcgggggctacgacactcatgaaatgaaataaagagggagagtttggtttaaattgatccataaggccattcctaacccaatgactaggatggtgtccatagtattaaataagctgtcacatatgatgaaaaatgatgtggcaagtgaataaataaggaaagagaaagaaaccatgtcttgcatgagacatggtttctacacaacatccaagtcatcatatgagataagtggcattaaatttatgtttggaatagtggtgtttgcattagaaaaatagtgtctagtactagtttcttaatgatgtgaagtttataaaaactatgtctagtcttgggttggaaatggcctaactctacttagagttaaaataaatttaggagctggggtgctactaatcaggcctgacacgtagcgtgaatcgtgatcgggtccgtgacgtacgcccgccgtgtttctgggccagatcatgttgggttgggtagaaagggttagcttggtttgggccggacattttagctgggctaggttgtttagctaaggaaaaagtacactgaaggtccctcaacttgtcatcgaattacaaaatcatcttgaaccgtaaaaccagatataaagcatccctcaacttataaaaccagtacaaatctctggcggttttaactccggttttgtctgatgtgacagctgactcagcatgggacccacgtgtgccccacgcgtcagcctcttcttccccctcccctctccacctctcttcctctctctcctcttttcttcacggacgccggtgggggagcagctgcacggccggcaggcggcggggtgaggagccgcgcgcgtccttctccggcgcggtgttcaacctgtccaccaccatcatcggcgcgggcatcatggcgctcccggccaccatgaaggtgctcagtctcgtgccgggcctcatcctggtgatgctcgccgcagtgctcacggacgcctccatcgagctcctcgtctggttcagccgcgctgtgggcgccacctcgtacggcgaggccatgggcgacgccttcggtgctttcggcagggggatcctctagctctgcgtcatcgtcaacaacgtcggcgtgatggtcagcttcactgaacatttcgttgtgactctaatggcttgtgttctttttccctgggatgagttcagatccactgaaatacacgccggccgtgtcggttgctctggccgtcgtgttcgtggtgatcactgtcggaatcgccaccatcaagctgatgaaagggcagattccgatgcctaagctgttccctgatgttcatgactggagctccacctggagacttcccactgcagctccagttcttgtgagttgtgactgcctacattttccattacaacggtacattttaattaccagctaagtttgcatttttctgtgggaatgtgattaacttgccactgcattcagtgcacacaattcacaacgagctcaaggaccactccctgatcaggccaatagtgcgggcgtcactgctactcggcttggtcgtgtacaccaccaccagcttcttcggcttcctcctcttcggcgaggcgacgctggacgacatgctcgtcttccccatcgtgttccgcgcgctgcgattcaacatggacggcctcctcttcccctcagcgaggcccttctcctgcgacaaccggaggttcggcgcgatcacggcggagctcctcacggtcatcttcctcgccgccaacttcgtccccaacatctgggacgcgttccagttcactgggagtagctgcacgggcgacgacgtcgactgcggaggcggtggcgacagctgcctcacggccgtaatccttgtggcggcagccgtgtctccgatgaggccgcgctcctccagcgcgagctcgacgccggtggcggggaagaaggagaaaacggcgacgcggtggtgctcgcaatccaccgcgccccgatgtgaaaaggctgcggcgggtcacggaatgccgccgccagcgccgccagcccgccaccaccaacgcccaactctgtctgggccatcgctggcgacgtgacccccctagccccaccaccagtggctcttgcccctgcttcggccggccggcatgaccggcgaattagaagagaattggagagagagagagagagagaggacgggagagagatgacgtgtcatcatgtcatgtggggcccacgtgggtcccacgctgactcagccgtcacgtaggataaaaccggtctcaaaaccaccgaaagctctattataactagttttgattagttaagagacgtcatatatctgattttgcagttgagagatgattttgtaactcgatgacaagttgagggaccttctgtgtactttttcctttagctaacacacacgcacggaagatggaacggtgggaaaacacaagtaccagtactccctccgtctcaaaaaaaaataaacgctgggtttccatatctaatgtttgactgtccatattatttgaaaaattatgaaaaaaaattaaaaagataagtcacgtataaagtattaatcatgttttatcatctaacaataataaaaatactaattataaaaaaatttcataaaacacggatagtcaaacattaaacacgaaaatctaggatttgttttttttttggacggaagaagtattgggccagtcgctttccatccgcttttcacaaccggcaaagacggtgagatgcgaccgcaaactgactacaggacgacaaagttgtgtgttcagttgttcaccacgggtgtcttcacagccgtactgctaagtcaatcccgaaagcttcggttgtgattcagaaatatgacgtgtttaaatccaaccagaatagttcgtatcaaaatttgaatttgcggcggcggtggccagcgagtgcgtggtcagtgagcacgcggctggcgaagcggagcggagcgccggcagaggccggcggagtggagcagagcggtggcgacggcgataggctagagcatggccaacggagcagagcggagcgtcggtggcggcgggctgcgtgtcgataagattggaaaggaaagcaaaggagaagaaagaaaagaaaagagaaaaataaaaaaagaaataagatatgtgggctctatattttttttatctcacttatatgtagaccttatattttttttctgactagaatgaaatcagcgaaaccatctatatatactatcatgggacccttgattgcatggttttgaacatttgaagggtgaagaattttggaattagggattagggctgtcatacagactcgacgaatagttaaggaatggtaggtgaacttattccaagaaggaacgagtgggaaaactgtaagtgttggggcagtcgctttccatccgcttttaactggagtacgtgcaaagacggtgaaatgcgacagcaaactgtctacaggacgacaaaattatgtgctcggttgttcgccacgggtgtcttcacagccgtactgctaagcttgctgacgccccgaaagcttcggttgtgattccgaaataggacgtgtttaaatccaaccagaatagttcgtaccaaaatttgaatttgcgtcttagtaatttgaaagttttcaattagctgttgtgaagaagcggaattaactgacggagtgaaatcatcaggagaagcaaatggctgcattcccccgctacatattgcgacctgtgtgcaatgattgtactattaattcgctttggctcagccacgctgtcagctcgcaatcagataatgtaaccaattgctaaataacaaattccagagaaagaatgtgaatggcgtacgctaccatggcggaatcaaccaacgtcgcctcaacaacattaaataaaaacaatcagaatatacaaaacaaaaattgatcgatcatgggaagtggtacaggttggacggctggagcccggcggtgacgttgaagtacctgaacgccgccgcccaccggcggttgtccttgagcatgtgcacgaggacggtgtccggccggaagttgtccatgtcccagttgaggtcgtacatccgcggcctgaggctgtaccggttcttgccccggcggccgatgttgagccatttcccgacgaggaggtcctcggggccgtgcgtgtcgttgtaccgcaggatgtcctcgttggtcgacacccacgtcgcgacgtcccaggacacgacgtagcccatcccgtgcatgaactgcatcgggtcgtcgccgacggcgaagccgtagccgaggtagacgtcgtcgcggggcttgtgccggagctcgtcgaccagcgcggccacgcggaggtacgtgtcgtcgtcggtcttcatcacgtagtcgtagggcgacgacgcgaacatccgcggcacggaggagaggtactcgtgcgtcttgccgtcgttcatgttctccgtgcagttgagcaccaggatgtcgccgtgccgcgcggcctccagcaccaccagctgcgcgtccaccgggtcggccacgcggcagaacacgaagcggacgtccacctgcgcgacgccggggggcaccgccggctgcagcgcgtacgccaggcgcacgatgttgcgacgctcgtaccgcttcggcgtcgtcagcacccccaccagcagacggagctccggccgcacgacggccttcgtctcagcagcagcagcagcagcggaagctgcatctccacccggcgtgacgaggtagccgtcggcggtggatgggccggcgtggcagaggacgccgaggccgtcggagcggacgtgggaggagccgaggctggggacgacgagcaccacggcgaggaggccgagcggcaccagcaggagatacggggtgcagagcgaggcggtggccgggaacccgtgcgacgacgacgacgacgacgatgcggtcttcatcgtaaaaatctcgcggggaaatgcaagtgcccctcgcacgatcgcggcccgcgcgttactcgagctatagccgtactcgacttataaccaggcacgaacgcgcgctggtttagcgatgtgggactaaaatttcagcattttccccctctctctctatctcgtgtcaaaagcgtcggtggaaacgaacggttcttcgcggaagaagtcgtcgtggcaatggcaatgtggcatcacccacgggagtacgcgacacgggctcgatcgatcgatcgtcgtcgaggctgccgtcatcaacggcgacaaggaaccttactcgataagtttactggataattttgggttgtctcgtgccacatgacaggggatgtttcaacggccaacgccatatggtaggtggcagacggccggggatataccccagccctccagagctctagttttatcgccaatgtatggaaggacagctcaggggtacatcgaaaattcgaaagggatttgattaaaataacaagtacacagtgagcaatcattcaatcattcatgctgagattcgaggcatccagcttccagcatgcattgttggcgacttggcgtgatcgttttgagttcgggggcggctggaacagaagaaggtcgctgggaacaggcaagcttgtcggctactactacttgcgcgatagatatgcccggtgtgtgttcaattgttcatgacatgcctgatgccttggctggaggacgatcgaaaccgagatctcaccaacttatacaaatgatggtagattaataggcagggaaattgacaattcttgcggatgcttttgcctgtatgatcgccttaatttgagatcgtgatttttcagtgaaaaaatcgatttcgtgcaacttcgaaacgttgagggttaattggctaatgcagctggtcttctgttgagtaattcaacataagaattctactagcagatcgatatagtgttgacctgttctctctattttgtaaatataaagtttagaccttttctgggtatatggcatgtgttatggcaaagtcggtcagactgatcatacagtgaaaccaacttggtctggtctttctttctcagaatacaacctgaatgtacgcgtacccatgcatgtctacttcaattgattaattaagttttgtactttctagtaatatacggcattgtttacttttggatatgatatttgaccattgattttattaaaaaaaacctaagtaatatttatttagttgtgatttgttttattattaaaggttccttaagcatgactatatatattgttttatgtatttatactatacgaataatcaaacatcatgtctaagagtcggctatgttatatattaaaatcagagagaaatagagaatatatactagctagtaaaatgttggatagcaacataattgcgacggaggtagtatatctattatattattaaaggaattgaaaaaggagcctccacattcgctctcatggtctagaaattctcacattaatcggacaaaaagaaaaaacagagttcatatagaaatacaatttagaaatagctgaaattcggaattaaaaaataaggaatattagaagagttgactagagtccatatagaaatacaatttagaaatagttgaaattcggaattaaaaataaggaatattagaacaggagactagagtccatatagaaatacaaattaggaaataactgaaattcggaattaaaaataagaaatattagaagtagagtatagagtccatatagaaatacaaattaggaaataactgaaattcggaattaaaaataagaaatattagaagtagagtatagagtccatatagaaatacaattaggaaataactgacattcaaaattaaaaataaagaatattagaagtagagtatagagtccatatagagatacaattaagaaaaaaacagaaattcggaattaaaaaaaggaatattagaagtagagtataaagtccatataggaatttaaaactaactaaaattcggaaaaaaaaagagtctccatgttcactctcatgacctagaaattctcatattaatcggagaaaaagaaaaagcaaagtccatatagaaatacaatttagaaatagctgaaattcggaattaagaaataaggaatattagaagaggagactagagtccatatagaaatacaattaggaaataactgaaattcgaaattaaaaataaggaatattagaagaagagtatatagtccatatagaaatacaattaggaaataacaaaaattcggaattaaaaataagaaatattagaagtagagtatagagtccatatagaaatacaattaagaaaaaaaatagaaatttggaaataaaaaaaaagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaactaaaattcggaacaaaaaggagcctccatacaattaagaaaaaaaatagaaatttggaaataaaaaaataagaaatattagaagtagagtatagagtccatattggaatttaaaactaacttaaattccggacaaaaaaggagcctcacgttcgctctcatgggctaggaattcttcacatttatattagaaaangaaaaagccgagtccctattgaaatct

SEQ ID NO: 18366 - DNA, 11880 bp, Oryza sativa
  unsure (1)..(11880): unsure at all n locations
gtaaaaaaaaactgttgctgacantcnnnnnnnnnnnnnnnnnnnnnnnncacattagtagtttcgtaaagttattgcaaaatttaaaattatgttgtcattgtaatatattttaataataaaatgagaaaacatatatgctattatacgtgagaaaatataatgatgctaaccgcgtaatctgcgcgggccaccatgctagtttttttttttgaatgccaaaagaggtagtatatgacatggtacatacggagtaccttctattagtatcttctcaagcaccgtgatagaacaaatgtccatctatctcgaggcaacaaattgctcaccttaggagccaaactaccgaatgtataataagatcgtaggttgtgatatacaggtttaatgcttgagaatgcaacggacattgctccagtcaaggttaagtacatcttgcactattgttatgcacttttcttttgagtgagaccaccaaaaacaacataggaaatccccaaaattgatatggcaaagctatctgaaatatacagccttgacaaattacgttttgcaagaggagtacaagcaaattacagagctaataacaagcagagcaagcacattccactttggaggctacaagtctactacagcttcaccctgcggaccacttgcatcaaccctaatcgtatgaagaagatggatacaaactttgagttatcatatccatcagccggcgacccccccatcttgaatgctttcatttcctccacacgcggacacaccgtgctgtttctcatcaatccgccaattacaaccacacctatcgttgtcacgaggcgatcaatgacgaatcgatcgaacaggatcaacccgatgatcaccaagaaatcgagcagccgaaatcgaatttgagcgagtcaaaccgaggcacagctcgcgcatccgtgttcgtgcaccgcacaaccaatgcacgaatcgaattaaacccgttaaagaatgtgtcgaacgattagttaattagaattaatcaaacggggaagaaattaacaaacaacaattatggatcatcgaagaggtgatcgatcgatcgatcgatcatggtgagaggtggtgcaggttgatcccggcggtgacgttgaagtagctgaacgccgccgcccaccggcggttgtccttgagcatgtgcacggcgacggtgtccggccggaagttgtccatgtcccagctgaggtcgtacatccgcggcttgaggtcgtagcgattccggccgcgtccggcgaggttgagccacttcccgaccatgaggtcctcgggcccctccgtgtcgttgcgcgcgaggatctcctccgccgtggacacccacgtcgcgacgtcccacgacacgacgtaccccatgccgtgcatgaacggcatcggctggccgcccatggcgtagccgtagccgaggtagacgtcgtcgcggggcttgccgcggagctcgtcggcgagcgccgccacgcggaggtacgtgtcgtcgtcggtcttcatgacgtagtcgtagggggacgacgcgaacaggcgcggcacggaggagaggtacgcgtgcgtcttgccgtggttcatgttctcctcgcagccgccgagcaccacgacgtcgccgtggcgcgcggcctccagcgccaccagctgcgcgtccaccgggtcggccacgcggcagaacacgaagcggacgtccacccgcgcccgcgccgccgccggctgcagcgcgtacgccagccgcacgatgtcgcggcgctcgtaccgcttcggcatcgtcaggacgccgacgagcaggctcagctcgggcttctcctcctccttcggcgccgccggcgccgcgacggtgtagtcctcggcgccagcgctgcggcgggcgcagaggacgccgaggccgccatcggagccgacgcgggcgccgttgagagaagggagcaggaagacgacggcggcgaggaggagcagcgcgagcggggcgaggaggaggtaggagttggacgacgccggcgccttcatcgccatggccgcatgcaaatgcaacgggagacaacgtggttggtaggtgcaatgcagaacgagctgtagtagctgttatacgcgcactaatcaagctcacgtaatcaagaattccattaagaaattccactgcctaacttggtttttttgtaaacaaatcgtcgaacagaacagctgacaagacaagagttctttctagcttgacgcgatgcgctggccagttagaactcgccacgtgcagtaataacaacacccatcgcttaccttttaacttatctacaaataaaacttaatattgaatttaattttagagttttcaattatgatttattttttacattgatcttttaatcgccaaggacgatatatatatgagtgtgtgtaatagttttatagctttcgaacgattaaacagaaaacatcttctctttttcttttgacagagacggttgctctgtctcgttattgacacaaaggttaagttaatcacgaaacgagtccatatcccatagaggttcagaaatggcacgttgagctgtcgccgttcaataatagcagccgagtcaaaggagagcgtgaagtgccgttcacgacgacggcttccccgctgcgaaatgcctagccttaccggtgaatgatcggatcaaactctgaacaggaataataataataacaataatgcagagaagtttctgaatatgaggcagaaaagaaagccatatggtccctagtagtagggtcgaagcctgtagtatacagataccagtattaatcaaattttagtccctgagttgccgtgccgtgctgtgctatgctcgcacatgctgatggcattgttgtttgtgttcatggctctgaaagtaacgggctaccaagaactgattccaatcaaatcgcacatcgctgtttcatgtgacgaatcctggtcatgggctggtgtcatctccagtcgtgtttcgtccagaatttgtaccgcgttttcttcctgttgctcgtcatctttgtgcttctcggctaagtaattactagcctgtacgagcagaattgttccacggcgaggagcccccgttttcaagccgtgctccccgcgtttctggagacaaagaaaacttgtcgatacccaacagtcctacctgattagctcgaaatcaatcgacaaaaaccggtgaaatccgaacaaattttgcagatatatacactgaacctttcccgtatttagccggcttactgcacggtttctcaattcgaaccgacttgataagattgataaccgcgaccgattacttaccgtcataggagtatctttgagaccctggtcaggtcaaaggtcatcggaaacgactcggaaaattaaacctccaaattcacaagtctccatcccactggtccctggacatggaagaggaggggaccggccgtgtgtacttgtacacggaaggaaccaagcaacagcactgtcgccggatggagtttggtcccggaggaaactgatcgatgaagctccaagactccaagcgccggcgacatcacacagctcgatcgatcggcagcagcagcagctacagaatatagatgcgtcgcgtagcaagctgagctatgccgatgggccctgtggcactaacggttgccaagagaggggattctaatcactcgagatgataatgtagtgatcgataggtcgcaataggcgccaaagccacccgtatagcctagtgatctttaaaaaaaaaaaatctgaattacccttcttactatcgtggtgaatagcagatattcaggtcccgtttgatagagctctaaactccaactcccaattctaactccaactccagtaagagctggctcctatacgagctgagacgggtatagaaagtatttggctagattactcagatccacgccaccacatccctcgtcgccattttgtcgaacaccttgtagacgtcaccctactgttgctgccgccaggcagcccgcgagccgccgctgctggtcagcccccgcatctcctccgccgccccgggccaccacctatcgccaccgccgccaacgcctgccgccgccaacgcaaacgccgctatcacagccacagcaagacgccggaggaggatggggaggaagatggagaggagagacaacgggaggagaagggtaggaaagggtagtttagtggtatttttacgtaaatacactaaaaaggtagtggttcttttgaggtggagtggagttgtggagcagcaaaaacccaactccatcccgtagtataattttgtggagcagctctgctacctctgctctaaaaaaataaagaatatgtatctatcgatgggggatacccgtagaccggataaatagggtattggggtacgttggtatgaggatctacatgatacgacatcaaaacaaacaaggagacaaagattatactggttcaagcccctcgttacgtaatagccctaatctagtttgtatgagattgatatgaaaaatcacagagtacaaagagaacaaaagaatccggcgttactggcgagatccttctctagatgattcgatgagatctcccggcaagtgggcttcgcgtcctcccgctccgtaaactatggtgggggtgttggtgttgtgatacaatgatctgaaccctcaggcggccttttataccgtgagttgccttagtctccaagtagaactcagagacaacaaaccctgcacgatatagaataaacctaatcctctctgaataggactctgataatcacttgcccataaggatattttccataatatcttgtaaattcccttatcgcatacggaaacatatcgtatacatgaaggtataccgtatccgtatattccataaggcgtgggatatgaggtatgccttatccgtaaccatgacagtaccgtttggcacagttctccagataagctggagttgggaggtagagctgtgccaaacggggccaataccatcaacttttcatactagacaattaaccccctaactcctgttttagatggttttgaactggggaggttaacgtggcattccaaggtgtcaaaaaaataaaaaaaaaagtaagtcaacaatggctgttagcaatatttaataaaactagcatagtgacccgcgcagattacgcagctagcatcattatattttctctcatataatagcatatatgttttccccttatattattcaaatatattaaaatgacaacataattttaaattttgcaataactttacaaaactactaattactaatttgtaatattcatattgtattttatatacgtgttagttattaattatttttaatatcaaatttcagttatttgtaaattatatatattcctatatatactctagactcgtcttttaatatttctttttttagtttcaaattttttttgtaaattgtatttctatatagactctatgctcttcttccaatattatttatttttatttctgaatttttattatttctaattgtatttctacgtggattctaaactcatcttttaatattatttaatttttaatttcgaatttcagttacttctaaactatattcctatattgactttaaactcttcatcccatatttttcttaatttcaaattttagttatttgtaaattatatttttatacggactctaaactctacttttaattttattatgtttattctaaattttagttagttttaaattcctatatgtactctatactctacttctaatattccttattttttaattccgaatttctatttttttcttaattgtatttctatatggactctatactctacttctaatattccttatttttaattctgaatttcagttatttcctaattgtatttctatatggactctgtactctacttctaatatttcttatttttaattccgaatttcagttatttcctaattatatttctatatgggctctagtcttctcttctaatattccttattttttaattccgaatttcagctatttctaaattgtatttctatatggactctgttttttctttttctccgattaatgtgagaatttctaggctatgagagtgaatgtggaggctcctttttctattcctttaataatataactagctaggtggcctgcgcaattacacggctagcacccaaacaaaatcatatatttttttagtatgatttttacttaaaatttattaaatagttatctcattgtcttaagactttgaaagacgaaaccttatcatccttatgtttctaattatatagtttttaaaagtcacaccaattgctaccccttatgtcatctccttctttatttgcttgctcgatctaccattatttctattcattctttttggaacctttaaaaattggattttatagtttttagagtttattgtcacattggatttcatttttataatatcaaaatgtcccgtcaaacgttgccattatactcctctacggcccgtccattgtctcttctctttattgtcattgagattttaaaaatcgaacataattattgtttgggttcatttttactttctaaaagtcccgccaaaccgtcaacggctttgccattgtactcctctacggctaacccgctaccttacttctttattgtcattgaaattttaaaatcgaacatgattatcattggttcttttttactttttggaagtttcaaacctttaaaaattggacttgtagttttattttttataacttttagaagtcccatcaaacgatgccactatgcccctctacagcccgtccgccgccaactctttattgttattatgattctaaaaatcgaacataactatcatttgaattcattttttattttctagaagtcccgtcaaccgtcagcggctctgcaactatactcttatataccccgcccactgcttctcctttttattgtcattgagattttaaaaattgaatatgattatcaatggggttatttttttttactttctagaagtcccagcaaccgtcttactcgtttgcttcacggcatgcctgacgtccctccttttaattgtcattaggattctatttggtgttttattaacaatttttatatctcgtatcaaccgccaccactctactcctttataggcatgtttcttaatttatctcgtcatgtgttttagatggtcttttctttcaataatctttatttttatcacaaattttagttatttataaattgtattcctaattgaaatcttacttttctttttcaaatttcagaatttttttaaaaaaaattagttaatatcgtattgtgttcttttaatgtttttattttttattttcaatttcagttgttttaaaattgtatttctacttgaattttcttttaattttttctaattttagatattattttatttttattctcaattttaattaatctcgtattgggttcttatatggattcttctttcaatattgcttatttttaattctgaatttcagctaattttaaattgtttccttcatgaactcttcttttattttcttttgctaattttggatttatttatttttatttcgaattttaattaatctcgtattgggttcttatatggactcttcttttattattccttatttttaattctgaatttctgctatttttatattgtattcctacttggactctcatttgcttttctaattttggattttatattatttttgtttttaattttgattaatctcgtattagattcttatatggaaacttatttcaatatttcttatttttaattccgaatttcagctattttaaattgtacttctacttgggctctccttttctttttttcttttctttttctctgaataatgtaggaatttctagcttccacagcgaacatggtgcctccttttaaagctgttttaataatataatagatagataatgaatggtcccacatgttaccttcttctcttttcttcccccattttcttcatccccagccgggtagatacggaggaggcagcgagccagcaagcgccctccttggcccgtggaggaaggcgacgatgatagcagtggcagccagccgacggagaggtgagctcatgcagggtgggtcatgtcttccctgtcacgccccgaactagtcccgaccggaactagcccgtgacgcttcaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaaaaactcctcatcagcaggatccgcttcatcttcttcagcaactgggggggaattatttatatagagcaagggtgagtacgggagtactcagcaagccatgggaaataagtgtttaatgcaggcttcaaggaaaggctgatgtttttgcaattaatttttatttgaactcttttctgaaacaactaagtgagtgcttctcaaacgacacggatgagacagtgcgtctcgtccggtcggagtatgtgcaatgtatcagtctttagaatttaaacaaggttagcacccggccaacagctttttcaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccgcatgacattactaacccggatcacccagcccgtggggatcagccacgtcgggagacctccaagctttcatgacaaggcatttccaaagccgacacaggtttaccatacgccgacgagaggggtcccagaccaacaacaggttagctcccagaccatactgtgccaggaagcccaggggtcctccccgacaccaccccggcgaatccacatgtctctcggcatcaaggctcccctgataagctagttactcagccaggggtgtcccattccacccatgtggttgtacttgtcttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatagtatagcaattaacaatggaaggatcaaatgcaacaagttaggtaggtctgccaatctgccttgcagacggaacaacagattaagtgcaatcctatcaatgcataatattttacaagcaatataattagatttcaaatataggctcaagatgttcaaaggtggcttgccttgctcgagatctggagcttgatcctcgaaatcctcgcaatgcgggtcttcgggctccgaaactacacgcgaaacgggacaactcaacaaacggcgaaaatgaaaccctaataatgacctctaagcgtgccattagatagatctcgagatttgaggaattttggaagttgaacggagtcaaacggatctaaggttaggaagatattgaatttctaagattattggattttttggtcaaaaagaaaaggatttaattaaatccttttttggaaaagaaaagaaaagaaaagagggagggattatagacttttcctcgggcggctaaggcgcggcccaagggaattggagcggaccggccgagttaaatgggtcggccggcccaaggcggcccaagtgcgcgcgcgcgggagggaagagagagagagcgccggtggaccgggctcaccatgcgcgatcccgggtgggacccgcttgtcagcggcttggctcaccgtgcggagggagtacgcggctcatgcgcgcgggcgggggagggacgcggtgcacgtgcgcggttcgcggtggatgcggatgcggcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcagcggcagcgagcggcggagcgaaccacggcgatacggacaaaagcgagcacaccgggcggttgctcgtgatgaggggagacgagccaacggctcggatttgccggaggaagcttgacggcggcgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcaaggctggtgacgtgtgagtgctacggagctcgagcggcgacggcggcgagcacgcggcgagcgacgacaacggtcggggtggcgccggctaactacggggagtctactcgagctactaccgaaagctagggggaggagatggagcgaggaggaagaacagagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctggcactcggcggtcgcggccagagcggcgacagggaggatgacgccggcggggggaaaaggggaaaaaggagggggagaaaggggcttgcccttttgccgattcgggaaaaaggaggaggggagcgggggcgacgcggcagagggaggaggggcgctgcctccatcccttggcggcttgcgcgcggagtggcggggccgggcggtgacgacagcgatgacggcgggcggtttggagcggcgcgacgacacgggcgacagacgcgtgaagaggctaacggcggcggcgaccgggcggtcggccactcggcacgcgcgtgcggcttgcaacgggcggcgtccgcgcgggcgtgcgcacgcgaacacggcgcgcgggaagtggcagtgagggagcggagagggaggacttcgctcggcgcgggcggctcacgcgcacgcacgcgggcggagcggaggaggaggagcactcggcgcggctcttcgcgcacgcgcgcgcggcgcgcgggcgaggtggagcggagctgagcgggggggggagcggagcgcgccggggaggggagagggccgggggagagggggagattttttttttttttctttttttattaaataatattcattcttaaaatttggtactctcagtctcctcgcnnnnnnnnnnnnnnnnnnnnnnnnnnnnnnnnnnnnnnnnnnnnnn

SEQ ID NO: 18367 - DNA, 24843 bp, Oryza sativa
  unsure (1)..(24843): unsure at all n locations
gggaaaggagggacttaggtgagacctgggcttttcacatataggcgacaagagtgatctaccaaagaaaagcggaagcgtccacacccagccagtaagaaaaccgggtggcgagttaagtgtggtcagacaatctaaagacttaccatgggagttagagcggccattggggaatcaaacggtggtttttcctcagcgactcgggggaaaagagtcagccaagtgggttaccgccagttgggtcaaataaagccggcacgtcctaatcacgcatcgccgataaatcgagaattttctcttaaaatggttagctttcttatccgacgcaccaatccatggaagagatcccgtgtatagggggagatgggccgggaggaaatcggcccatcgacccccgggggaggcaaaatagacttttgtggaggaatttgatttggaaggattggattcgggattggactcgacgatagatcggggattgagatcttgagatggcacgaacactagacaacaagcaaagaaacaaatttcgcaattagggtttttaagagataattttcccgctaggcgccacgacggaacgggcgctacattccctcctcttccatggaggccgatagctaccgagctagaggactccaacaacacaggtgtttgctagctgcggttgcctccagtcttctcccttcttccttcttccctcctcccctcttcacccctgccctcaatctccaatcaagccagcaaccaagccgattgccaaatccacatcccgttgttcgttgaggttccctcctattccttctcctccggccgacaagagaggagatggaaggagaagcgtgggcatcactggattcaccacctcgaccctcgcgtcgtccacttcctccctcacctctctttcttccatcccccatctgtctgggctccatcgagctcacagctaccaaactgcctactgcttccagccctcctcaccgccgtccgccgcgccacaactggccccttcctcgcgcagcccaccatctccagcgccttcctcgccaccgttcaccatgccctccttgccgccgcatactcccgccttcctcaccattactaggctcccactgcgttgcaaccccttcctcacctcgacccgccacctccaacgtcctccttgctagcgtgcgcagcaccctttctgctgttcccgccatccccgcagcgcctacatcgccgatagagagataaccgaaacaaatgaaaaacaaactcgtaactgaaaaacgatgtgtggtcatgtgaagtggtcttttaaccgaaacaaatgttagcttggtgattataagcataattaggaacaaaagaagggatggaaagctattgcaacagttcgcgaaattctcacgcacccgaacacccgcgagggcactacgcgtcgagtgcccgatctggggtgcaaaaaatcgggcgcccacgtcagctgaccgtcagcatgcatgcatgcaaaactattttaaactattttttctcttaagttatttatccaaatcatgatccgattgcaccattaaattcattgcaattaaatttttaaaataagaccacacatagatatattacgatgacaaaaatttagcttattattgaattgtttttaaatgttgcacactgttacaccaaatatatcggaattgtttcactaagtagatcgaaaatgtttcaatcgtttaaattggatgttgtttcaccttatataaaaacaaagtttcagcaaatagcgaaagaatgtttcaattcactgcaacatttaatctatacatagtgaaacatcacgagtacactaggtgatacatttttggtggaacaaaaaataaaacggattcacttaatagagggttttcataatatgtgtgtgatttgttgtaaaagaatgtttcaattcactgcaacatttgattcatacacattgaaacattgtgagtgcattaggtgaaacatttttggtggaacaaaaaataaaacgaattcccttaatagaggttatgtgggtggattgttgcaatagagtatgtggtggagatacatggcaggtgggggcaggggcacgtggtggggcctaggaggcagcacgcgtcacgtggggagggagcgtctgatttttctccttcccctgagcgaccgacgcgaaggattttggacaagactttacccggaattatactctgttttaaaacagagtaagaaatgagggagacaaaatagacatatttccaactgattgctgatgactcgttgttcggttgggccattctgatcccagaaggatggcaaggcccagaaatacataaaccgtcggcgttgaggcacttgtcccaccgggcctggtttaatttcgatgtaactacacattcgtagtcggtgagactaaggctctgttcgttatgaggagataggggagattgattctcgttttccgcgtgcacgcttttcaaactactaaacggtgcgttttttgcaaaaaaatttctataggaaagttgctttaaaaatcatattaatccatttttgaaatttaaaatagttaatactcaattaatcatgagttaatggctcacctcgttttgcgtatctccccaatctcctcaatccccttctcctcaaacacaccttaatagaagtgagtgatagcggagtacattgttgtgtccagccaatatatatagtgtacatccatttctagcgattatgccgtttgtcactggattctagttgtgtggccttgccgctgtggatggctttatgccgacggtgacgttgaagtgccggaacacggcggcccaccggcggttgttcttgagcctgtgcacggcgatggtgttgggccggaactcgtccatgtcccagttgatgtcgtacatccgcggcttgaggttgtaccggttccgtcccctgccgccggcgttgagccacctgccgacgaggcggtcctcgtgcccgcgcgtgccgctgcgacgcacgatgtcctcgttggcggacacccagcgcgcgacgtcccaggacacgacgtagcccatgccgtgcatgaacggcatcgggtcgtcgccgacggcgtagccccggccgaggtagacgtcctccgcggcttgccgcggagctcgtcggcgagcgccgccacgcggaggtacgtgtcgtcgtcggccttcatgacgtagtcgtaggggcacggcgcgaacaggcgcggcacggaggagaggtacgcgtgcgtcttgccgtcgttcatgttctcggtactgcagccgtcgagcaccaggatgtcgccgtgccgcgccgcctccgccgccaccagcaccgcgtccgcggcgtccgtcacgtcgcacagcacgaaccgcacgtccacctgcgcccccggcgcgggctgcagcgcgtacgccaggcgcaggatgccgcgccgctcgtaccggctcggcgtggtcagcacccccacgaggagtcggaactccggctccctcgcggccgtcgtctcagcacctagaccgccgtcgttgttagtgttgtcgacgacgggacgggagcgcggagcactgaggcagccggagacggagaggacaacaaggctcgacagcgccatggctacgagtccgaggggtaggaggaggcggaggcacagcgagcaaaacgaggtggccggaaagcgcgacgacgtggcctgcttcatggctcccgaatcccaaccggcgaaacgagacgacgagacgaacgaaatggcctggttacggggtgttgcattgcgcagttatccagcttatgaagcagcggaagatgacgggtggacgtcacactcattcattacatgtcaattataacgaaaaaaaataacaagatagatcaacatctaatatatcaattcacaaacatgtgtttttacaagttgtaacaaagataacaaatttaattgcaaatatacctatactaattttgagttttatttattattcttgttacaattcgtaaaggttgaattttaacttgcatctatattgcatattgatgtatcttatcatatttttttatttttttcgtaattatttaaatggcatacaataaacgggagaacatccacccatgtgattaaaagagtttcctggcatgatgatggaggtggattttaaactctcgagagaatacctcctcattaatcgtatgttattcaaataattatgatgtttttttaaaaaaataaaagtttgtattaacacgtgatatatcagttaattaaaattcaacttttaccagcaagaaaaaacattaaactacagctagttaacgtatattcataacgtatattcatagttgaatttgttttttgcattgcaatatgtactagttaaattttaccttgcatgtttatgaagtaatttatcatatattaatttatctttttttattttaaaaataaatcataactatttgagtggcatgcaagttcttaaatgtttataatagttccgtgataatgtccatacaatttgatgataggagaaggctaagtcggacagagctcctctaacgtaaaatcagagagacgtgggtcgctgataggtgggtctcacctttatgggcccacacgtaagtgaccacgtccctctgactttctgactttatgataggagatgcttctagcttccggctcagtcacagtcacacagtaccacgaacgaaagtggtttgactatatactaattgcaaaagcaacaaacaacgatttgttatgatgtatacgtaccacatagtagtactacatctgaaaaaatctgcccaaaaagttatgaagatggagattaagtaaggacatctaaaacaagaaaatcatttgaaaatgataaattaaatttaaattactacaaacctgaaaaaatagatttatttaaatattttagagcaacaactatacataaagtttttttttacgaaatcacggtttaaccgtttgaaaaatatgctaataaaaattgagataaattttgtattttaatatgaaacggattatgaagcttaggacgagatatgcggcccgtgcaactgcaagcgaaaaggaaaaatcgtgaaaaaaataaaaattccaaaagtcgaaaaatacacccactaccggttcgccgtcgtccttaagccttcgcagccactgtcgacgtcgtcctcctcctgtcacggtgaggaggcaccgggagggccacagccgacggatcagggtgggggagggcaccggcctgcggatccaggcgggggagggccgccgccagcggatcggagcaggggagggcaaccaccggcggatccaggcgggagagggccgccgccgtcgcccatgccccccagtgccgccgccgtagtctgtgtcgtggggtggtgcctgctcccagcgcctgctcgtcggccgcaccgcccgttgcccagtgcctcccgctcggtgagagaaagagagagagaggagccgaagagaaagagagggagaggagaaaatgagagaaagatagaggtgaaggaagagagagggggaaatattagagaggagaaagaggagaggataagaggtgaaaattttgaagtggtgaggagggaaaaactgtaataaagagaagataattttgcatgcgaatctttaagagatccgcatgcagatctttaagaggcccgcatgtgaatagacttatttttacatgcgaccccttaagagacccgtctgtaaaaatagaattttacatgcgggtctcttagggagtcgtacgttaaaatggaggtcgatttttgcagacgccgttagttacggttcatctgcaatctaaaggggtcctcgtacagaaagattgttttcctaccagtgttatttaggagtttgagaataaatgcgtgtgcgcggaaaacaagaaaggtgagttgggaaaaaagagggaagaacacagcctacaacaataaatttcccatttgaaagaagaggtagcagagagatagaaacatgaacggagagatagtaatcacaaaataactcaaatcaagaaaaaaaatactcctatatgacaacatatttttttaagtagaactgttacgattcgacgtgagcgcgctgagcaagagaagggtgttgcagtggagtggaatgtccggttggccaagcttgtaacacaattaaacaagcctggcctctgcatgtgcatgtgctcgcttttaatttgcttgatatcgactcgctcgtactagttttacactattcatcctatttcgtcttatttaaaatttttttataattactatttttattattattagatgataaaaacatgaataatattttatgtatgactaatttttttaaaatttttcataaattttttaaataaaatgaaaagttaaacattggacacggattttcacggctacatttattttgggatagaggtagtatacgcttgggatcgatgaacaatcgaacatgttacgtacactggtcacctcaccgcccgttcctacggatcgagaaatgtttaatttgcagctttacgtatacaacaatcaaaagaatacaaatctcacgaaccgaagttgactcggctcaacaaaaaaaattcaattgcggtaaaaactcacgagatcgatatatcgatcaacctaaatcaccgggtagaacggcttgagcgcggcggtgaagttgaagtactggagcgtcctcgcccaccggcggttgtccttgagctggtgcacggcgatggtgtccggtatgaactcgtgcgagcacgggtgcctcccggggaagttgtacatggccggcttcacgtccacccggttcctgcccctgccgccgcgtcggagccacgagtagagcgtccggtcctccggcccgcccgtcctcccctcgatctccgccgccgccgccacgatccactccacgaggtcccacgacagcaggtaccccatgccggacatgtactcgttcgagccgcggacgtagtcgcacggcaccatgcacccgtagtagaggtcgcgccgcggcgctcgcgacagcgactcggcgagctccggcagccggaagaaggtgtcgtcgtcggccttcatgacgaagtcgtaggcggcttcgccgccgccgaagaggcgcggcacgctggagaagtaggcgtgggtcttgccgttgtccatgttctccgggcagtcgagctccaccacgtcgccgtacgccatcgcctccagggacaccaggacgcggtcctccggcgagccgacgcggcagaagacgaaccggacgtccacgcgcgccctcgacgccaccgccggctgctggagggcgtacaccatccggagcaggtgccgccgctcgtaccgcgccgggagggtcagcacgccgatcagcagccggaactccggggccgcctgcacgccaccgccgccgccgccgccttgatgatcgccgcatgcggcggcgccggccagcgaggcctgcagggcgaactcgttggggtagacgaccaagagaagggcggcgaggagtgcgacggggagcaggaggagcgccgcggcggggacgggcggcagcggcagcctctgcggcttcatggcagaatgcgtgcgtacacggtgtgtggctgtggcccaaacgaagttggttttggcagaggcagaaatggtggtttttctggggatttttgcagcaggttcacgcggtgcggagggaacacacgatcgagtacaggctgctgcatatttgcagcggagtagagagcacatacgctgtgaagaagtatagtgcaagcatatactcccttagtctcataatattaaaaccttagactggatggaacgtttcatagtacaacgaatatggacagatgcatgtccagatttgttgtactatgaaacatcacatccaattctagattgtaatattatgggacgaagagagtaacaagtcttcttcgcctttgcgtggaatatagttgtggacttgtggagctgtggtggactggtggtggcagaggaaccttggtagtagtatttggtttctcagaagtccattggccgggccatgcttcgattcctggatggcaggccatatcatttgcatgaaaaagggtccaggttttaacgattcacaagtaatcaaagacggcatgacacgtagctttctagactttttaccgaggaaacctgcacatgctcatcgcctcatccgtagcacattgccatttgccagtgcgcccagcgcagcccagcccagagctccaaaaataccaaaccaaccaggcaaggctgtgccgactgccgaaatccatcacggcgcaaaactcgcaaagctcgcgccgcgcatagtccaaaccgcgaaaatttcgctctcccaccacgaaatccccaaatttccccgcgcggtctccactctacactccccgaaaccaacctcgccgatccgcgcctccctcaatccaacggcccacgctgcactcctcaccactcacgcggatcgctccccatccgacggctccccactccccactcccccacccaaatcctatataacatcgccctcacctatctccccaatacagatcaaccaaaaatcgccaccaaaaatccccaattccatcgtcgtcgatgtcggggcgcggcaagggagggaagggtctcggcaagggcggggcgaagcggcaccggaaggtgctccgcgacaacatccaggggatcacgaagccggcgatccggaggctggcgaggaggggcggggtgaagcgcatctcggggctcatctacgaggagacccgcggggtgctcaagatcttcctcgagaacgtcatccgcgacgccgtcacctacaccgagcacgcccgccgcaagaccgtcaccgccatggacgtcgtctacgccctcaagcgccagggccgcaccctctacggcttcggcggctaggagccttttgcattgtgtttgtcttgttaggaatctgcttgtttcggatgtagccctgtatcctgtaatgaagaaaatgctagcagtaaaacttgtttgaattcacctatgaatctagtgcgaaattctgcaatcacaaattcttcagattaattttgctgggacatgtattgaattacgaacaaactgctaatttgaccggtagtttgagacataaaccaaggaaaatctgaagaactttgaacttgctgtagttcagttctcccattcgagagcgaaggctgactcgaacgacgcacggtcgaacaccgcagggccgaccccggtgtcgccgaccagcagccgcatgagctcgccgacggtgtcgaagtaccagtcgcacgggccgtggctggcgtccttcaccgccacctgcatcatggcacgctgcgcggccaccagcgctggccccagcggcgggaggtcggcgcagacgaacagcttcccctccggaaaccgcgcccccgacgcgaacggtgccgccgccgcaccgacggcgaagaacgcgccgctcagcgagcgcgacaggccgtgaacgcggagccggaggtcctcgtgggacgcgccgagcagggcgcggacggcggacaccgccgccgcgtgagggacccagcggagcgcggacgcggcggccacggcgggggccgggttgtagccgcggaagcgagactggaactcgacgttggagaagaacacccagtgggacgagaaggccgacctgaacagcccggcgtcgccgaccagcagccgcatgacgtcgcggacggcgtcgtagtagcagtcgcacgcggcgtggtccgcttcctccgccgcgacacgcaccatcgtgcgctgcgcgtcccgcagcgccggcccgagcggcggcacgtcggcgcagacgagcaccgccccctcgttccccgcgccagcgaagaagacggcgctgagcgagcgcgagagctggtgcgcgcgaaggcggaggtcgtggtgggaggcgccgagcagggcgcggacggcggagaccgccgcggcgtaagggacccagcggagcccggaggacgccgggccgtggggctcgacgtcgtcgtcgtcgtcgtcgtcatcggtggtggaggtggagtacccatcatcctcctcgctggcggcggcgagttcgctcccccggtccaccccgtgagccaccacaaccatgctggtatcgaacgtaatggcgtggcgtcgtgcggttactcttgtgcgtagagggagctgtgactcctgggctgttgatcactccatggaccatgttccatcccgttgcgacttgcgacccaggggcggagctataacgtggtccgtgtggtccatggaccaccatagaattctggtccatggcccattacctctatgcgctacttaaaaatatagatggcactttgacgctttgttttttcgccaattcaaccaccgcgtcgggcatcgggcgtcggcgcgtcgcttcgtttccatcgcaattgtcgtttccaattttcgagcgcgcaagtcgacgagtcacgacgaccactgtccattgaggcactaacgagtgagttgtgacgtcgccacgtcggcggccggcgactgcgccaccgcgggcagcgaccgcaccagcgcgcagtgccacaggccagcagcaaccagcagggagaaagcaatcagcagcactccattcatcaggaggcacgcaacaccaaagcacagcaaacagcacgttagcaaacagcactatagtaggttctcaacttctcatctgcttctctctttctcctccctaacagtagggtttttttttctttaggtttaaatgttcaatctcatttcaattttaggatatccggtcgattggaattggaatggtaaattcaaattaaaccttacaatcctatataatctatggtagatttgctgaacaagttgagttagaccaccatatcttaaaaacctgggtacgccactgttgcgaccgttggtcccgagacgacgcgcgagcctcgaggcagagagagagtgcaggactctcatctgtcatttccatttcatgtgcagaagtcagcttttacaggtactttctcggtttctccttctggttgggttggcatcgtctgtctcggggtgatacggcaaacttcgccgttttttcatctcgagcatccaaacgtgaccgataactggatgagcaaatgttcgatggttgtgtttagttcacgctaaaagttaaaagtttgattgaaattaaaattgagcaaattgtttagtttcaacttttctgtcacaccaaatgtttggacacatgtatggagtattaaatgtggacgaaaaaaaaccaattgcacagttcgactgtaaattgctagacgaatcttttaagcctaattacactatgatttgacaatgtgatgctacagtaaacatttgctaatgacggattaattaggcttaataaattcgtctcgcagtttacaggcggaacctgtaatttgttttgttattagtctacgtttaatacatgaaatgtgtctccgtatacttaaaaaattttggcacacgaactaaacacagccttggacgttaccaggtttacgattcctagatgatctttcgttttgggctctgacggaatgacagttttcacgaaattcggtggaaagccaaaattccgaacaaaactccggcgattccgaacaaattttataaaccaaaatttaaatacaaatttcttaagtttaccgataagcttgcgaaaaccgataggctttggtgaaattctgagcgaaatcatcaaaatttcaatcgataactagaaaaagaggtaaacagattttttttccttttttaattctttattattttctttcctattgtaaatttcagtaaatacacggaatacatcaattttttcgaaaatttatatcccaataagttctatgaatatcatactatttataagattttatttgatttttttcttttttatcaattcaaatttaaatttggataaaactcatcgaaatctcagacggcttctactttgagccttgtcgaaacctcaaaaattcgcgggattcgaccggttttcgtcggaattgtaatccctggacgttactaatctacgcatcagttgaatggagaatctaataattaataagaagaagaaatgtgcaagtatgagcatgttagaaataacaacagaacaacactgaggtggtgatagaatctcctaaaagataaagattaacaatttcacgtaaaacgaggtggtaataacatgtgattaattgagttttaattattacaaaattaaaaaatggattaataacaactttcatatagaaagttttcgcacgaaatataccgtttagcaattcaaaaagcatgccacgagtacctaaaaatttatctaatttatttttacagaaaagaataggcctgaagtcatacaactaactgaacaaattatggaataaaaaagaaagctggctaggatcaatgtcaaggaaggccctaagcgtcggatgcccgatgctttgggaaaaaatcgggcgctgacgctagcatgacgtcagcgcccgatttacgtgtaaaaactactttaaactgatttttctcttaaattacttatctaaatcatgatccgattgcaccattaaattcgttgcaattaaatcttcaaaacaagaccatacatggatatattccgatgaaaaaaaattttagcttattattgaattttttttaaatgttgcacgatgttccactggatatatcggaattgtttcactaattagataaaaaatgtttcactcgtttaaattgggtgttgtttcaccttatataaaaataatgttttactacctccgtcccaaaatgtaactatttctagcatagcactttgtcccaaaataaagctatttttctacctaccttctcctctcaaccaatcacaaccattctttttcacctactttctctttttaaccaatcacacatcttcttcaatcattctcacctactttcttaatacccgtgccaaccttaaaaatgcttacattttgggacggagaaagtagcaaatagcgaaacaatgttttagttcactgcaacatttgatccatacatagtgaaacattataaatacactaggtgaaacatttttcgttggaacaaaaaataaaacgaattcccttaatagggggtttccaaaatctgtgagttttttttgttgcaatggagtatttcagttcactgcaacattagatttatacatagtgaaacattgtgggtacattaggtgaaacatttttggtggaataaaaaataaaccgaattcccttaatagggggtttccaaaatatgtgatttttttttcaatagagtatatggtgaagatatgtagcaagtagtagggacatatggtggggtcccagtagaagcacatggacacgttgtggaggggggaggaggggagcgcccgattttctccccctcccctgggcgaccgagcggcagcattttcgcaatgtcaacgcacgtagaattaaatcttaacctttttttacattcggacaaaaatcttaacctttttctaattgaagtaaatcttaatttaagccagtaggaattgaaaggatgtcatggttgtaattggtgctgattttctgaattcatttgatcccgaaataggtactgcaggatgatgttaggtgcttgtcagatacggtggttggaatccagccataggtcatgtatggatgctctgatgaagcaacggcaaagtttgccgtatcagcccaaaggccgacgatgcctggttagaaattcatgatgagtgtttggatgactttcataagtgtgataagatttctttttttaaaaatattggtaaatccaatattttttttataaatattggcaaatccaatatttctctttagtgactctaaatagtatagcatgattttatttagattatggcttggattttgatgaccttacctttgacaagtttgacgaagaaaacatgataaaccttggcaattatagattgtgaaccaaacaaccactcattgtttcatgctttattttgttttgccacttaggagtaggctttttatgaaaattcagtatcccatactttattttgtttcccatttaggagtaggccttttctactactccctctcccaaaacataaaagattttgattggatgggacatattctagtgctgtaaatctgaacctctgtattcatgatctgctatactctccatggaaaaaaaaatgatctgctatactcaaatataatcatgatcgagaaaaaaaaatcatgtacagttacataaacacatacgtacagccagtatacaaacgcaaatgaaaactaaggcacacagcacgcgttcaactctgatcaatatctgatcaacaagcgagttcatgcgtacacctcgcaacatttccactcgtgtatagtgacagccgaaactctttcgccatccaagatatatccaacgaaacccccctacctgtcctctcgacttcctccgatccgctacgggtagctagggtcgttcggattcaagtgaagaagtcgtacttgaccggcgtgccggtgggatcgatccatggctttgcgtgcaggaagttgtcgacggtgaacttggtcgcgtccgccttgctgatcaccttcttgtaccccggccacgcgacgcgccccgccgtgtcggcgccgggccccttgttggcgtactcggcgtagtagagcgtcttgagcgcgaactcgccgttccacggcatgtacccggccttgtcgatgatcgccgggatgtcggactccatgatgacggtgcgggagaactcgcgccacggccggccgaggtagttgcggatggggggaagcttggcgtcggtgagcgccggctcggcgttgaactcgcacttctggagcacgaaccccgtggcctcgcggccgtcggcgcggccctgcgccgtggcgatgttctgctggttgtccatggggcggcggagcgtgaggacgcagttctggaacacggcggcggcgtcgccgaagacgaagtcgatggtgcccgtgatgacgcagttgcggtagaactgcgccttggagtgcgcgtacagcgtgtcctggaacccgtccatccagcagttgaggaacaccgacttgtccgactgcaccagcagcgccaccgcctggtgcttcgccgcccccgccgtgttctggaaccccatcccgatcgccatgaacccgtccccttgcgccgctgcaaaaatcgccatcgatcacattgcgcgtcaatggcggaagctctgatattggtttataccgaaggttgctgtcttgaaggtggtgaggccgtcggcgaagttcttgctgccggtgacgatggacttcctggagccgtcgccgtacatggtgacactcgccatcttcttggtgatggtcacgtactcggcgtacacgccctccttcacgtagatcacgtaccttccactgtaggtcttgggcatggcggcgagagcttcgttgatggtcttgaacttgccgctgccgtccttggcgacgatgacgttcggcgtgaggttgttcttgaacccgccgcccttgagcaccctccggtcgccgtcgggcacccactccgggatgccgtcctcggcgagggccaggtgggggtccgctgctcctcctccgttgtcttcttccccggcgagcagccggcgttgggagcccttgagggcggagaggaacgaggaggccttctcgatgagcgccagggcgttgctggtgaactccctgccgttgttgaacgactccttgaccttgtccctgaactcgccgtcggggaagccgtcgatgcaggtctccatgttggcgatcaccgcgctcagccagacgcggagctggaagccctgtttgaggccgtccttgccgtcgatgcccttgagcgtgcagttgaggtcgtccttggcgtcgtcgaagagctccttgcagtcggcgacggcggccttcacgcgcgggtcgttgctcatgatcaggtcggcgcggtcgaacgcctggtcgaccgcgccgccgatcacgttcacggcggtgcggatgatgtccttgggcgacgacacgctggcgttcgccgccttgccgatgctcgtggcgcacgagtccgcgaagtccgtctgcgcgcacatcatcttgatgctcttcgacacggcgcgcaggtccgctttgccgccgccgccgccgccgtcttcgtcgtctccacctccgccgcctttcgatttccccttcgacgagcccttggagccgccttcgtcctcctcggatttcttcccgctgtacgtgatggcggcggcgcccatgacgatgaggataatgatgatggacaccgtgccgagggcgatcatgatgcgcctgcgctgctgccgcgccttctcggcgcggcgccgctcggtgagcgggccgaagtcgccgaacgccgacgacatggccggaatctatccctagctcttctcttcttcccccactcctctttctcctcctccttattgactgcttcttctttctctctcacactctctgcctgacatcaccattggcagagaggacggaggaggaagaaggccggaggcattggagaacgagggttcattcatgtggccgcgctgacgcttcccgggaaaaaagaagggcccggagacgattgtggaagctatgtttagaagctttggcatgcaacaatggccgccattctcggacgctcccgccattttcttggaggggtcaatgtactctcttctctgcgagaaagctccatgaaaattttggaatacaaggattcttctgcgtcaactagacattcaaccagaaagtatagaagaattcttctacgtcgactagagattcaactagaaaagaaaatagagacggcggaggcggcgctgcgtgccgccagaatcagggaagagcggtaggactcaaactacatattttacaaacgaaaaatatactgcctccgttttttttttatagatgacgttattgactttttctcacatgtttgaccattcgtcttattcaaaatttttatgcaaatgtataagatataaatcacatttaaaatactataagtgataaaacaactcataacaaaataaattataattacgtaaattttttgaataagacaaatagtcaaatatgtgagaaaaagttaacggcgtcatctattaaaaaatgaacacagtatgtgtttttagcgatctaaaagcaaatactggaaaacaaacaacgacaaaaaactttaaaattaactctaaatctaaaattaaaattttaaaactttgctcgtataagtataagcgaaaagatgagtagtctcgatccgatctgacgatcgaagtgacccaaatgggctactttcataggcccatctgggtgacttgggccgttgaggaagcccatcgcgccgtccccgacacggaccaggcggcccagttgataagccgaccgaactgagccgccgggctgcggcgtccccatcgtcggcgtccctttcttcctcatcaacggcgagcttccaattatgcaaccagggtataactataaattctatcgtttctcgggagagaggaaagagcaatgatttgtcgagctgtccctgcctcctcctgtccatcactctactgttagaacgagatgaaacctctacctcgagtggtccagcagcagctgcccctgtggaattggttctccggtccgctttcacttccaacagggagcacagcatcagtgatgcctaccgcctcatcaatctgccggggggaagattaggcggagaacgcgtcaagcatccaaatccatgtcagtatcagtgtagcaagatcgagcggcagaggcctctggttggaatgtaacgggtcgaatctactccctccatcccaaaataagtgcagttttgcacattcatgttcaacgtttgaccgtttgtcttatttaaaaattttttatgattaatatttttattgctattagatgataaaacgtgaatattactttatgtgtgactaaatattttcaaaatttttacaaatttttcaaataagacggacgatcaaacgttgggcacgaatatccacagctgcacttattttgggacggaggtagtactactgatggattcttgcacgagtgagaatctttgatcttgatgaggagcttcttgatcaatgatcatcctctggaattttcagatttgcagttgaaagatgcgcggtttttctttttttttggaggagtttcttttgcgtggcctatagattcgtgcctgcttcaagtctgcatcgtccagttgtaagtacaatgggggtgttgcatcttttcgtgtttggccaaaagagaggaaaagggtaaaggagattcgtgcctactaataacttctgcagttcagcgattctctagaggtgacaagtcacaactcaaaagtgagcggcaacttggccaattctcgcagcagaatagcagtgtaggtgtagcacagtagcacatgctggttttactgaactgaacaatgagcaagaaaaacgtagaaaaaccaaatcattttaagatttaagtggatgatcagcttaaattactgcaacatctgggatccagaagagaataggagatgataaagttcctgtcaggaagtatatcatgcacattaagatttacgatcatgaataaaaacgttgagcacaaacactggatcctaccaccgtattggtgcgtcggaaagcaaagtaaaccacttaaagagaaaattctagatttatgggtgatgtgtgattaggactgcaggattatcttgatccaactggtgataacgcactcgtctgacttttttcccgggatttgctgaggaaaaaccacggttagattccacaattgccgcactaactccattgttcatctctagttttactgaccacactaactctgtcaccgtgtctgttccatgatcggttttagcaagctcatgctttccttgaaagaacaaacaagagcagagaagagaaaagcaaggcatcaactacagctttaattctcactcccacaaaataccaatcattcatcagcttagctagctagctagcacaatcaacattgctgtcaaattcccagcagcatcagttgcatcatcatctttgttaaaaaaaaattgtatcattatcatcttttttttaaaaaataatgaaattgatttacatcccggtctctctaccataagacacataaccaacgagttttgatacctaaaaatcaaaccatataaggtgaagggaaaaaccctcaactccctctaaacaagttcaattgaaaaaacattccaaaatcaaataaattctagcatgtcattcggtatatgctaagtcagccaaagtggaataaaagaaacttggctaccaattccaataaccgaaaattgaccatttttaccatcatttggccccaatttcagatattaagaagataattatatacaatactaattacttaattagtgaccagtgatcacttgtgtgtgtggacagagtggctttaaatacccatcactcctctccccctcacacaccctccctctcaccattgcaaagccactagagatcgagaagaagaagaggaggaggcgagctccgtttggtgcgaggcgccgccgcgcgctgcgggcctctcctcctccccgcgcgctccactccaccatgcttccgagccggcagagaagcatcttccatctcggggaggagggtggcggcgccgccgacgccgagcacctcggcgctgaccacggcgacggccatggcgatcacggtatcatcagtatccaccagcagcgccttcgtgtcgtcgggctgcagatcgtcctcgcccagacgaggcaccaccaccgccagcagcacggccatgtcgtcctcaagcagatgcagatggtgtccccgccgccggcggcgcgtcaccggcggcggcggcgtccttgcggtgacttcttgagcgcgtgctccctgtgcaggctggagctcggccccgacaaggacgtgtacatgtacaggtacgtacgtacggcaacggcacgccgacgacatggccggcggcgggccggcggctagctggagctcgatcgatcgccgcctgaattttggggtggtttgcttggatgcaggggtgaacaggggttctgcagcgaggagtgcaggtggcagcagatcatgacggacgaggcgagggagcgggacgccatggccaagaaggagcggctaggcctgcatcatcggacgccgcggccgccgccggcggcgatccgcggcggctcgccgaggagactactcgccgtagcctagcacgagcgaagtacagtatgctatacttgatgagaccgtgacccatgcttggatgatatatgatcaaaagaaaattttctactgtactctctgtaaaatatggagaaatcgatgtaattaagaaaaacttgataaggaggaaggagagagagagagagagagagccaggttttgagtaatttgaggcaaatttgaggaaacgtatacgcataactgcatgcagtttcatatttcaaatgaacacgaaatgtttggtgggggaaagaagctttccaggtctcatgggtacaagtgtgcaacttaactgtaacctgctcctgcttatgtgcaaaaaacctggtaaattctggataaattagtttcctgtgcgtgtaaatttcatctcgattatttttagaggatgcgaatgattctcagtcgagtagaactcgtggaatgattctgaacacaagtaaaaaagctctgatgaatcctggggcatctgccatcttttgctttcgagatgccgaggtgccagaaatttgatgccaaagacgaagtggagggaacgaaaggatggtggccgtggcatcaagcaccttgatcgatggggagacagtgagacaccaatcgaatcaaagtggaatcttctcttgctagaaaacgaccaacaaaaattggaagcagctagaagcctataaacattggtcaaggaagagggagcagcctaagagaggcagacagcgattgctacattttagtgccacgaaaatctattaggacagttcgaaaagaagccatcacgttcgtggtgaagactaaaaacacttagatcctgtttagataggactaaaacttttaaatccctatcacatcggatgtttggacactaattataaatattaaacgtagactattaataaaacccatccataatcttggactaattcgcgagacgaatctattgagcctaattaattcatgattagcctatgtagtgctacagtaaacattctctaattatggattaattaggcttaaaaaatttgtctcgcaaattagctttcatttatgtaattaattttgtaagtagtctatatttaatactctaaattagtgtttaaatacagatactaaagttaagtctctggatccaaacaccaccttatattaatcagagaaaaaattaagtaaaaaataatttagaaataattgaaattcagaaaaaaagaaatattgaaagaacatcacataaaaaacccaataaaagattaattaaactcagaataaagaataaaataaattctgaaattagaaaaagaaaaaaatgagatttaaataataatataatttataaataactaaaattcggaattaaaaataagaaataatagaagagagtccatatgtataatccaatatgagttgaactaaaatttttaataaataaataaattttggaattacaaaaataaaaataagattcataataatataatttagaaataactgaatttcagaattaaaaataataaataacagaaaaagagtccacatagaatccaacacaagattaattaaaattcaacataaaaaatatatcattacaatttgacataaattaaagatatagctctacttaccctttaaatttcatttatataaaaaaattatacaaaattaccccctccttccttctccctctctcctctcttacccaagattcagttgaaaccacggtcgccggcgacggagctagcagcggcgtggttaggttaatccattgacaggggcnnnnnnnnnnnnnnnnnnnnnnacagattagaaagagggagaaggaagaagggagtgaagaaaggaggaggccggggtatagtttagtacaaattttttgataaatgcattgaagaggtataagtatggcatatctttaatttctatcaaattgtaacggcatatgtctttaaataaacgaataataatgctattttttccaaatcaaagaagtcctaatgggtatgatatagttattttttttaatgtgaggactggtgagcccttatattttctttttttttataggtgaagccattaacttttggacacataatttgaccattcgtcttattttagaaactttgtgcaaatgaataagatataaatcatgtttaaagtttttttagtgataaaataactcacaacaaaataaactgtaattacatactctctcgtcccataaaaaaccaacctagtactatatgtgacacatactagtacaatgaatctggacatatgtatgtctagattcgttatactagaatatatcacatccggttctaaattcacttttctgaaacggatgggactcaaaagttatatcatagtcatcatctattaaaatacagatgtagcatgcatccagttgctttctcaaatttcaggcgccagcccgatcatatcgatgagaaagcagagaacaccatgcaccgccgaacattgacgccgcgcgccgaaccaccgcggcgcgctccgtctccgtctgccacacgtacaacgcggcacgacgtacgcgcgcccacacacaccccgcgatcgattgacacgggtccgacgccccagtgtgtctgtgttccccccctacccgggacgtgtcacctgcatacgctgcctagcgaccgcccaagaagctctcgcgtcgtcgcccatttagcagcgcacgcgcacgcacacgaacgcgccgtgcagcatcagcaggcagcagcagcagcttcctcctcctcctcctcatcttcaccgacgacaccgcacgctccgcttgctcgtctcgccggcgccatgtcgtacaaccattcgccgtccatcaccgcagagaccataaaccagaaggtacgtggctacgtgcgtcgttgcgttcctccgtcgatctgaacctcagctcgcgatcgatcgatcgatcgatggctagctcgatcgagttttattaactgatcaaatatgtgcgcattctcattcgtcttgaaggtcaggatcttcacctacgagccatgtggggagattgtccgccacgcacgggtaactataaatctcatcaacctacactgagggcaaagccaatgtttgaagcttacaattaccttgagatgagacccataaatagttaatttttgttgtagtatgttatacaatacttatgatcataagataagggcaatgtatacgggttaagtagtccttatggtacggttaggccctgtcacaatagacttcagttatctctatttctatcgctacaaacatgggatgggaatcatgggacccactaacaaataaaaatgtattccctccgtttcaaaatgtttgacaccgttgactttttagcacatctttgaccgttcgtcttattaaaaaaattgtgaaatatgtaaaactatatgtgtacatgaaagtatatttaacaatgaatcaaatgatatgaaaagaatacataattacttacattttttgaataagacgaatggtcgaacacgtactgaaaagtcaacggtattaaacattttaaaacggagggagtagtaagtaacatcaaacacaaaagatgaagaggggagcaaaggagagagatattcttatttcttatgggtagtcgttagttactccatggatagctcatgctattgactcccataaagactccttccacaatatatacattggtacattgaaacatgagctcactacataccctatcttattataagttgatgtccactatctcctaaaattcaacatgtaagtgtaccatatcatcaccactagtaaaatataacctttcagtgatggtgggagtatagatggccaaaaggcctgaggcccgacgggccgccccacggcacaacattttggcccgtgcctccccccccccccccccaccggcacgttgggcaggcctaggccaggcccgacacacaaagaatagggagtaaaaatagacatattatatgccacggttcaagaatagggacgcaaaatatagttattttagctatatatatgtcaacctaaagaggagggagaaaaaatagacttattttatgtcacagcccaaagaggagggaagaaaaatagattcatttaaaaaaaggcatgatgtgccacccgtgccttcgggccggcacggcatggcccgactactggtgggccgtgcctgggccggaggtgcagcccatgagccggcatggcccggcacaaagtgctgaccgggccgtgccggcccgatggccggtgggtcatgcctagccatgcctgggccgggccaggctgggcgggccttatggctatctataggtgggagagagcaaaggagttgtcttttcgttaagtagcgctagattaaatttatctcagattccaattagccatcctccaaccccatnnnnnnnnnnnnnnnnnnnnnnnnnnnnnnnnnnnntatgaagagtgtcggtctatgaagacgatcacaaannnangctcca

SEQ ID NO: 18368 - DNA, 785 bp, Oryza sativa
  unsure (1)..(785): unsure at all n locations
gtggtanatttgttgctgtgattcgagttcgactgcagtggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgttcctggatgcgcagatgtgggtacttctttgactccacggtcagcaggaagttgccacgcgacatcagtcgaagatctgtattggaattggcgacgacagcttcaagacattgatcttcgcagaagttttgcgcacacgtg

SEQ ID NO: 18369 - DNA, 766 bp, Oryza sativa
  unsure (1)..(766): unsure at all n locations
gagcgttattctataaataggggatccaaataaaagggtggaaaatatcccagggtgttagataaaacacaatagttctcttgttaattaaaatgtagaagctggtaaatggaattacaatttcccgcaggatttggcggaaattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtaccatcgacgtcatcataaacaanccgcca

SEQ ID NO: 18370 - DNA, 767 bp, Oryza sativa
  unsure (1)..(767): unsure at all n locations
cggagatactgttcgcagtagttcatcaggctcgtcgaaggggaaatcgaaaggcggcggaggtggagacgacgaagacggcggcggcggcggcggcaaagcggacctgcgcgccgtgtcgaagagcatcaagatgatgtgcgcgcagacggacttcgcggactcttgcgccacgagcatcggcaaggcggcgaacgccagcgtgtcgtcgcccaaggacattatccgcaccgccgtggacgtgatcggcggcgctgatntttttnnttttttttcttnntttttggtntttttnttntnnttcccncttgtncttntnccttttttttccnctcccnctattcttctctttctttcccccccccctttttcttttgtttttcctctccctttcatcttttcnctgtgtgctcctcttcctttctctcttcgtcctttttttactgggttttcncccggccgttgaattccattagccggtatcccgccgacactagccaggcagtcgtttcaattattacagtcccaacacaacaaccgggcggatagattgatatgcgttccaatgatccccaaggggggccttttatggatctggaatcctggggcattgttcatatatcgacaagggaaaaaatggcccaaagggagggggagatgtttaaaatagcccctattgtgtgagaggcgcctccatgccctgcatgtctgatgatgcacactgatactttgaaacaaagcaacttgttacgctagtgttattgctt

SEQ ID NO: 18371 - DNA, 742 bp, Oryza sativa
  unsure (1)..(742): unsure at all n locations
ntcgggtttcgtaagaggtctgtatgtgaaattggatttttttttcatgtgggtcataactcatanccaaatagcatgcaaatctttttgcatgtgaacgctcttttggtccgcttgtataaaatagggagtgtgtccacaaaaatcggtttttagtagtgatacgtggacgacagtgatccacttaattggggagacgaacgaatgaaaacggtgggtggaagcagaatttattttctaaaaaagactggaaaatggcccgtgcattgcaacggggaagaaaaaaatatcaaatcatgtgtatgtatatgttcagctttgggaggacaggtgaggtggttggtgctctcagtggctttgctcctgccctgccgtcgtgcaaacaggctgttgacggtcgtttgcgatcagtttcgaccatcaatattaccaaaatagaggagaactagttgattacaatagagtattaaattcaaaacatgtgacatgcaatgttaatgtaatagcttcccttgcccatgcagtagacccttttgcaaaacgttagctttcaataacttcgacattgcactattggtgttagcattatccaaagtgatgaaaacaatttatcttcacaatacaatcttatatggtctctaggattgtattgaatataacaacatccatgtgcaatgtttttaagtgtgagaaccttaanattctttgggtggcgggtacgagtcgcagtntcaaccacgcg

SEQ ID NO: 18372 - DNA, 718 bp, Oryza sativa
  unsure (1)..(718): unsure at all n locations
ggtgattgaaatgtatgcagctgccttaggtcgactctagaggatccccgtggcgcacacgtggcaatccagtcagcgttttttaataaaaaattgtggggaggcgggtatatatagctaggatagatcaggccatgcgagcaaaggttagatactcagaagcgttagcttgccaccaatttaggatgtccgtttcaaaaaaaaaaattaggatgtcaaaacatcacttcgagggcttatacatatatccatcatactcagaacatatttcagccgtcatctgaatgtcatggttaagatgttgatcccaatcagccaaccggtcacttgtagatactccaatatcaacatcagcactgcctgttagatccgtagtgaagttgatattagcactcactgaaagcctctcgaaaagcattcttgacattgacaatcatagactcggtatcattaccaaatgcaggcctgaaacggaactcgagaacttaagcttaaatatagggtccacgataacaggtagagatagtgccaaccaagaaatcttcaaatacttctcaaatttcttcttcctggacttgatcatcttagatatttcaattgtcacttgagaagcttngtaacggcntgtaaatataccaaatttacgccggcgtcaatccagcataaatctaaaatataaaacatgccatatagtggctggggttatttctaacaaatt

SEQ ID NO: 18373 - DNA, 1094 bp, Oryza sativa
  unsure (1)..(1094): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattaaacttgtcatttacatccccaaactgtgatgtaagcaatccattgagtgtccaagcaacagggcacatccaatagtaccacctccaccatactggaattctctgtagtaaacggagccatattagaaaaattagtggatgtgagataatttagccacgaacaatgtacaattagatacttgagaaaagctggtatacgtacaatccgtggtattagaaatcctgagaaaaggttccatatgttatagaatgccgtggaaacaacagcagacatggcattgtttggagtcaaacccgccatcatcatgccataaaatgtgaagtatgatagtgtgaagaacatgaagaagaggtaccaaagaaatttggcacatgtccactcataccctaccatggcatacactagcacccaatatattatggtctgaagaaaaatgtatggaaattcaattgcaacctgcaatgaaactagatgtcaagaaggctttttgtttcaccattcctttccacttactgagagccttggttttgtataaaaaaataatagtatgttaaaacattttatcaagactcgcatgcatatatttacaaaatgattatgatgccaacaaactttacctgtcccaaggcgtccgacaaagcagagtacatgtgtgatgctctttccctgtaaaagatcgtgcgcctcaccaaagatagctggctgaacagaactagagttctgcacccccattgccatannnnnnnnnnnnnnnnnnnnnnnnnnnnnnnnnnnnnnnnnnnnnnnnnnnatnccatctc

SEQ ID NO: 18374 - DNA, 822 bp, Oryza sativa
  unsure (1)..(822): unsure at all n locations
catcagcttcgtacatgatgaatgcgggcagcttcaccatcctcttcttacacaaggcgaccagcccagcggtaatcacttccagtagaagcgctagggaggatagtggtaggtcgttgcgccgcagccccaaggtcaatctgttctccgagctgagctcgtcgccgtgtacctcatggcaatatctggcgctccagacaagggttgactctatcggttgacgcttttgtatagggggtcaccgaaatcccgaaattttcggaaatttcgatatgatatttccgaaattttaagcaaaatttagttgaatttgaacaaatattacccaaattcatgaaaaaatgaaaaatttcggtcgaaataatatcgtatcgggggtgaccgaaatgaccaaaattttcgaaatttcaaaaatttcagtccgaaatttccaaccctgctccggtccttggccggatctggacgacgggatggttaaggcgctaggggcaggggatgaggaagggagacccagatgggaaaggtggagtaggctccaaaaggtggtggaggagcgactttggtccgccacctttgcatatgagaggtttctcgcggcctatgtgcaactccaatggccgccgcctctattgtacgaaaggaaagaggaggtaggatagttcgtcgggggcaccacccccctgcatcggcccacctctcgggaggtagccgccgctcgggaggtagcagcataagccagacgctcgtggccactctagggttgccagttttgattcaataggtcnnncngtggtttccaccagagcatcttacgttccacat

SEQ ID NO: 18375 - DNA, 17602 bp, Oryza sativa
  unsure (1)..(17602): unsure at all n locations
tgttctcgtcgcacacggtggtatactggccaatgtatatgctagggcgcttgtggcctgtgttggtatttcttagcgatattactaggaataaaatttcaagcaatgacgtagaaatactcctgatatattatagttacagagttcatccgcaagcacactaatatacctttgtaacattttacccgagagtattccagcggtattgtatttatttaatcccgtcggaagatcatagtagagagaaccagactaataatttatatgttacttataataattatagtctaagtaggggttacgataaattaaatgatagagtgatatacaagtagagaaatactcattctcatactaaaatatctaagctaagtggaaagaaaatagaaggagaatcttttcctatacttctagtatacatagtatacgtacattctagttatctgattaactagtttaataccctctatccgatgccctcctggtacatcgagaagccatccctgactgtcgagttccttacgacagcctatcattaccatacaaccggggctaaatacggaggactaccatcctcagtaaattaacttaggactatatacacgcgcggaggaatatccgtactgaggtgtcactatcagtggcccacctctcatccgcagcatataaccccaaataatgatatcccgtaatctagacaccatgcctaaactaccagatactactctaatatcatcgtcatatcatagagtaattgcataagcaaacattgcccgtaccgatgcatctcccagataagctagcagtataatcagtataacatgaacataatgtaaagctggcattcatatactcggaaagtattcaataccataaatgtataaagaagagtattctaataaatgtacaaagcttacaaaagaggaaaatagagctactagagccatacctgaactcttccgaaggctaccggacttcgatttctactctatttctactccactagcttaagaacactaaactaaacttgacagaatatgagagagctttgcttgaggtgtgtgagtgaagtgagaagaggacctccttaaataggctgccaatgacggttgtggcatttggaatggtcggaattgccctccaaccgtcattggggagtgatccacaccgtccagaagaaatcctgcatccaacggtgctaggggggttcggccgaactaggggccggcccaaccagcccaggttttggctggtggcatcctctgttgcttctcttcgcagacttgttaattttggctcaattcatcttgtcaattatgagttttttgcctattcgtgcataagtctgattctcgacatcatccgattgatttatcgtctgatttgatgtcgattctactccactttatggttattccctgcaaaaggttagtgaaccaactactagtggaatattattattctaacgtgaatatgcattgcaagcataactagttctcctctattttggtaatattgatggtcgaaactgatcgctaatgaccgtcaacaaaaccccctaagcttgaacctttggttgtcccgtgtaaaggacgaaaggaaacaaagacttagttgttgatcaagagttgctactatgctgtatatctcaaaggtacaggtgcaagatatatgtactctatctcaaattaaataatctttggcacggtggcttacccttatccctgattcccacgagatattgcttctccttgccttgaacaattgaaaaacagaacaacaattagagcatgaatcacccaatctttattcaacttttattccagaagttttcaaatgattttgtaaaagaaaagccaagttcctcaaatgattcactcattctctctaagtgtatcaatatgaattcctcaccatttttgcctttttgattcctactctaaggtttgatatgtggagctcggtagggattaaacatacttgcattcatatttattactaagtaaaaaactcagactaaaatagataactaaacatactcaagataaagatcgtgcaaagtgtgtgatatatggtggaaatgtaatatgaagaaaaataaagaaaatgcttctcttttgtgcttacttccttctcccaaaaatccttcttttattaataaggagagggcacagctatattctctctttttttttctttctttcaatatcatgctcatgcttgagagagcataactttatttttctttcataaccatgcctttccctcccttcttctttctttttttttcagaaaggattttctttttaaggagaagaaagcacataaaagcatggagaatttattttggtggtagtatacaaatggaatggaatggataattgctaactctcagtgtaggagtttagcatttgcatatatgtgggtgtatgatcttgatcatagagcatgagaagtatctacacaagtcacaagaatttgataaagttcgatggaatagcaagtaaccaaaatttatatggtttaatcaatgaagcatatttttggctctagtaggaatttatatcaaatgaggaactttcaaatttatcatttcgaaaaacaaagcatccggaattcaagtcaaactaggactaggatcatagcaactcttatttactatcacatatctcacaacaacttagactcagattagcaagtgcagctcatttacctcaggttcctagataattgttggctacttatatttaatttttgagagagcacttacctatgaacccatatatgagagatataaaacaaagcaactattcatcatttcaacaaagagaactagtttgtcttacctagcatgacaaaaccttacctatctttttggtattttctattttgcaagtttttatgttgttttcaggtttataggatgcaattagaaagcaaacatgcaattggaaagggaaatattcaatatgatacaagttacctcagtggggggagagatgtttccccacaagcttggctttcgctcagggtccttggtaaggattgaacccctgaaagcggaagtatgtttgaaggtcatcgggcttttgctgcatcaggttgttgatgttggtgaactgagcatcagtagtttgttgccattcttgcgcttgtgctatgtgttcctcgaggttgtattggacctctcccatatgcatatcaagggtattcattctccgggtgatttcacccaagtcccaacgagaggaacttgagcgccattcacctggagatagaggcataccacttgatctgggggttgattgctcatgtccccccactgtatgtcatgaggcacatgccgtaggtcctcattggcacttgcccattttgagactccgatgctgtggcgtggagcttggctccatccggttacatccccagtcagctcccaacctgcctcatacgtttgcacgggtgttgaggatgatgaaccttctcgttcattccttgccatgttgcatatctccctgtatgttcgacctacacaagattcttctatggtctgcaagggaatggttagttcatggcagttgtagaaatgataccccacattaggcaacgggaattcatttgtacaatcgggaaaaaagtaagtcaaagatccatctactccatgtttaagaatatgcctttgcactagataattctcatcaatacagggacgagcggctgagatataagcaatctggtcattgacgtcccctagtcccttggctatccgagtaatcaaagaactgcactcaacaggagcagaaaatcttatactttctaaccattgccttatcatacatttcacagtagcaactttgatcttcctaaccatggcaaacatgataattaattcatccccctaatgggtctaagatcacttctaggaaacaaagtcatagcaatccatttgtgcataagcctaagtgtaggattatgaatatcattcgtcctaggtttcttgcaaattggagaaccataaatatcttcccaaaacctatttttctcaaacgcagaaattcttttctgaagatcgattttacaggaatcgtgaaaatcaagaagtatacttaatccttccatgaaagtgtgtattccttatggaaaaagcgaaaggaaattctatcttctatttctttcaaagtgcacatgaatcgcaaagtaagcgaacaataaccaggctcatctaccacagcaaatctctgccaaccaacaactttccagatagcacgaaagttagtatccatacctatcttttccaatagctccagagagtattctcgcgtgtgagtatactcccggtctcttggcatgtagtaggcttgtctttcctgatcgtcgacaaggtcgaagtcggcatcgctcaagagacgttgcagaatgtcggcatcctccatcgagacatcggttgatgaacgagcactagactcatcatgatgacttgatgaagggctggatcccttgcacagacgaggcaatcgcttcattctgcataatgaagcaagaacagactaactcggcgggggttagtatagcaagaatttcacccgccggttagttttcaccaaagcaacttttatgtatgcgactaagtatttgaatttgagggaaactatcaaagcttgaatgaatttacgagcaaagtttgaagagggaatgaaaatgaattggaatggggtgcattcccctctcacagctggccggcttatatagggcagccacaacggtcaaaaatgacatgtgggccccttagccgttaccctgtcaaaattggtaggtagccgttgcctggctggttcggccgaacctctggtgggcccaaccggccccacttttggccattggaatccaacggttagtggggtcgtggcatagtgaatttttgttgaaaattttattttggtttgctctgaaaaattcatttgaaagaatttcttcaaaattcaaaatcctaaatgcaagttttgaaattcaaacatgtgttgatgcaaaaattcaaattgttgaaaataaatatgcgaattcataccaatttacctgttggcgaaggtcgcgtcattttgggtccgacgtgcaagaccgtacctcctttcagtttagttcacggattttccacccgtctccggaggggatggagcgggtgtctttggcttttccttccacaccttctttggttttggtgcagaagacggcttcttttgagctggctgctcttgctttttggccggtgtactgggttttaccggcgtcttctaataacggttcctgggaaacgctgtttcattttccagcaaattctgcatgaacttcaccaggctgtccgtctcgggtggctccacttcgacctcttggatgttttgcaggtttggcccatacttgattctgacactcaaacttttcttccttcccgttaatatggaaacggatactccccgttcccacgtcaatgttggctcctacggtgctaaggaacggatgccccaagatgtcgcgtccaggtagtcacgggacatgggagtgagtccattatagatgttttacaagataagccagtcgtccatcccatgatgaggacaggcggccacatacttctgaagtcgttcccacgcctcaggaatggactcatcccccgtctgctggaaacacgatattctcccacgaagggcgctggttttgcccatcgggaataacttcgataggaatgccgtagaacatttatcccaggtgtagatcattgcacggttggcatagaaccacagcttcgctttcccaagaagggaaaacggaaacagccacagcctgacggcgtttggactgacacccttcatggtgtatgtgctgcaaatctccaggaactgttgtaagtgagcattggcatcctcattaggtttgtcgcagaacaggctagcctgcgccatcgtgatgaggctggacttcagatcgaaatccacttctcccaggttgatctgcggcccaatggccacgttgtcagctgagggagcaacaaattcatggagggtcttgtgactcttgtcagccatattctggaaggtcggtggcgctggtatggctggtttctttgtcgggagagttttctgcggagcgacgactcgcggcttgacgctccggaaaaaaagcttctggattttctttaaagttttccggcaagttgaaaccagtcatgcaataccgtgtttccacaacaatagtgaaaacaaccaaggttagcctgcaaaggatagtgattatgtagaggtaaatataaagtattagttctggtaatctctattataaatcttccccagcaacggcgccagaaatgattgttggtatttcttagcgacattactaggaatataattcccagcaatggcgcagaaatactcctggtatattatggttacagagttcatccgcaagcacacggatataccattgtagcatttcaccagatagtattgcaagggtatcgtatttatttaatcccgtgggaagatcatagtgagagaaccggactaataatttagatgttacttgtaataataatagtctaagcaggagttaagataaatcaaagggtagagtgacacacaagcggggaactactcattctcatactaaaatatctaagctaagtggaaagaaaatagaaagagaatcgattcttatacttctagtatgcatagtgtacacacattctagttatataattaagtaactaataccctctatccgatgccctcttgttacttcgagaagccacccctgactgccgagttccttacgacagcccgtcgtgaccatacaaccggggctaaatacggaggagtatcgtccccaagaatttaacttaggactatatacatgcgcggaggaatacccgtactgagctttcaccatcagtggcccacctctcatccgcagcatataaccccaaataatgatatcccgtaatctagacaccacgcctaagctaccagatactactctaatatcatcgtcatgacatagagtaattgcataagcaaactttatacccgtaccaatgcatctcccagataagctagcagtataatcagtataacatgaacaaatgtaaagttggcattcatatactcagaaagtatttcaataccataaatgtataaggacgagtatattctaataaaagtacaaagtttacaaaagaggaaaggagtgttactagagccatacccgaactcttccgaaggcatccggactccgatttctactctattcctactccactagcttaagaacactaagctaaacttgagagaatatgagagagctttgcttgaggtgtgtgaatgaattaagaagaggaggtccttaaataggctgccaatgacggttgtggcagttggaatggtcgatattgccctccaaccatcattggggagtgatccacgccgtctagaagaaaccctgcatccaacgttgccaagggggttcggccgaaccaggggccggcccaaccagcccggtttttggctagcagcctcctctgttgcttctcttcgcagacttgtgaattttgacccaattcatcatgtcaattttgagttcttggcccattcatgcataagtctgattctcgacatcgtccgattgatttatcgactgattggatgttgattctcctccactttatggttattctctgcaaaaggttagtgaaccaaatactagtggaatattattattctaacgtgaatatgcattgcaagcataactagttctcctctattttggtaatattgatggtcgaaactgatcgcaaacgaccgtcaacagcctgtttgcacgacggcagggcaggagcaaagccactgagagcaccaaccacctcacctgtcctcccaaagctgaacatatacatacacatgatttgatatttttttcttccccgttgcaatgcacgggccattttccagtcttttttagaaaataaattctgcttccacccaccgttttcattcgttcgtctccccaattaagtggatcactgtcgtccacgtatcactactaaaaaccgatttttgtggacacactccctattttatacaagcggaccaaaagagcgtccacatgcaaaaagatttgcatgctatttggttatgagttatgacccacatgaaaaaaaaatcaaatttcacatacagacctcttacgaaacccgcatggagaaagaactttctgggcctcctcgttttcccttttctttttaaccgtccccccgactcccttctcctctacttatatctcgctccctcacttagattttcttcccctctactcctcccccctatgcctcctctacttctccctccttcagatccacaaagggagccgatggcggggtagcgatggcggtccggtggatgtggcaacgacagtagtgggcgggagggcgaagctcgaggccagtggatctggcggcaccgccctcgagagggtcggatccgtagcactcggtcccgctatagctcgagggcggtagatctagtggctctgcccttgggaggggcggatctgctgccctacgcccgggggtttatggcgaggacaacagccttgagctcgagtggatgagagtgggagctagggttttgggatttcggtttcttttggaaatttttttgttattttttcttttcgcatgtgggaggtttaactgaccgcccgcgaaaatcatttttttgcatgagggagcgttgcccgcatgtaaaaactctgattttcacaaatagttatgtgcatgcggacgaagtgcctgtctgcgaaaatacattttggtagtatggaaaaagttttctgtagtagtgtatacagccatgtccgatacaattccatcctctttctcatcactcacgacctcattcgtacgtagactaagaacaaaccaaagtcacaatcgatctgcccagattgacacggctgcacatatgagtatgtcgagtaggaggagaagctgctcatggacgggttccctaaccaatctctgctctgcacgcatgtctcgcaagaagccaagcaatggccgcacatcgcggtatcacctcacaccgtcaagcattcaccccgacaaacatcgagaatctccctttgcttcacatcatgtaggtaagttctttttgcacatcgacgtggcacggccgtgagaattaacgcaaagcgtggatgaataagtgcttattttctctgtagagtatgatgggtttcggaagtttgtgtctaggttgaaccgactatttaagatgatttcccgacgaactttaaagtatgattgcctaaaatattttgaagagcagaagctagagctacaagatatgtccagaaactgtacttctaatgtttttgtgcagaaactgtacttctaatgtttctctaacaatggctatgtggacctcaaaccagactagaggatatatatgtataacgtggcactttattgatgctgattggaaggtaaaaaaaagatttttaaggttctcacacttaaaaacattgcacatggatgttgttatattcaatacaatcctagagaccatataagattgtattgtgaagataaattgttttcatcactttggataatgctaacaccaatagtgcaatgtcgaagttattgaaagctaacgttttgcaaaagggtctactgcatgggcaagggaagctattacattaacattgcatgtcacatgttttgaatttaatactctattgtaatcaacatccatgggagcattaagtatattaaaggataacaagcttggattggaaggtaaatttttaggaaattgtggcacaagttattgtaataataaaaaaaaacgttgttattctgatgtgcgtactaggtggaacaccacctgtttgatgattcaaactgcgccatttagacaagctttggagtcctcagacttgcaagataagaccacacatacaaatatactttagtttgctttgttaaaaaacagttgtagagtatggaacattgcaagtgttgtatgtgacaacaaatgttattttaggtcagctatatggtacctcaaatcttaattttcataagatttgggatgtgaagattctagaaaagtaagtttcagctttgttggtatatcttacgttcataaataaaatacgcaagcgcacggagatactgctgtagtacttcacgcaaaagtattccaaggtttcgaattttcacagggaacatgtgtgtttagctattctttaggtttatgtaaggacacaaatcaaatatagacaatagtgtagagatgattttctaatatggtacatagtcatttagaaatcttaactttaatcctatcgctatgcttcaggtactggcttctaccagaacgcgctctactccctacctagacagggaggactacgatgatctcgagggctgtcaacacctctacaccaaactgtaacatactacgagatacgcaacaagtacaggtaattaataacctagacaccacatctatgattgtaattactactttaatatttataactcactaaagtaatcactatctcttaatgagcaatgatcagccaagccaaataggaactaaataaaaagtatacacacaaaataaatctcaattacttaaataaaataaagtaattgcttggctacaaaaggaaagtgggagaagaacaccgacactccgggacttctcgtcttctcttattcctcactctctccttaatctaagtgtacataagaatacaaagagactcttataatttagctaagtcttggtgtgtgttggacgagaggaagaggggtatttataagggaggttgcttggaagggtagtgaagtgccatggaatccaaagggtatcttcattctcctcttgccaagtgtccttcttgatgatggttggagcgcaggaaacaaccacaaccttgtcattggaagttagtaattactgacctagagagtttctggaccagctgggctggtcctgggtcggccgacccctaaccggctcgcttggccctaggccttctcatggatcttgacctatgggtcccgacttgtattttcctgaatttattgttggatttgtaggctcaagactccatgggcttggatatggaattgataattccctccttagtgtatatttttttctcaactctgatagtttgccacctgtatacaaatatacatcagcactcgtggaatttgttagaaataaacccaaccactatattggatgttttatatttttagatttatgctggtattgacggcggcgtaaatttggtatatttaacaaccgttaacaagcttctcaagtgaacactgaaatatctaagatgatcaagtccaggaagaagaaatttgagaagtatttgaagatttcttggttggcactatctctacctgttatcgtggaccctatatttaagcttaagttctcgagttccgtttcaggcctgcatttggtaatgataccgagtctatgattgtcaatgtcaagaatgcttttcgagaggctttcagtgagtgctaatatcaacttcactacggatctaacaggcagtgctgatgttgatattggagtatctacaagtgaccggttggctgattgggatcaacatcttaaccatgacattcagatgacggctgaaatatgttctgagtatgatggatatatgtataagccctcgaagtgatgttttgacatcctaatttttttttttgaaacggacatcctaaattggtggcaagctaacgcttctgagtatctaacctttgctcgcatggcctgatctatcctagctatatatacccgcctccgccgttccgtctctgaatcaaccttcagagtataggaaagagagttatatcgaattatcaaagctggttaactcccaagacagctgaagcgatggtgtgcttgctatattggataagaggatctggcacgtattctttcagccattttttgttaaattggtcctaacaacaacatctatacatcattgttctgcttgtaggttcatcaaacttgagcacatcatcaatttatgattttcccgaggaagatgagttaatagatcaagtaacatgttgcttctcaattattatcattttggtatagttcaaagatagatccataaattaactacatcgagccaaaagccaaaagtgactggcagtaatgctccgtgcaactatgtgcctttgttgcctcttctgtgtgacttcggtagttgaatggaagatgtagctcattaagataaatagattcaagtttgtttttgctgttgtatccaaacaatctgattggtaattgagtttttagggatttgcattcatactcagttgcatggtggatttttctgctacaatcgagcagggagctgtaagtaatctcatacagatgtctcattgaataacaagtcttttgtaccagaaaaaaaaatgttttgtcatgtacattatactcaatctctgtgatatattattcaccatgttccagaaaaaaatgttgtgtatttatggattgaaacttgagatttctttgttgtccatggtctaaattgtaccatgttataattcttgtgcttctgagttattctggtatttttaagtggttggcatagtggaaagcgttgtagttgcacttgtattttcatccttttcaattactttttagcttgatatatataccactaatatgttctattgaattattttatacatgtgcagtgaaaaatcttgatggaagcagtggtgcatgtgtggtgtaatttttaaaagtctagttgatgacccaatgtttctgaaaatcagtgctattaaaaaagtctaatttttgacgctgttgctcttctccttggcactgtcaagactggtgtattttttgaagctatattgtaatttatcatgtgctagcacttatgtatcaggtggcaaagaaaaataattttagtgtgttgctgttaacaccagacaccagtagtaatatattattaatttttgtaaaagaaagatacaatattaaatgtttgtgtatgataaaatattaaatgtttagggtttaaaataatcctagcacttatgattctttcctattagcaacatactatcatataatctgaacaaccatatcgtgtcttaccatttttatacttcaaaacccactactacaaaaataattattatggatgagacattatttaggttgcaagcggatcataactggtcacgtctacaaaaatcgacctccatttttgcatacggctgcttaagaggactgcacgtaaaaatcaattttcgcacgtagacttcttaagagtacatatgcaaaagtaattaagtccgcagaactcttaagaggccatacgcgaaaatatattttcgcaggcgtgcctcttaaggatccgcctaagtctgacttacctcctcatttccctcccgacactttaaatttttttaatccttatccactcatctctctctcaccttttctcctcattatttcctctccacttcgtcacctcctttcctctcctctctcaccttctgtggacgagacaggcaatgagcggcagggctcaggccaccaccaccgggcccgtgacggcctgatccgccaacgttgggcctgtgatgactagatccgcaggcggcgggcggcgcaaccgatggcaggctcccccgcattgaaggaagcgacggcggttccattttctttagataatggaatataattccggcctttgctcaagagttacagccaattattacataaattcacatacaagctttcacacactaaaaggtccacaaaaagcttacataattgaaatgaacacaaactgagaagcaccaacacaagacaaaagatccacgattattaattgaatcatattagtgaacctccatccgaaattggcgaagatttgcatgaccgtcgactcaagtttacgacatacatcatttagtagtttgatgtcttcatcacacctttttagctgggcctaacattggagccaatatgctaccctgaaaattacctgcatataatattttgatggtgatttatcaagaactatatcattcctacaaagccatagagctcaacataatgcagatgcttctacaaggataagtttcttgttttttttttatcaaaacctacaatccaattcctaaagatataagatgtactgtgtggagggtataactcaaaagtaatttgtaatgctctccaaagaaatatggaataatggttatccaagaaaagatgatgaattgtctcatttttcatgcaaaaacaacacctcttgctatcatttcagttcctcctagtcaagttgtccttcgttaacactacatctttaagtaggtaccactcgaaaacttacaaagcacaattcacaggcccgatccacggctactaacttcaaccctatcgtttggaatcccatggacacaaagaaagtacaagctatagtatggacggcaaatcgactagcaataacagtacctattggcctaacggtcatgcaacttataaattgagagagccgattgcacgtgttaattcaggtaccagtcatgacttacaagaggcggacgacttttgagagaaggtggacggggcagacgagatggaaggacagcagggcattatattcggaaaataagtcaaaacacctacattatacttacctataacaaaagaaaaaactaacatatccatataaatttatcaaaccgtccgacttaattatgttacagtactaccgtactaacattagtagtgaaaatgtgccgttaaagcactcttcgatcacgaaagctagaggtgtcagaacgtccctgatacgtacaaacgcacggtcactttggttatttcagaagaaaaaagaaaattaagggaggaaaatttcgatcagtgacgttggggattagtgtgtgtacgctgctgctgcgcaaatacatatttacggcttaacgatgacactcgtacgcgcgtacgctacgtgcttaatttatactccttcattccctaaatatttgacgccgttgatttttttaaacatgtttgaccgttcgtcttattcaaaattttttgtgaaatatgtaaaactatatgtatatataaaagtatatttaacaataaatcaaatgataggaaaagaattaataattacttaaatatttttaataaaacgaacggtcaaacatatttaaaaaagtcaacggcgttaaatattttagggtcaaatattttaggatgaagggactagttcctcgcgtccggtccatcgggacgagtttgtctaggcacatatatattcacctgacaataatgacagtataataagtattttcaaaggctagccggcctacttcctagcctttgaaaacatgaaatgcaatgatactgcaactagcggaaagctgtttttatccgtagagatggtattcctctcgtttgtttaaaaaaatataattataaaaaattttaaaaaaccgacaacatgtatgcaacgtatatatatcacttcatcctatggcgaaactcaacataggaaataagataaaagaaagacaaattaacgtatgaatattgaaaagtacttgtactattcaaacctcaatgagtcattttcttttctctcggtgtcatttttttttgttaaaattctttctacagcgttttgcattgaattggaaagaatatgaggggatagcctatcgggcgattagaatccgtttctccgcaggtttggttcaattcgttgtctgaaatgcacttttcaaacatcgggcatagccattttgcccatttccatgctttagcatccagcttattctttactgctcacaccattgggcctaaaactgatccatcgttcagcaaataaaaataacacaggtggagaaactctctttactcccggtttgcaatggcctttaatcccggattgcaaactaggaagctcagtaaatctttagtcctggttgatataattggaacttaagattgatctttagaccggttgataatagcaaccgagacgaaagatggtaatgctatgtggatggcgctaccatctttagctctggttggtgttaacaagccggactaaagttttttttctttttctaattgtttgttgctgcttgtatgttgatttcaaaccaaactcaacaacaaaatcatttacattcaaaaaaacatcacaaaatcatccacaaattcaataacaaaatcatctacatccaaaatcactaaaaatactaaaaataatctttagtcctagttgataatactaaccgggactaaagatcaaaaagtttcattgggcttttgagccgaggctaaacatattctttagtcccgtttgtaacaggaaccgggactaatatgatttttggccgacacacgaaaagatcagttctccagtagtttaataatttgttgacaaaactttgtcctagagatttcaaagccaatgctaaaaataattattgtcattgtcatagtgtacccttctgcaagctcctcgtgtccatctgtcaataaacagtacaacatgttccatgataacagtataatacgttccatggcaacggtaaaagtaaacagcttgcttcaattcttggacttttgtttttgagagcattaaattcttggacttacgtgctctatttcaacatcacattgcacagtttgacatgcattcaggcatccagcatcgtctttacgtgttctcaactaagcttctttacgtgtttttttaagaagggtattttttacccgtcctctacatccaatcggatatatacggccattgaaatagggaacttagccccgcaaacaacccaatctgaaattcgctccataggagatttgaactcaggaccttggggtactactcaggtcactataaccactagtctacatgtcctttcataagctgcttacgtgttatttgcacagtttaaatttctccttgaaatttcaccttaatttgctcgacgtgctatatatataagtgcccatttctttcctcctccgatggctgtggctgcaatccgattcaggtagatcgacaacgtcggcgggatggacgatgccggtgagatctgctcgttctcgcggtcgtcgtcttcggcgagggaggacgacgaggaggaccagcggtgggcggcgctggagaagctgtcgacctacgaccgagcacggacggcgctgctggccatgccgccggacggcgagctgcgggaggtgaacgtccagcggctcgccgccgtggagcggcgcgcgctgctgcagcgcgtcgccggcgtcggcgacgaccatgcacgcttcctcgccaagttcaaagaacgcgtcgatcggtaaggcgatctcatattgacatggtgaattttggtggttttatacagtggaaaaggacgtcacaatattctgctcgagcactactacacgtaatatttttttactaaaagtcatctcaatgtanggcttttgaagntagattttat

SEQ ID NO: 18376 - DNA, 6175 bp, Oryza sativa
  unsure (1)..(6175): unsure at all n locations
aacgatttagtaaggagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaaatgtgacggagggagtagaagttacaaaaaaaatttagatacactcatagcatgacacgtccgtgttagtaagaaaaaattaatatgtatagccttttcatttttttatgttgtttaaatagtcgtaaaatgtttttctttcaaaaaagtagaagatctaaattattactgcctcggttcgattttaagtgtagcggtgggtttctgcatctaacatttctccatccatcttatttgaatttttttatgattagtatttttattgttattagattataaaatatgaataatactttatgtgcgacttttttttataaacttttcaaataaagcggatggtcaaacgttccacacggaaacacacgactacacttaaaatattggatggagggagtatatggtatatgtcttcacaaacatgcaagcttgatttgatccaaaaagcttgaatatgtcttcacaaatattcaaatctgaatatgaatggtcggcatactagtgtttaatctgtgtcatttttttctcgagttgtagatcaaatttagaattgagttttaataggatgataaacaactattgtataagtgttattaaatatttcgagattttatatattatacctacttgattaatattccaatggttagaataaacgagaggatcccttaaatgccaataaccagttgtccagctacatatcatatcatattaaatccttagatttcgtaacccattaccagcagtgctgtgattagtataggtatatatttctattttcactatattgtaagttatctactacctccgtcccattataagtgcacttatgaattttcgtgtccaacatttaactgtccgtcttatttgaaaattttataatttttttatagaaattagtcacaaataaagtactattcatattttatcatctaataacaaataaaatactaatcataaaatttctaaaaataagacagacggtcaaacgttcaacgtaaactctgcagtctttatgggacgcaggtagtacaagtttgaaaatatcactaaatcattttatgtgaaatttatttatttttcctgaaatattacttgattctctaactttctatgttcaatttttttgataaattccatgctaattttacttcatgtttaacgtttgcaaatgatcatttttgtatgaaaagtagtaccagaccttgcctagtaaatacatatatttaaataaaatatttacaaacggagaaccaatttatcagaatttttgcaaagtgggtgtagctccatcagttaggtttcttgtgatggaacctgcccacggagatcacatttacggctaattatatttttattcataggcgatgtacctatcgatagagagacaaccgtggtaacttggttaacctcaaaatatgtcatccgagttttacgaaggtgctcatacgggtagggtgtgcgtgtgcgttgagggatgagtgtgcgcgttttgagagcacatgcgtttgcattgtatttctaaaaaaaaatatcatattttttatgaatgttgttaccaatcagaaattacaaggctaattgactcattaatccatatgcaagaaaatttcctgaatgaaacattaaacttgaatttccggcttaaaacagtcaagcaataaccttcatatagcaacatatttacaaatattttttttccattcgtcctcgatttcaaaatatgtcgggaggctatctatacctatactaatcgggcacttttttggagctctcacgttaaccagaaaaatctaaccattgattagatggattgtaaaatcatggccgtacattgaaatctgtgttatcatgggcttttttaagcgaatccaacatgtatagagagtccctctattatacgtattgttaactacctacattgatatggatattcaatctgttaatatatctggacgtatcctatctccagttaggtcaatagatcgggctgtgttaaccacgtacgtacgtagcctagctgatgccgatcggaattaatggcggattaggcagcacgatatgcaaccgagggatcgtcgtgaggagcgaccattcgatggaatcgtccggcaagacggtcagccccatcatattcatgatttccaggttcgaccgctcctggccggggcttcatccatggtactaacaacttcttcatttttcaatttattttaattccgaataaaaattaataactgagtagacgaggaacaaggcaacatgtatgtgggatgatggaactgtcaacagcagtgcaatcatacagggtaagaaaaatacagcttattccctttggttctgatctgttaatgtcattgtgtacatatattttcaggaacatatttttaattttatttgaaattattacgatctttggcgtatcgatagagttattttatcacggtcgactgacagtaaaaatttattagttcaccaaagattaagttgtttcataataattttgaagcaggcaacttacatatcgatttatagtttttctgaacataaacaagcattttgtcctctctatacgccaggttgtgtaatgtgcaattgaactacttcaaaaaccattttcgcaggtatccctttactacgttctttttgccgtacttctgtattctttttgttggaaaatagctttcttcgttttggtaaaaaaaaagttttcgtcagattctatggtataattcaataaaatgtgaatactactatttgaaggtttgcttcaattcaattagtcatgaatatttactcaggcacccatctgtattccttctaaatagattttcaagccaataatatataggaaaagatatatctatatattattgattaaaataatgtatcaagacacatcacagcttcctaattgttaaaattacattaataaataaatgaaatactaaaattcagacccctaataggaggacgatctcatattttcaattctaatttacagaattattaaataaaaaattacgactccaaggagagttcaatttcgtatgtattaactctgagtccacattatctatgatttttctattttgaaaactattaaattagaaaataaaaaaactagaaaaaggatatagaaaagcataaataatgcatttggtactccagtactttgcataaaagcgagtgtcgttgtggagtaagattttgtatatattattattatcaaaattcacaattactttaaataggaaattaaattacttggtttttattaatctatttgtcaattaaaaatatataattctatgtataaatccatttatacattatatatatatatggtagttctgagtgaaaatcaagattcttttaaagttgatctccactcaaatccgctaatatgaaatcaactaattgcctttatgagatatttttgaaaataaataaccaatattctagcatatgattaaaatttttaaaatattaatatagcccgtgcaacattcttacaaattaacattctcaaacgcaggtggggtacactgtgatttaatcttaattttctttaaccttcaacttattgagttaagtggtagagatttagatttcttttattgcacatagtagttctctaatatttaagcgaataaaatctataattgggcttaaactaaacaaatagagcactctggggagctcccacatttattgtaattgacatctgatttatcttttagttaaaccgatataattaaaaaataactaatgatttttctataagtagaatctaaacattataatattaataataatagcccgtgcaacgcatgggttggcgactagtaaacataatatccaaaaaaagccatgttgcttgaactgtggccttgccaaaacgaacatattctcatttcatcttattccaatatgttccgaacattatctactgaaagggcgcgtgaagaaaagatgcatcatacttatcaccaattttttagtatggccggtcaaaagcttctttaataaggcaaaacaatatcaaatacaaggctaattgagcatttgtttccttctataatattcaatcaaagttccttgcttaattcaatgatactcaaatctcttgtgtgttcgaaaaaaaagagagtaaaagttcgtttttaccatgaagtagtgaatgatctcagattagctcctttttttagagttattgggcacatacaatggcagcatacattttggctttgaaaaaaaaaacataagattttctttgctgtcccaacttttttaatggatataggtgagacacaaactgtctggtggttggttagatatattagctataaagtatactagaaagggactaggctttgccgcgtaatgggtcatctagtaagaaatattaatgggccatcgtttataacgtttgtgtagtgattaatatttattagtaaatatatatgctatttgttatatttgtttgtttgcatttggtatcggtggaaattcctgggaactcaaaaaacatgacaagcgtggattggttgactaagtagaccatataaattttaatactgaattttagaagagaaagattacaaaaataatagcaacaaagggttgccacttttaaccataccataagttgatagtaccgaaattttgataactatagaagttttcactctcaaaagttctaccaaatttgcgaagtgagcatagctcaactggttaggttccttgtggtggaaccagcccacccgggttcaaatcctagatttgacacaggtgctcgcatttacggctaattattctttcagtggtaggcgacgtacccgtcgacagcgaggcgcctgtggtgacttcgtcaatctcaagatgtgccggcccagtcttccggaggtgctcataggggtagggtgtacgtgtgtgcgttcataggggtgagtgtgcgcacgttgtgagcgtgtgtttctcaaaaaaaaaagttctaccaacttttggtaatgcataatttaaaaagtacgaattaccccccccccgaactatcgcggtcatccgaattacccccgaaccacaaaaccggacattcttcgcccccaactatgcaaaccggacaaattaccccctcgaaccaatttagagtggttttgtccaacgtggcgcacacgtggcaatccagtcgccccccccccccccgaactatcgcggtcatccgaattacccccgaaccacaaaaccggacattcttcgcccccaactatgcaaaccggacgaattaacccctcgaaccaatttagagtggttttgtccaacgtggcgcacacgtggcaatccagtcagcgttttttaataaaaaattgtggggcccatctgccatacttttctcttcttcctctctctcctctctctctctcgctcttttctctctcgcggctcgcgctgcgcacacggcgaggacggcgcggggacgggtggtcggcgatggcagaggcagcgagcgcggcggaggaggtagcggcggcggcagaacgaggcggcggcggcggccggcgaagtggagcaaagtgcccgcagcgaggggcaacgggcaagggcgcggcaggcggagtggagcgggcggtggcgagtgaccggagcaagtgggcgagtgcgcggccgtcggcagagtggagcagagcagtggcgggagagggggagaggaggccgagcacgacatcgtcgtcgcgctagacggcgaggtgtcggcgtgggtgatcggcgttggcccgttggtaggaaggcgagaggggtaccgagccgaattcagccttaggcaacggcaatcagtnntcaannnccccttn

SEQ ID NO: 18377 - DNA, 22412 bp, Oryza sativa
  unsure (1)..(22412): unsure at all n locations
cggactatgactacattactatagggcgaattcgagctcggtaccccatcatccggagcggcggcggctgcgccccctccacggtagacccaccggcggcgacgccgactgccgcgcctctcccctcccccatctttcgtcggctgcctcccctctccctctctcctcctcccgtcgcgaggccctcgaggcagcggagctcgaccgggctcactggccgcctctttcctttctaccgccgccggcctatcccctctttgcagcagaggagcctagcgcggcggcggaggcagcgcccacgatgaagcggaggaaggcgcggccgtgagatggggctggttgtcatgcatggcgtcggccaccgcctcccctcgccgccgccgctgcctccttcaccgtaccccgccatcgcctcgcctcctccgtgagcagcgtgagctcatgccaacgcctcgcctcgccgccgccgctacctcctccgctgcgctcactgcctccgccatcgccgaccacccgtccccgcgccgtcctctccgtgtgcgcagcgcgagccgcgagagagaaaagagcgagagagagagaggaagaagagaagagtatggcaggcgggtctcacaattttttattaaaaaaaggctgactggattgccacgtgtgcgccatgttggacaaaaccgctctaaattggttcgagtggggtaattcatccggtttgcatagttaggggtgaagaatgtccggttttgtggttaggagggtaatttggacgaccgcgatagttcatggggtaattcgtactttttcctaaactaaatacaatcaacactaccaaaatttggtagtgctaaaatataccatgcccataatctttagttagcggatattttggagaacggtcggtgctcggtaaagtcattattttgtcttctccagtagctattctacatcccatgccatgtatacactccacagtggcccactttagataagcaacaaaataaaaaataattacgtacttttttttaaaataggacaaatagatccgttatgagtcttctgtaggataagatcggtttggtcttgtgataggggtttgaggaggaacaagaggggacttctaaaaacataaaatggatctccttatttacagggaacaaagtgagtgatatcttttgtgagtatccaagggttacttctcagtggcgtagctaggaatttttcgttgggtagtcctattgcccatgatggaggatgcaaaaatttaggtgtggccaagtaactggtagatagcaaatataatgatgcaaaagttatactacgaaatttacaaaatttgtccttggtcgtgcctacttatgctacaatttttaatatcaccatacaatataatatgcatttacaaaattgttaaagaccacctaatttaaataaatcatcgtaacataagacacaatgataaaaaaaaaaagacaatgaacaaagtgagtgatattttgtgagtatccaagggttacttcattacttctttatgttctaaaagtgctaggtatgatttttctagacatttctgataggatacgtacacgggagacatgtaggagttcttgccaatggatacatatgttgcatgttactccctcctttccagaaaaaatcaacctagtactggatatgacattatctagattcgtagtactggaatatgtcatagtcagtcctagattcgtttttcgtgggaatgagggaatatatggcttattttcagcaggacacatggcagaattttagagatgtctaacttaatttttagagactttttacagtccttgaggggaggcagtaccatatcttggccattggtttcgcccaatctaacggctgaaaatggttggtaccgcgcggtaccgtgccttcctccgagccggtaccaaatgacttttgaaggtgggagggcaaaattgtacattcgcataccgattaggagtggaacaccgcgtgtctgccccagtcgtcgccacaaactgagcaaccctagaggtggccacgagctcgtggctgatgcggcgacctcccgagcggcggcgacctcccgagaggtgggccgatgcagggttgtggtcccgccgacgaactatcctacctcctctctcctctcgtacaatagaggcggcggccatgggagttgcgcagaggccgcgagaaacctctcagatgcagaggtggcggaccaaagtcggctcctcccaccaccttttggagcctcctccacctttcccatctgtgtctcccttcctcatcccctgcccctagcgccttaaccatcccgtcgtccagatccggccaaggaccggagcagggttggaaatttcggactgaaatttttgaaatttcgaaaattttggtcatttcggtcacccccgatacgatattatttcgaccgaaatttttcattttttcatgaatttgggtaatatttgttcaaattcaactaaattttgcttaaaatttcggaaatatcatatcgaaatttccgaaaatttcgggatttcggtgaccccctatacaaaagcgtcaaccgatagagtcaaccctggtctggagcgccagatattgccatgaggtacacggcgacgagctcagctcggagaacagattgaccttggggctgcggcgcaacgacctaccactatcctccctagcgctgctactggaagtgatgaccgttgggctggtcgccttgtgtaagaagaggatggggaagctgcccggcatccatcaggtacgaagctgatgccagcagcagctgtgagcctgcaagcgcatcaccgtccccatacttggggtcaccagtcgatgtcgtctatgagtgtatgacttgatctgtaatttttttaggctgtacatagtggagtatatttcgctgtaggtgaaatctaatttttttttcctcccaatatctcaagcacggaccttttcttcagcaaattaaccatgatcaaagaaagggtaaaaggatttgtaagatcttgtagtcttgcccttgtttagttccaaactttttcttcaaacttctaacttttccatcacatcaaaactttccaacacacataaacttctaactttttcatcacatcgttccaatttcaaccaaacttccaattttggcgtgaactaaacacaccctttgttcaggcacgatttctacctctgacatgccaaaacctggcgattcttgagtgctagaaggaacttgcatggtggaatatgtcttggtctattctgtcagttactatgttttgttgcagaagctattttgtcagttatgtatgtggttgccggaatcgatattgttggaatctgtcttgagctattttgtcaattatctacaaataggtaattgacagaatgacaatctgtcatggatgtccataaatattggggagattttgccaagatattaaagaaattcctagtgaactctcttattcatgtaaaactgcatttggttgtgaggtttagctgagattttctgagttctgaaaattttcgaaccttttcggaactagtgaatcgagccatgcacagggagttccatcacgccaaaggaaggtcaccctggagacgtctctttcttctcctacaagctcctcccaaatgctgtgtttctccaatcactccatcgaatggcctccgatggccctgcaagagagagggcagggatcttgagcggagcagggctggctgtatcgacatgacccggagagaaatacgaggacgaagacttgggaaaggggtaaaaagtcatggggacttgttgtgtcaacaaatgtccccataccaatcttacccctgtgaaatcaacggtgggattgaagtggtacctcaaggtacctggtacctcgtatggcccgtttggttggagggagtttttaggagggattgggagtttagagggatgaggctattaagtgttttgtttggttgggagacatgaaaattttagtgggatggggatggggaattgaggaaggaactcccttcttttcaataccttggtaggggcaggtaattgggaggaaattcctcctttactttatgtaagcaaatctcagccatccgtttttattaatgataatctccaactaaactctctatcaatttccatcacctctatcaaacaagatattgggattaaaattaaattcccatcttaatctcatcatcaattctctcgtgtaaactcccaatcccttcccttgagttaccaaacaagccggtagtacctcctcaaggatggtaaaaactctcagagatatgtttagtgtgggagtttccggattctcctctcaccctgcccgtttggttggagggagtttttaggagagattggtagtttagagggatgaggctattaagtgttttgtttggttgggagacataggaattttggtgggatggggatggggaatcgaggaaggaactccctccttttcaatacctgggtaggggcaggtaattgggagggaattcatcctttattttttctaagcaaatctcagccatccgtttttattaatgacctaatctccaaataaactccctatcaatttccatcacctctaccaaacaagatattgggattaaaaatcaaattcccatcttaatctcatcatcaattccctcgtgtaaactcccaatcctcttccctcgagttaccaaacaagctgacagtgtatcttcttctccttattaatcaaacaatgcacagatctcctatgtgttcgaaaaaatatattcacatggttacgacattaatttggaaggcatggttaaatataaggaaaataactaggtttttccttttcatggataaccatgctaaattcaattggaaactttgattgctaagtctcctatttgaaagatgtttcctctgtgcagggttggaattaagctaccgacggttgaagtgcggtatgagaatctgaacattgaagcagagtcgtatgtgggcaggaggggacttcccaccattctcaatacatataccatcataatggaggtatttgcatgaatgaactatgagaaaattactacattcataagaaaaaatgtctccatctatctgttataggacaaaattataataatttagatgaaaagaaagactctatcggggttgatcaatgagatggttactactttgtgattatcagacttcttaagcccgcacaaatcaagaaactgctatgtaaactgatcaagctagaaaatttcaacatgaaattcacaggttttcattgataatagagcggtaatcacggtcactaggaagcaattttaagtgacatcttgtggagcacggtctccatgtttaatacaactttgtaagcattaattcaaaacttgtaaaacaattctgtgtttgttcaattcaattataatggtttctatgaatcttaacaaccgaaaactagtttttattccatcaatgaactttgcgacatcctagaaagttgcttcccattatccgtagttaatgctaattctctcctctgttatgaagccacatcaccccaaatggtttttttttttttgcaccatggtcaatcgtccatgatgagcccatcaacattttctcacttattcctaacattttttactacaccacatcaattatttctgaacttttggataaaaattcactttgcatcatcatgtttacttgtcgccatgcaacttttctattccaatgcacaaagtctatgtagtttcaatgaaacaagaaatctatgtggcagagagtgcctgccaactacgcattttccatgagttccatatgcagatctaactcatggaatttgtaaatacttgattgcttttagttaccagatgacattaggcttgtgctgacccatattttattccattttttaatattacattaggtttcccttattttacatagttcaatgtatcacacaaaggtgcaactgacaactagctacctctaaacagggcctgacaaatgctctttgcattacaaaaaagataacacacaaaataccaatccttcacaatgtgagtgggattatcaagcctcacaggtaacttcttagtaattgttagtttacaaaatatgtccatgcaaccttgtccatgcggcatataaccttgtccatgttgttttcagaatgaccttgttgttaggccctccaggttcaggaaaaacatcactattattggccttggctggaacatcaaccttaaaggttattttgtttatgtttttcacatacaactcttctttagtacattgcaatatactttaagtattaatatgaggaaacattgcaattataaaaggtatctggaacaataacttacaatgggcattcaatggaggaatttgtgccccaaagatctgcagcttatgttagccaacatgatgtacatatggctgaactgacagttcgggagacagtcaatttcgctgcaaagtgtcaaggggttggccatcattatggtaagataggagaaatggagagattgatactcatcaacattaataaaatatcatattaaaacattaacattttctagaaaatgcttagacttgctaatggaactgttgaggagagagaaggaacaaaatattaaaccagatccagaaattgatatatatttgaaggtacaatgcagttcttaaatcacaactaactttatccagtgttgagctatctctagtacggttgtttttaccatttattgatgttccactaaaaggtttgaggaattgcactttatcattttgcttatgcaggcagctacaacaggagagcagaaagctgaggtggtcacaaatcacatactaaaggtgtatgagcactgtctagttatatagttctattgtagtgttacaataaatttcacaattgaaatccgtatgccatttcccaataattctttacttttctaactatcgaagattttgggattggatatctgtgccgacacaatagtagggaacaatatgctgagaggcatatcaggagggcaaaaaaagcgactaacgacaggtaatgtatcattggagttattagagtgcatgatggttacaatttctgatccactccctaatattgatgccacagctgagatgattgttacaccaggacgagcacttttcatggatgagatatcaactggacttgatagctcgacaacattccagatagttaacaccatccgacaaaccattcgcattcttggtggaacagcagttattgctttgctacagcccgcacctgagacatatgaattgtttgatgatataattctactatcagatggtcaagttgtctacaatggccctcgtgatcatgtgcttgagttctttaaatcggttggattcaaatgccctgagagaaaatgcgtagctgacttcttgcaggaagtgagttttaccatggtttgaccttagcattatttttggtcaagtgcttaactatgactaattataagtggcttattttaggttacatctaggaaagatcagaaacaatactggataggtagtgatgacacataccaatatgttcctgttacgatgattgctgaggcatttcagtctttccatgtcggtcaagcaatcagaagtgagttggcaatcccatttgagaagagcaagaatcaccccgctgcgctggcaacatctaagtatggtgttagcatgaaagaactactcaaagcaaacatttatagagagatattgctaatgaaaagaaattcgtttttgtatatattcaaggcaattcaggtgattcttaaaaaccaaaggttgtttcattatagaaagataactcataagctttaaaaggtcaaagttaattggcctcttattatattatttcccttaattgttcagctaaaactggtcgcaataaatgcaatgactgtgtttatccgaaccaatatgtatcgtgactcgatagaaaatgggaggtcatacatgggagcactattctatggaatgatgatgattgtgtacagtgctttggcagaaatgggaccagctattgcgaagctcccagttttgttcaagcaaagagatctattatactacccatcatggacatattccttgccatcttggatcattaagatccctatctccttcctcaacacaacagtttgggtcttcctaacatactacgtcattggatttgatccaaatgtactgaggtaaggaaaacaaaatattaccataaataaattcttgtaatgaatacactataagattaatgaaaacaatgcaatgctacagatttttcagacagttccttgtactttttgttttgtgtgaggtaatatatgcacttttccgcttcattgttgcccttacaaggcatccggttattgcaagcaacatgggcccattctgcatcctcatttttatgctttcatgtggattcatcttgactagaggtatgcaaatagtttaatgaattaccatatgatgcttctgtaagttttgatactaattccacaatgtatgtagtacttttatctctgttatatgtctgtatgattcaacagatgatgtcaagaaatggtggatatggttgtattggatatcacccctaatgtatgccttaaacgctttagccgtaaatgaattcctaggtcaaatctggaacaaggtaaacatatacttatggaatcgattaaaagccatatatttgaatttgcctggctaaaacattttgttattgttaaacaacagtcaatacttggttacaaaggaccacttggaaggctagttttaggatctagtagttttcttcctgagaccaaatggtattggattagtattggcgccttgctcggatatgtgcttttattcaatgtcctctacaccatatgtctcacatttctcacacgtgagttattaaaaaaagccaattttttcattagtaaaatttattctttcaaatgatctataaattctaattttatgcaccatgcactctatagtatttagcaggagccaaccaacaaagcctcaggaaatgttgcagataaaacaacataatttaactaatgaagttttggaagcatcgtctggagggcgtgctgcctgcaatacaatatgtaaattttttgattcacctatcaaaagactaaacatgtcataacatgatgagatgccattcaaaagttaattttcatttgtgctgtgtctggtagatgctaaggaaatcatcaatgatgaagcaaattcgtaccatgcaacaagacattctagtgctggaaataaaggaatggttctcccttttgtacctctttccatcacctttgaagacataagatatagtgtagacacgccagaggtacaaaaatattgcaaaatattgttgagacatgcttgctctctctctctgcataattgcctatatttgcaccatttgcgagcaaactctatataatagttgttctaatcctgcaataaaacttgtaggcatttaaagcaaaaggtatgacagagggtcgactggaactattgaaagatatcagtggttcttttaggcaaggagtacttacagctcttatgggtgtcagtggtgcgggaaagacaacactgctggatgtgttggctgggagaaaaactagtggatatgtacagggtagtattaccatctctggctacccaaaaaagcaagaaacttttgcccgaatttcaggatattgtgaacaaaatgacatccattcaccaaatgtaactgtctatgagtcccttatgttctccgcatggcttagattacctgttgaaattgattctgcgacaagaaaggtaagtcaagtacaagtaataactactctctctttatttgaatacaaagtagtatataagaatgtagattttgtgaactgatctatattgtctcacatgatgctacaaatgaaaaacaaaattgatagagatggaatttttatgaaaaatacgcgacgatgtgttgctttttctttatcttgtagtagtttttaaaaggaatattcatgtatctttttgacatggtttctagatgtttgtttatgaagtcatggagctggtggagattctctccttaaaagatgcactggttggattacctggcgttagtggattatcatctgaacgaaggaaaagactaacaatagcagtggaactagttgcaaacccatccattatatttatggacgaaccaacatctggacttgatgcacgagcagcagccattgtgatgagagcaataagaaatacggtggacacaggaagaaccgttgtttgcacaattcaccaaccaagcattgagatatttgaatcttttgatgaggtgaatgaaactataacaatattgtgcatttgatctttcaagaaaagaaaaagtaaatcattggtgagtaaatattgtttgcacactcactcaatttattctaatatggttctttgttgcagctcttcctaatgaaacaaggaggtgaagagatttatgtaggtcctataggacgacaatcatgtgaattaattaaatattttgaggtaagaaaaaaacacataaaacaatacaattttgcatttttgctgtacgaaacatgctattgaactccttttattttctaaaggctattcaaggtgtcagcaagataaaagatggctacaatccttcaacatggatgttggaagtgactagtacaacgcaggaacaaagaacttgcgtggacttttctcaaatatacaagaattctgagctatataggtaggtattgggtagtgctttaattgttgtcccattaacatagcatctatgtgcaaagccaactttctagtatgtacagaatatccgtgatggtatgtgtaagaagtgggttctactaatgataaaaaaaggaaataatgagacaatgtagtggcgaaagcaaaaatatttcctatatgaattgcagaaagcgatgaaatcataatatcaaactggaaatgcctcaaatttattattcttccacaattaatgtttccatttatgaaaatggtaataggaaacatcattgtttcacaatgttactagtttgctttcattacaggaggaacaaaaatttgattaaggagttaagtgcacctcctgaaggttcaagcgacttatcatttccaactcaatattcacagctttttcttacacaatggttggcttgcctatggaagcaacatctatcgtattggagaaatcctccttatattgttgtgaggtacctcttcactattgtagttgcactcttgttcggaaccatgttctggggtattggcaaaaaaaggtaattaactgcaataaacaaatgcaagtaaataatatatatatatatatatatatatatatatatatatatatatatatatatatctcaagtccatccattgcagtttacaaaagatattccattgctgcagacaaaatcaacaaaccttgttcagtatcatgggtgccatgtattcggcatgtatggcaatgggggtgcagaactctagttctgttcagccagctatctttgttgaggcgcacgatcttttacagggaaagagcatcacacatgtactctgctttgtcgtacgccttgggacaggtaaagtttgttggcatcataatcattttgtaaatatatgcatgcgagtcttgataaaatgttttaacatactattatttttttatacaaaaccaaggctctcagtaagtggaaaggaatggtgaaacaaaaagccttcttgacatctagtttcattgcaggttgcaattgaatttccatacatttttcttcagaccataatatattgtgtgctagtgtatgccatggtagggtatgagtggacatgtgccaaatttctttggtacctcttcttcatgttcttcacactatcatacttcacattttatggcatgatgatggcgggtttgactccaaacaatgccatgtctgctgttgtttccacggcattctataacatatggaaccttttctcaggatttctaataccacggattgtacgtataccagcttttctcaagtatctaattgtacattgttcgtggctaaattatctcacatccactaatttttctaatatggctccgtttactacagagaattccagtatggtggaggtggtactattggatgtgccctgttgcttggacactcaatggattgcttacatcacagtttggggatgtaaatgacaagtttaataatggcgtgagtgtatctgactttatcgagagctactttggttacaagcaggacttgttgtgggtggccgctgtggcagttgtctcctttgctattctctttgccttcctttttggactctcacttaggctattcaacttccagaagagataagtaaggaagaccatgtcgagtttcagactttgatcaaatattggttatcatagatgttttacagtatgtgcataatggcataatggcatataacatgcttacaagcatctgttttgccaatataaaatgcagccgtgccgagtgagtttgtttaatggctgtttgcaaaattggctctcctatacccctcattctcaacttttatcctttatttttcctggtagtaatcaggtgaaaagatggttttttccattgcatgtaatttatatgaaccaataaatcttcttgactactagtaaacaaataatagattaaattttcacaataaaggttaatatgtacccaaaacaaaagaagaaacaaaaaatattttgggggcaagattgtaaatttgagtaaagtgcatagccagttcctattcttgttcgcacctatcatctcgatccccaaactcttaaaatacatatcttggtgctataaattgttaaagtgtgttattctgatcccaaattgccatgaacccccaaatcataggtgacatgccatgtggatgctgacatgtgtcacactccacctttgcatcatctaatagtgacactagaggggatgagctgcaagagatctgcgtgaaccgaatccaatggaaccactcttccggtaccagcaataggacacgattgctcatacatgcggtcaactaagatgaatctattcaactgaatatgataccttatagaaggtcacaccttcaaaacgactccaaaagtgtcacgggcaagtagagaagcagcagcagaagttagcgcagctagaccctatccacgagcaatggtttgggattaaaaagaaaccctaaccttcaacttcactcttcttgggggaggggaaaataacaatggctgagtaaatacatactccacaagccacgggaaatttgagtatgcaggctccaaatgacagttggttttgttttgtaaacttttaaaaatatattttgaaaaacaaactaagtgtggcgttgtttaccatgtgattggatggagtttctcgcttccatcctgtctacgaattgctttgcaacaactcaagtggatgaaaaaaaatttagttgatgaccactattatgtcggctgtcgtaccatgactctagcacataaccttctatccttaggcagttcccaactcaatcggtgtccattagtttcttttcactttttaaccactgggcatcatcccatctaatcatctcatctctttggctcccagagccaaccatattctccaacacactagtgtggccctacaaattgggagaaatataatcaaagggtaacttccttctgatttcttgtccaaaataatttccaacgacatagactatgtgcaaacgaaagagaaccaaacaaaaccctaaaaataaaacaatattattaataacaaatagtacgattggatagatctcatttttagaaaaaattgaaggccttaacatggtcgattcgagttacaaatagggagtatgatttttggatgattatgattttctgaaatataccaaaaatgatttatttggagtataaggggaataataatattcccatgacaggttggctcaagggtcggtgagaaagggaagtaaaatagactttgtaggggtgagatgttggttggtgcactcaggcaggcccattggctccaacccatttatgaaagtagccagttgagggagagatagtggacttggaaaggtggaagaatgaggtgggccactacctgtgtgggctaccaggctggcccataaggcatcgacctggtctacggctaacgcaactcggtggcacggagttggcccgcccatcgcagccgcatcggcctagtacgggagggtttgaccgtccccaatcaacggctggtgacagcaaggagttgcagggatgatggtgactcggtgagtgtgacaagtggcttggatgggtaggaaggtcaaaggtgcacgatggcagtgagagaaagccaacacacggcagtggctgattgtggcaatggtgccgttgcatcgaagtgggagagagaggatggattagagagctcatcggagggagttctatagcggtagagacaaaacagacctcgcagcgctccaaattgtatggagcgcagcgagaaagtgattggccgagggggataggaggcatgactgaggcagagggaggacaagcgagaatcctgttacgcgcgtacgcaccggcaaaccaagtcgcgcgcacggggctaggttttcttttttcttttcaggacttttttctttaccggatatgcctatattaacgtaactaactaatctgattagttgattagttttagataataacgataattaaggaaaaattaaggacgttctttttgtattactaatagattgaaaagaaaactatacatgcagttaaattttgaaaactttcaacttttcatctcaaatttgaaaaactttcaactcaaatttgaaaactttcaacccagatttgaaaactttcaactcagattcgaaaactttcaacccaagatttggaaactttcaaactagatttgaaaactttcaacccaaaatttgacaactttcaactctagatttgaaaacttccgactccgattcgaaaactttcaactcagattcgaaaactttcagctcgagatttgaatactttcaaatcagatttaaaaattttcaagttaagatttaaaaactttcatctcaaaacatattgaaaaaataagtgtgctaaagattaaaaaaagtaatcagaaaaaaaaaacgcaaaagaaacagcgaaaaacaaatcaccaaaaaaaggaaaaaaaatgggctggtgggccttttgggttgggagcagctggcgcacgcgcgtgccaactagcaacccccgaggacaagggggcaacgtgctttgcatgaagcacggggtgctgtggagctgcaataggtggaggcaggaactcgacaatcaggtgtggtttctcgatatactgggagggcataggtagggggtattgactgtataattgtacaattataggtgtagactaaaatgactatatactagaagtacagaaatgatgcttttcttttttttctccaattagcttagattattatttgagtgagtgtcttctggttagttccttatgtgtgttaatcgatcctaacacctgaattgattaacccccgcattagactttgatctacatatatgatgaaaattattaacatagtactctcttatcatattttcccacaggattaaataaatatgataccttggaaatacttccgggtgaaatactatatccatgcgcttgcggattatatctgtaataaagaataccgagtaatatttcaagagccactagagggaattatatttctagtaatgttgttaagaaatatcaacaccacgcaccagatctatgcgtggggagggcggccagccaccggatatgtgaggcacacagccgccgctaccggttccttgtgggggttgtccaccacccgccgtccatgcccttcaccgccggatggggccaccgggtgcgggggaggatagagaaggccgccgcgcaccatcgccctcacccgctggtgcccacgcctgccatcgccgtcgtccacgcccgccgctgccgccaatgctcaccgttcaggacagaggagaggggaaaagaggagccgggaaaggaagagattcggtgaggccgtgagagaggagaggagtggtggagatgagtgggtggaaggggggccggtgaaggggagaccaaataaaatgagtgagaagagaagtgttgttgcgtacgggtgagttaagaccccgcatgtgaaaatccttattttcgcgtgccgatgttttaagtggtccgtttggaaaaaaaataatttttgtgtgtgagtctattaaagagccgtatgcgaaaattggggtcaatttttgcggacgcagacacttatggcccgtctacaacctattagggtgcttgtccatgaaaatcatttttgcactagtgtaattcaagttccaagcgtagtcatcggagtgtaatttagtttttccctgctgattctagactagtgcttatcacggttactcaactgatcggtaatgcaaaaaagatattcacgtctgctcaggacgggaactattatttaatgaaggaaaaaatacgaattaccccctgaattatcgcggtcgacggaattactcccgtaaatccgaaaaccagacatcgttcaccctgaacttttaataccggacaaattacctctctcgacccaatccagagctgttttgttctacgtggcgtacgcgtggcagtccagtcagcattttatttataaaaaaatatgggacccacctgttatacccctatcacaaaagcataagtccctatgagagaaactaaaatttttgtgagagggactatagtccctccttcccaaacaccactttttttccttcttccttcctaaacaagcagtgatctgatgacattttcggcccagggccgtatatggtggatgattctactctacttttaattttatttgacgcgagtggtttctacagctgacgtgtatgtggtcaacgtaccgtttcaaattgagagagtttgtagcatggacatttttgctactgtgccacctctgtttcgtacgggctaataagtcactactattgaaactcagcttcgtcagttcacaaccgtgctaagctctatattgccacgtgctaagcaaatttaagtattttttttagaatcacacagtacaacgcaaacactcacaatcactcacaacgtacacgcactcgctcctatgaacgcacgcacgcaaaccttacccctatgagcatcttcgaagactgggccggcaaaatataatttaaagcgcatatatatatatatatatatatatgaaaattatatcctactaccgagagtaaatatacatgtattacaattcattatgtgctcgctagctacgacttcgacgccggtgttatatatgtcagaagaagaaggaccggcgttataaattgtcgatccgtcgtagtagaattcaccgtcgggatcaagaacttgttcgttgatgaatcgcatcaagttgttcttgagcagccacgataaatttcttgtgtgtgaggttgtccctcatgtgaataacctatgaatatatgaaattaataaacaagaaattgatatgtacgtaatgaaattttgaatggtttatatgtacattgtgctctcttgtggtatagatttgggttgataggatgtgtatacagtcgggtacaaaaatttgcatacggactttttaacaaacagatccgcatacaaaaacagacttttttttatgcctcttaacaggttcgcttgtgaaatgaattttcgcatacgggcctatattaattggatacatttcaaatctctttacatataggtcttctttgcatgtgataaaaaaggtgtgttcacgaaaaaacattttctttatagtggcatcctatatatttgtaaagggtgtgtttccactaattgttatagtattatttctgttttttctcattaaaccacatcatctcaagtgttcctaatgcttggattattgatctatggtacaaatctttattatgaagtcatatcatcttaatcttatatttggatgattcatctatatcattatttttcatctctaattgagccacatcaccttaggctatatctatagatggccatatggcccgaggcccacggcccggtccgaagcatgcaattttggcctggtccaagcatagcatgactcgactagggtcgtgcccatgccggcctggcccgacagccgggccgtgcctgggctgcaccctcagcatggtaggccggcccggtacggcccgatcaaataaaaaaatataaggatgcaaaatagacttaaataatcgtataaggcaaggcccaagacaagatatacaagatagatttattttccagccatttaaacacagcgcacattgttgagggaccaaaaatagactttttctgtgaggaagcacgatagaccgtcgtgccttcgggctcctcggcccaggcacggccgggcttgggccgtgccatgccgggcccagatggccatctatagatatagcctataggccggccacaggccagcccctatcaggatatgcgtttcacaacgattgacagcgaacactggtggtgtactgtgcacagatatgcgagatgtgtgtgcatattcttcaacgtaatcgatcgaaaattaacgaccagtgtggcctcttggcgtacgtgtcccgtcccacccgctcgctctccgggcccgggtcggtccatcgccgcgcgaccgcgagctatccatcgatagacgccgcgtcgctcgtgtctcgcgagctaccgcgcgcgtcaagcgcatcgcagcaggcgcatgcagcgatccacccctcgcttttcagttttgtccccgtaatccaccgtactatacggacgacgacgcggtgcccgccgtgtactcactcgcgcgcgatcgccccgcggacgacgcagccgccacacggacgacgcggcccctgcgcacgcacgcgcaccccacgggaaactacgcgccccgcggtccgatcgacctgcctatatggctatataggacctgcctagacgtggtcgcgccagccttcaattgatcgatggatttaattaacagcaggagtagctaccaagcatttgcaggggtagtagtgaccggcctattggctattgcatgagttttccaaacctggggccggccggttttgcaaaccagccctgggaaaggccggacagctgagctaccccaaagttcttgcacaatttttgacaatttgaccctctgcaaaaactaattttgcaaatgaatcgtgaccaaaacttatttaaaaaggaaaaagtacgaattaccccctgaactattgaggtcgaccgaataaccccctcaaacttgaaaagcagacatttcgtacccaaaactaataaaaccatgtatttaacccccctaagctgatttgggggcggttttgactggggaggtggacacgtggtcgtccaacgtacgtggcgacccctgccatgtcaacctagccccacacggataacccgaccggcgccatcccccttactctctctcgacaaaatttcccctttcctctataaaccctagtcggcggcgactagggcggcgattgcgggggtgactccggtgacggtgggcggtgacttcggcgacgggacggcggcacgctctgaggcagagagggcggcgcgttctcaggctgtctcaacccacgacgatgtcgaggagctcaggtacgtcgcagggcttgtcttcgtcttcttgggctggacgtggtgagggaggaaggcgtcacctgccggtgccatatagggaggggcctcttgattacgagcctccagttttttgtgagtgtaaaatgaaggcagctaggtggatttcctggagtcccagtaaccccgggaggagatattttacgtgctacaatgcatgtgtgagtaaattttcgattgttcgatttatttttctgatttgtttggttttgaactgattcagtgtttcacttgatatattctgatatattatgtatagtgtggggggtgcgatttttggcagtggtacgatgaaaagtcctgaccatattgaaagcaatttttgcttgatttgaggaatgctgtgtggtctggacgagaagaaatcaatggattggaggctgcactccgtgacagcaagaatgaagtcaggtagaacagggtggctgcacagagcagagaaagcaaagaaatggaatccctaagagcagctttacagcagatagaagctgcgaatgctgcttgagttgatagggttaataggcagcagaaatgtatggttgtgttgatgtatgtgttagcagctcttgttgttattatggttggtaataagtacctaagatcctagtgcattcctgaacaaaaaatgtgtggtgttggcaagggttgtatggtggcctgtaatggaatttggaattaatggaagtagaaatgatgcttttgatgaacatcagtatgtcatagtgactctttatctggagtaacaaatgttgccatagaaacactttgaatcattagttgttggaagattgcacaaaatgtgggcataaaaatgaatcatgatctgtaaaaagatatgtatccatagaacacattgaataattagaacgtgaagattgtacatatgttgccatataaatcaatcatgatctggaatacagaagttgccatagataggtattgaatcattagaactggaagattgcacatatattgccataaaaatacattgtgaatcatggatctagcataacatataaattcttcattgtctaaaatgttgccatcaacttacttagtgccacatgtttgacattatagtaaccactttacatcaggtaatacacaaaagatgacagttagtgctacatgtccaaatacagaagttgagcaccaactatcactacacaaaatatggtgaacttctgcatattgcttgctatcccagtaagcatgtccaaaagtactatgtatctattgtatctatcctactcactgtcctgatatgttgagctgagtagatcttctaactttcaacttctttgctggttgcccccctgaatcatgtgcagctgcggtggaccttgtccttggtcttgtagatgttgatgtcattgccaattgttgccatagtacataatatttgcagttaaaaaaaaagatacattggaaatcagtacaaaaataactgcagttaaatggcatgtgtggatgtgtggcagttgctcactgtggggtgtagaatctgtgttggcacgtgtggagctgtgctgagaaccctgagcctgtaaaaatgacttaacatcagaaaaatgacagtgaaattagtacatgtagatgataatctatagcatcttacctgcacatttgtctgtgcttgtgatcatttcagacatgatgccttgttatgaccagggagcttgcacaatctgcatgtcatgacagacccaaccctagacactcttgttgcttttggtttctcattgggttatctcctcctatcttttttggaaggctttcctagcattttcacataaccaggtgcttgtgggctaggcctatctgacttgggccaactctcaataccctcaactgtatctaggcagaacctgtatgtcttcttgaatgagtatattgagtagcaagggacaatgtaactgtccaggcagttggttctaaaatgcatgcaggctatagcatgacagcatggtaaaccagccaactcccagtatttacatgaacatgtctttctctcaagatcagcagtgaacctatgagagtgaacctatgagactgatgcttcagctcaaacttgtccatcccattactgattgcatggtaaacccctgattctatgatgtatgcattcagcttcttatgtatgtttgggcaaactgatcctacccacttgtccattatagacctttggtcatgtatcctaaccatcacttttcttctaatagattccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttggagcncagngctcgaattggcggtatgtactcggacagct

SEQ ID NO: 18378 - DNA, 759 bp, Oryza sativa
  unsure (1)..(759): unsure at all n locations
atgagtgatcgattcatatagggcgaattcgagctcggtaccctatatatatatatatatatatatatatatatatatatatatatatatatatatatatatatatatatatatatatgaaaattatatcctactaccgagagtaaatatacatgtattacaattcattatgtgctcgctagctacgacttcgacgccggtgttatatatgtcagaagaagaaggaccggcgttataaattgtcgatccgtcgtagtagaattcaccgtcgggatcaagaacttgttcgttgatgaatcgcatcaagttgttcttgagcagccacgataaatttcttgtgtgtgaggttgtccctcatgtgaataacctatgaatatatgaaattaataaacaagaaattgatatgtacgtaatgaaattttgaatgggttatatgtacattgtgctctcttgtgggatagatttgggttgataggatgtgtatacagtcgggtacaaaaatttgcatacggactttttaacaaacagatccgcatacaaaaacaggccttttttttatgcttcttaacaggttgcgcttgtgaaatgaattttggcaaccgggcctatattaattggatacattccaaatccctttacatataggtcttctttgcatgtgataaaaaaggtgtgttcacgaaaaaacattttctttatagtggcaggggatcctcagagtcgacctcaggctcagcgagagatctcagtttcatcacn

SEQ ID NO: 18379 - DNA, 1443 bp, Oryza sativa
  unsure (1)..(1443): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtaatccaccgtactatacggacgacgacgcggtgcccgccgtgtactcactcgcgcgcgatcgccccgcggacgacgcagccgccacacggacgacgcggcccctgcgcacgcacgcgcaccccacgggaaactacgcgccccgcggtccgatcgacctgcctatatggctatataggacctgcctagacgtggtcgcgccagccttcaattgatcgatggatttaattaacagcaggagtagctaccaagcatttgcaggggtagtagtgcccggcctattggctattgcatgagttttccaaacctggggccggccggttttgcaaaccagccctgggaaaggccggacagctgagctaccccaaagttcttgcacaatttttgacaatttgaccctctgcaaaaactaattttgcaaatgaatcgtgaccaaaacttatttaaaaaggaaaaagtccgaattaccccctgaactattgaggtcgaccgaataaccccctcaaacttgaaaagcagacatttcgtacccaaaactaataaaaccatgtatttaacccccctaagctgatttggggccggttttgactggggaggtggacacgtggtcgtccaacgtacgtggcgacccctgccatgtcaacctagccccacacggataacccgaccggcgccatcccccttactctctctcgacaaaatttcccctttcctctataaaccctagtcggcggcgactagggcggcgattgcgggggtgactccggtgacggtgggcggtgacttcggcgacgggacggcggcacgctctgaggcagagagggcggcgcgttctcaggctgtctcaacccacgacgatgtcgaggagctcaggtacgtcgcagggcttgtcttcgtcttcttgggctggacgtggtgagggagaaaggcgtcacctgccggtgccatatagggaggggcctcttgattacgagcctccagttttttgtgagtgtaaaatgaaggcagctaggtggatttcctggagtcccagtaaccccgggaggagatatttaccggcctccatgcatgggggagtaaattttcgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgcggataacaagaaggccgccacgatc

SEQ ID NO: 18380 - DNA, 1033 bp, Oryza sativa
  unsure (1)..(1033): unsure at all n locations
aggctgacgactcgttgactatagccgaattcgagctcggtacccaaaaggtatgacagagggtcgactggaactattgaaagatatcagtggttcttttaggcaaggagtacttacagctcttatgggtgtcagtggtgcgggaaagacaacactgctggatgtgttggctgggagaaaaactagtggatatgtacagggtagtattaccatctctggctacccaaaaaagcaagaaacttttgcccgaatttcaggatattgtgaacaaaatgacatccattcaccaaatgtaactgtctatgagtcccttatgttctccgcatggcttagattacctgttgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactatctcgttcataactcggggaggcaaatccgtgcggtgaataattggaggacaaatatcttttgacacaacttccccggtaaatttccggggagcaatacctgggccgaataatatcgctgtgacatatattcgcggggaaaaaaattgtgtcagcaaacatcgtggggtagaataactcgcgcgagtattatatctgcgggtaatatatttggggcgtaaataaatacggggggcaagcaacccccccgtaaataattataggggcggcccacggtatggtcg

SEQ ID NO: 18381 - DNA, 733 bp, Oryza sativa
  unsure (1)..(733): unsure at all n locations
ctgcgtgacggncncactgatgtaccnnnnnnnnnnnnnnnnnnnnnnnnnnnnnnnnnnnnntacattcgcataccgattaggagtggaacaccgcgtgactgccccaggcgtcgccacaaactgagcaaccctagaggtggccacgagctcgtggctgatgcggcgacctcccgagcggcggcgacctcccgagaggagggccgatgcagggctgtggtcccaccgacgaactatcctaccttctctctcctatcgtacaatagaggcggcgggcatgggagttgcgcagaggccgcgagaaacctctcagatgcagaggtggcggaccaaagtcggctcctcccaccaccttttggagcctcctccacctttcccatctgtgtgtcccttcttcatcccctgcccctagcgccttaaccatcccgtcgtccagatccggccaaggaccggagcagggttggaaatttcggactgaaatttttgaaatttcgaaaattttggtcatttcggtcacccccgatacgatattatttcgaccgaaatttttcattttttcatgaatttgggtaatatttgtccaaatacaactaaattttgcttaaaattccggaaatatcatatcgaaatttccgaaaattccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18382 - DNA, 733 bp, Oryza sativa
  unsure (1)..(733): unsure at all n locations
agagcgtnattgatgatacaccttcatgcttgcctgcacgcacgactatctatagaggatccccttgaaaaaaaaaacataagattttctttgctgtcccaacttttttaatggatataggtgagacacaaactgtctggtggttgggtagatatctagccgccgggtacctcatggcaatatctggcgctccagaccagggttgactctatcgggtgacgcttttgtatagggggtcaccgaaatcccgaaattttcggaaatttcgatatgatatttccgaaattttaagcaaaatttagttgaatttgaacaaatattacccaaattcatgaaaaaatgaaaaatttcggtcgaaataatatcgtatcgggggtgaccgaaatgaccaaaattttcgaaatttcaaaaatttcagtccgaaatttccaaccctgctccggtccttggccggatctggacgacgggatggttaaggcgctaggggcacgggatgaggaaaggagacacagatgggaaaggtggaggaggctccaaaaggtggtgggaggagccgactttggtccgccacctctgcatctgagaggtttctcgcggcctctgcgcaacttccatggccgccgcctctattgtaccaaaggagaaaggaggtttgatagttcgtcggcgggaccacaaccctgcatcggcccacctctgggaggtcgcccgcgctcgggaggtcccgcataag

SEQ ID NO: 18383 - DNA, 706 bp, Oryza sativa
  unsure (1)..(706): unsure at all n locations
ccgccgttcgatgactaacccatnnnnnnnnnnnnnnnnnnnnnnnnnnnnnnnnnnnntgtggagcgctgcgaggtctgttttgtctctaccgctatagaactccctccgatgagctctctaatccatcctctgtctcccacttcgatgcaacggcaccattgccacaatcagccactgccgtgtgttggctttctctcactgccatcgtgcacctttgaccttcctacccatccaagccacttgtcacactcaccgagtcaccatcatccctgcaactccttgctgtcaccagccgttgattggggacggtcaaaccctcccgtactaggccgatgcggctgcgatgggcgggccaactccgtgccaccgagttgcgttagccgtagaccaggtcgatgccttatgggccagcctggtagcccacacaggtagtggcccacctcattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18384 - DNA, 849 bp, Oryza sativa
  unsure (1)..(849): unsure at all n locations
agatgttnaaaggtacagacactctctatccggntcctacatgtttgtttatgaagtcatggagctggtggagattctctccttaaaagatgcactggttggattacctggcgttagtggattatcatctgaacgaaggaaaagactaacaatagcgggggaactagttgcaaacccatccattatatttatggacgaaccaacatctggacttgatgcacgagcagcagccattgtgatgagagcaataaaaaatacggtggacacaagaaaaacccttgtttgcacaattcaccaaccaagcattgagatatttgaatcttttgatgaggtgaatgaaactataacaatattgtgcatttgatctttcaagaaaaaaaaaagtaaatcattggtgagttaatatttgttgcacactcactcaatttattctaatatggntctttgttgcagctcttcctaatgaaacaaggaggtgaagagatttatgtaggtcctataggacgacaatcatgtgaattaaataaatatttttagggtagaaaaaacacataaaacaatacaattttgcattttttctgtacgaaacatgctattgaaactcttttattttctaaagctatccaggtgtcagcaagataaaagaggctacaatccttcaacatggatgttgaagtgactagtacaacgcaggaacaaagaactgcgtgacttttctcaatatacaagaatctgagtatataggaggtattggtagtgctttaatgttgnccaataacatacatctatgtgcaaagccaacttctaagatgtacagatatccgggatgtatgtgtagaaatggttcta

SEQ ID NO: 18385 - DNA, 766 bp, Oryza sativa
cgtggattgaatccacttgtagcccgccacctctttgaaaaccattttgaatgctgataactactcatagcatacatgtatacgaagctatcttcgatgcactcgccaggggttctcctcagccgctggtggcctgtgtcgggactggctaaactattcactatgagtacaaattgcactgatagcgcaccatatgccgtgagatataccagacacatgcgtcatgcgaaaacaccctattatgcgccattcaccattcaccctgcacaactgcagcgaagggcgatcgatgcaatcctcttcgatgatactccagctgacgaccggacgaagtgctgatatgcgacttataagagtaactccctaggttcccagtaacaacaattaaaaactacagccatatacaagtagagcaactctcattctcatactaaaatatctaagctaagtggaaagaaaatagaaggagaatcttttcctatacttctagtatacatagtatacgtacattctagttatctgattaactagtttaataccctctatccgatgccctgctggtacatcgagaagccatccctgactgtcgagttccttacgacagcctatcattaccatacaaccggggctaaatacggaggactaccatcctcagtaaaataacttaggactatatacacgcgccgaggaatatccggactgaggtgtcactatcaatggcccaactctcattcggagcatattacccccaataatgatattccgt

SEQ ID NO: 18386 - DNA, 5901 bp, Oryza sativa
  unsure (1)..(5901): unsure at all n locations
nnnnnnnnnnnnnnnnnnnnnnnnnnnnnnnnnnnnnnnntagtgcaattaatgttgggacattaattttggacaaagtcatgctggtggagcattctaggagaatgtgattcgggcttgttgcaggcttgaggcagcaacctcgaaacacagaggcatctttagtattcccaataattgtgcaaatgtcaaaagtcagatcctagttagattagtatacacaattcctattagacagattttctgcaataaagcacaatatcatgtagatatatacatatgaaatgtacaacactacaatctttgcaagccagcaggtgcctcatttatcacatctgcgtgcaagtcagtgcaatgcctgatgcaaatataatttagaacgacagaactcaaaaaagtatttaaagtggcaatgcatcaacacataaaagctatgaacaaaaggcgagagcaatataaaatatagtacctgaagcttcgcaaaatctttgttcaaatcaatgcccctcccaagaatttgtcctcctaattcagcctacaaaggataacaacagttgcaacattaattgcattaacaagctcatataagttaattttaaataggcaattagcaaatatccaatttagtttagtttctaaacacttgccagtataatacaggaatatttgtcataagctaaaaaaaactaggtagcaaccagccggctccctctggcaagtagtaaccagctagttcccttcttcaaacaaaaacccaataccagacaggtgagaactggtctgctccagaactgcaacacccgggtacactgtggtataagccagaaggcccacaactatgctaggagaattctagaacgatgcgactatgcaagttaattaacctggaaatggtattctccatttaatgctgagccagaatcccgtacttgatcgcgaaatactacatgttggtcctccaagcactagaaatagcaattgcaaattacaattcaattaagcaaagttaagaaaagaaataacacattaataaggacactaaaatggaatataagtgcagcagcagcatctcttacaagttctctaataagacttataacagaggacaacctatccaaagcttttgaatgatcctgttcttttaatgtacttccagatggctcttccatagaaatatcctctgagagagtaatatcttcgagaaagccatttccactcccaggaggcttgttcacatctttattaagaactccagcaacaggagccatgaatgacaagtaattgcctgcaagtcagccagataacaggatttaaggcacatggaatttctcatcagtgaatgctttagaaaaagaatgacacctgtaaacacggaattgtaaaacaaacgtaacttttcaagcttgcaataatcaagatgtaaaggattatactcactttccaaattctggagagctttttcagcagctagtacttgggcttcatctcttgtttttccaatgccgatcccgattttttcattactaaatagaacctggaacatcatatgtataggtaacatgaggatcacatgattaagtagagatatcacagcattgctatacaaatctggtaatgcacccgcaagcaaacagcttcagagcaaaagcactggactgatgctgaagttgagagttgagacgccaaaggaaatgtgtctcaacattctaaatatatatttttctcaattagaatttcagcccaagctgttgccaagaccacatggaaacgaagtataatatgtaaaaattcaaaatgccaacctcaacagaaaattgcatgttttttccactgcttacagtagacctgaactccacctaatgaagaaagaacaggagattactctcagctcataagggcaatggcagaaaacaaatataatcttaaagatccaaataccctggattcgcacagccgtccaatttcttgcaacaccgtgacaaataatgagggggttgttgccaatgatcccccgttagattggatatttgtaccacctggaatgccacggagtgccactccgtcgtcatctacaaagattggtttatgttactcgaagcatcaaattacagatccaaaacaatatatgaattgtacttctttaataatagtgaggtacaattaggattttcaagcataatgttgatgctgctgcatttcatagtagagtactctttcctttacagggaaaaaatggtacagagaaaaccattccctcttttaatgtccgcaaggtaataataaaaaatgactaaagtgatttataaatgcaagggttcaagaaagcccaggaagaagaaccaaaagaaagccaataaagataatggacatgaggtaagtacctgacaaacgggttgatgatggtatttgtttctggtctctaggatatgcctgaaataaggaacacactagcatgatcattatatactagtctattacaaactgataaagaaactagtgatgattttgctagctaagtgatagaactgtggacttaattttgatacaaggacaaatccaattgtaagccaaagaaggatcaatttgatacacctacatttcttctaaaatgaaataacacaaagtagatggttataaataattgaaatcaagctacatgacagcatttatattatgctgtataacagcgcttaccatagaaataggcatcattagctgatttgatctaggtgaaaaaaaaaatcaagtccctaaaaatcaaagcaaagcagaaacgaagatcagcactcaccagcccattcaacctcttccctacttcagctccactcataccctcaggtataggggcaacatccttattgtttggtgcaaaattagtgtcctggaacaaaattagcagttggataaccatttagaaaataaacacacacaaaataacaacgattcaataatgttacctcacagactaagtagtcaccaacatcaggagcatatggaagatctagcaactcattttcatacattagttcaaacacttttctcaatagattttcatcgaactctctgcaatgcattgatgaacgcaaagaataacattacaacagtaagcatgatatcatcagaatgcacatacggtatcttatattttttaccaacctgaagaaaccaccacgaacattgcaagcaacatttcttgcaacacaaagcacaggcacagcatttgccatctaaaatatgcaaacagggtccagaatgagatattgttgaccaaaaaaagtgtaagcaataaaatacaaataaatacctcagcttgtggggcataatatggagtatatgctgggacaacatgaactcgaggttgatccttctcatcccaaacctgcagtcggtcatcaattaccatggccatcttcggatggcatcctttgtctttaaaaacattctgcagacactttttcgaacctgccatgaaatagaataatgaataatattggtggttatgtccatgaaattatggcaggaacatagtccagagctgagacaatagagatagtaaagcgaagatctatgttatgtattatccatataatgggcaatggcaaagcgcaatttctcattcacttaagcattctacacaaatattatattgtttaaactaagaataagttttatacaaatttaaacaatatttagtactacttatgcactatatttgaagttgtaaggataagaatgaaatacaatactaagggaatgaacgatacatgctagaaaaactatgggttttctctctgggacactaatctgcaataccgaacccattccttctcaataacttggaaacacaacataatttcattgtacatgaaaagatagataacacagaatattcgtgttcagtgttttaaagtagctactctgtgtttagtaacgatgtcaatataacaaaacatgttgagacaagaaagcaatgaaagatagcagaaaaaaaagaacctccaatttcttgaaaatttacctgactttacacatactacacgctctgcaaggttatgagagcttatcaagttggcttctggatcaagaagcctccacatctcaagagcataatctctctcagccattgtacatacatagacctcaaatcgtttgcgtcccttagcagtcaggtaacttctcaaatcctcccaagcaggccttagctttacaaaaacactagtatcgcgaacctgagcagagtattaaaatcagacaggggataaggtaatcacctcaaaaaagggaactaattacagaattctacaataattaaaaactctagttatctcaaaattttgaataactagacatatgagaattatactgagcccattttcagtccagaatgacttaatcagcttgattaatcgtctcagataagcattacaaaaataattactaaaatagaatctcttttttctaattggcagcaaacatatgagctgataataacacattgtgtgtaggttgtcaaactttgtgttaattgttatttcatcatttcccaaaccatcaggctacaagttcatttctgcatctgttttattcataaacatcacatgtacaaagcaaattatgtaactatgcagatcatacagacctgtaggtagaaacaatgagcctgaacaaatatgtcttatccgaggatcaaaactgcagcaattacaagtcatttatagaacttatttttgtaccatcgctaataaccaaatagacatacagcatgccttttgtgggcagcaaattggagcccagttctatttttccaacccaggaataggtccaactgatttcaaagtgtaattctagataaccccaggccaaaaacatgcacacaggcaaacgataacaacatttcatttaaatgaaatatatttatacatgatctatctgaattgtacctctggatttatgcgagttagaatcgcattcctttctggcagcctgataacaggcccgagaacacgctcctgcccaccagagataggcagaacttcctccttttgggtcccaacgattctgccattatctgtaactgtatctgtgtcaatgaactccttgagcagctccctgtcctcaatataccgcttgatttctgcagacatccctgctatcctgacggggtcgtcttcaatatccatcctacgggaaagcatctcgatccggtcctcaaaggacttcattgtgttagcgacaataagggtttcatcgagatcaaatacgatagcaaggcaccgcaagttcagcatcccaacagatgctgcatagatcccagagcgtactgaacagcaccaaaagcatggcaccttctccaccttgctcggcattgccactaggtgtagctcctcatctccaactactaccactgcgctctacacaaacccaaggagacaaaaaattttataaatcctattatttcgtgcccctgatggaaatatcatcaatgggaaacatcatccgaacgaatcaaaccacatcaaacacacaacccatcgaagatccataatagaatgtgttaaacgctttgattactggtgattgccccaaaatttagaagtggcgctaataccaatttccaagtagtcgctgtaacaacttatttcgcttcgatttcgaatgggagtaccagctatactaatacaaagcgatggacatgatgcgattgtgagaaatngcgtgggggcaaaccttgtactcgttgaagcaagtgaggtagaggcggtgtaggctcgggtggggaggcatcagcttggcctggagcttgcatcgcacggagaagggcgcgatggtctgcaggatggcgagcggcgggcaccgctcgctcgtcggcgagaggtggctgatgcggatctcgttgctcgg

SEQ ID NO: 18387 - DNA, 7160 bp, Oryza sativa
caaatctaaaagtggcaaatagttaaatgccccaatatggggtacggagtacttgctactccctttcattttcatttaggcggctgtattgagttcctctgccaaaacttttttaagtatatggacaaacatttgaagtattaaatatagactaataacaaaacaaattatagattccacatgtaaactgcgagacgaatttattaagcctaagtaatccgttattagcaaatgtttactgtagcatcatattgtcaaatcatggcgtaattaggctcaaaagattcgtctcgcaatttacatacaaactgtgtaattggttttttttcccgtccacatttaatgctccatacatgtgtctaaacatttgatgtgttggaatttttgaaaatttaaaataaactaaacacggcctcactttgattgtcatatttcaaaaaatcagattttaaaatttgatcatcacattttaaagtgaatggagggagtaatacaaaatcaaaaaaagactaaaataccactatttttatcaaatctcaatttaattattcttccttttatttactcctagtgaatttatctcatactttcacaaactccgatttgagacaaaagagaagagcaaaaaataaataaatttactctaggacgaaagcagtacaatttattactacatccgtctaatatattagcaaaatcttttatattttaggatgggtatagtatcgtattgaagttgatcattgcaaaactgacatatggatctcactttttctagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactctagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagtttgtataaccggtgaataaatggtctccagtactaatcaaatattatgatcagaaagtgtagtgaaaaaagaagatgcaggaatatgtgagaaaaaggaactgaaaccaaataagttggccaatctcatgttacttggccgttaatactagtactactccgtcgagtacacaatgaatgattcactgctatctagtttgtggttctaataaatcgaatacattatactcttcatatgttccttgtataaacctgtttgtttgtggttctgtgaatcaaatgccatatacatgacattcgtgtttgtgctcctcatcttgcaatttcatagcaacatttttctactcagtatgcctagttgtcatggtgttttcacttgctgaattgcttttctacatatttttggctcttcttgtactgtatgttcagacttgcctttaacatggataattgaagtattgaactaacatgaaaaatgtgatgtcctatgcttcttgatcaacattcctgcagagaaccaagtcataagcattgactgatatttacctgccaactatcactgagcattttcagacacatacctttcatgcttcaacttttgtatgtttgtgctacaattttcttacaccaaatcgcctgtctctgctctggaaggagcaaagcgcttcgaggtaatcagcctccccgaaatcaggccacagcgtgttggtgaagaagagctccgagtacgctgactgccacagcaagaagttgctcagcctcagctcgccgctggtcctgatgagaaggtcggggtacgggaactcgtcggccgcgcagctcgtctcgagctcgtcggcgaacagcgcctcgtcgatgtcctccgccgcgagcgccttgctctgcaccttctgggcaagcttccggcacgcctgcacgatgtccctcctcccgctgtagctgattgccagtgtcagatcaagctgtgaattgttcctcgtggtctcctcggcttctctcgcaatcttctgtagagaaaccggtagccttgagctgtcaccgattacacgtagccgaattccttccctgtggaaaaaaaaaatcctcattttgttgtccacatcaccacatgacatgtacacattagactttggcaggaaattatactggctcctgtgaaaattgaatctttttcctatgaatcttgcaagaaattcctattacaagctggtaattgagttgctggtacgcccggagcactgtgggctttgagcatctattggcgaacttccagttccacaaagccaagtgttgtgaacgcgtgaggcattaactaattatttaatttgcaagtacggatgtttacctcagaaactcggcgacgctatcgtggatcacccgctcgaacagcctcatcaagaagtccacctccacctgcgaattccaacatggcgaggacgcgtcaagctcggcgaaggcagagatttcgaaggaatcggcggcgaggcgtgtgtaccttggggcggctccagttctcgttggagaaggcgaaggcagtgagcgcgcggatgccccaggcgcgggagagacgcaccgtctcctccagcgcgcgccgcccggcctcgtgcccggccgccgacgggagcccccgcgcccgcgcccaccgcgcgttcccgtccatcaccaccgccacgtgccggggcagcgactccgcccgaaggcatccagggaggagagactcggccgccggggctgcgccggcgcgcgggcatgggcatggtggtggcggcgcggggcgcgtgctgcggcgaggggaggtgggtagctgatgggtagcagctggagagtgggagggcagcatggtgttggcggcttggcgcattgcccccaaactccgacaaaaggatgaaaagctctgcatttattaaccttttagaattgtttttttcttttttttatgatgttgtgatttcctggggaattctaaacaaattgcaagaaattgatttacaagaatactacgggacgatatctcgttcgaacggtatcgtgaccttagggtacggacaaatttggggatagacggggaagtatagtttcccgcctatcctgagagtgagctcaaaagcaaagtgagtgaaaagtatttttctctattgaacttgtccctgcttacaggatctaggtcggcttaaatgactctcaaccatacacttgagattacaagtttgcccctgagggcctacatattatcatactacccttataaagtttacaatcctaagagcattttactatattttagtggtcttcaagtaacatccagtgagagtagttggagtgatccctgttaccttcttgagacatgttcttttgtagttggagtgatccccagttaccttcttgagacatgttcttttgtagttggagtgatcccctgttaccttcttgagacatgttcttttgctcaatgatactttcccttgacttcaatcatccgggtagagtaatgtctctctcgtgagggcttgaatacatttttcccatcttctggcttctcacctgctaagtgaagagaattgtccaaacacgttgtgttgttagtaatataccccatcagtccaaaaatataacaacctttaacactcagtatttgttccaaaatataacattttttttcaccaacattctcttcccaacaattcacaaccctccatcgttcacttttcctaactacctccacttcttaaccaatcacaacctttccctatttaattctaaagaaaacccctgtgtacccctgaaagttcacctaatcccttctataccctgaattttgctcaatcccttacatacccctaaattttagtatggatcccttccatgccctttccgctagttgaccgttaaattcttatgaaaaagtccattttgccatttggtataaagaagtatataaattaatagagtatattgttggagcatagaaatttattatatgagactattatgtttatgagatagttatgcaccatattatttgcgataaatatacttttagatatgacataaaaaattaatacttatttatttttttagcatatgtgttctgatagtaataaacaaatctgttgtattactatgaaaacacatgctacataaaagaacttttaataactaataaataagtattaaatttttatatcatatgtaaaagtaaatttgtcacaaataatatggtgcatcacagactcataaatataatagtctcatccaataaatttttacattccaacaatatacttcattaatttattatgtttcttcgtagcaaagggcaaaatggactttttttcaaaagaatttaacggttaactaacggtcaactagcggaaaaggcatggaagggatccaaactaaaattcagaggtatgtaagggattgagcaaaattcagggatatagaatggattaggtaaactttcatagatacataagggattttctcttaattctatctactttcttaataactgtgtctaactctaaaacttcttatattctgagatggagggaatactgatttgagcaagtgaaactactcaaacgcactttccttggaataaacatttcttgggcaaatgcaaatgatcgatcaagggttgttacaggtcaaaacttcattcgagcagattgcatggctcaaatacgatttccttattgtgtgtgtttttgccgaacatagggatggcgttcaccccctactacaacaaatgggatgatactagttaggtataaggtcctgatatccctaaggtattagataatacttgagatctgataactataaggtattatacctgatacccaaccggtttcatcccgttcgaacgggatttcgtcgtacaacaacccctttatattcctttgtgaaggtgtcaataaaactgaaaccattgacacgtaggcctttttcctcttttcaagaaggaaagctctgtagtttaataaaaattgaaaagagtaaattgtattggtggtacacaaacttattaggtgggtgcaatttagtacgtaaacttgtaaaatgcttatttcagtacacgaacttgtctagttcgtgcgaacgaggaccaaaataacttagcaatgttaatttatgatgttcattaggatgtgacgtgcatacgtatagtgagtatgcataagacacgtaatatttataaatttcgtcttaactttatccttcagaatggaaataacgaatctcatatgtttctaacccttatattagtgctaagttttttaatctttctgatttttattgaatagatatgtctaatggcaaccttcttagatatatgtttacatagtatcctaatcaacccctaaattaataagattaaccatgtagtgtacttttcggttttctccgcacgcacctagacaaattcatgcaccaaaatgagcattttacaagttcgtgcactagattgcacccatctgacaagttcgtgtaccggcgatgcaatttactcaattgaaaaccattgacgtatataaaacgctgaatagtgtatatcctgcattcttgctctgaacgttgccttggctttttgctccatttctgagaatacggacgggcagttaaaggggcgttcctagtatgtgcgtacgccgacgcggtagcctaactaactctgttagttaaggataatgatggtaattaacaatagattttttattttattaggagattctttttcctaatagattgaaaaattttaagttacatttgaaaacttttgacttaagatttaaactttaaactcaaattttgaaaactttcaactcgaactttgaaagttttcaatttgcaagaaaattttttaaaactttcaactcgagatttgaaaacttttaactcaaatttaaaaactttcaactcgagatttgaaaactttcagctcaaaatttgaaaactttcaactcgtatttgaaaactttcaactcgaatttgaaaactttcaactcgagatttgaaattttttaaattaagatttaaaaatttttaagtcaagatttaaaaactttttaaaaaataaaaacacttgctgctagaagattaaaaagtaatcaggaaaaaaagaaaaaaaaaggaaagcgaaaaaaatcagggaagaaaaaaaagtggaaaaaaaaaagagaaaacagcggtggttagatttcgcgggcgcacgccgagtgggccgtatggaaaaaaaaagagaaaacagccgggagtgcgcgctgccggcgcgcgcgaattaggtttctcgcagttaaagcacgtactgtgtgtgtatcgctagacagatgcagaacggctgaagagcagtctgtctcatgccaatgtgcaaacctgcacatatggtcgcacgcataatgaaacgcaaactgcgcatgtggttgcttactgagaaaccagaaacgggagaatactgtgaatacctatag

SEQ ID NO: 18388 - DNA, 4145 bp, Oryza sativa
aggggatcaaccaatacaagaaataaacaaggtcaaacaatcaattatcagccatactgataggagacgaagaactgcaagtctacaacagctgacccacatcacaagaaaatacaaaatgagaggggctccagtagaattcgtcagaaatgttagattgctaagaggagctaatggcctttaatttgatatttgtgtcatctgtcaccggcatgctaggagtacaagtttgttatgtgcatcagactgtacagagaaattcgtgagaccttatcttcctaataaagaggactcatacattgtcaacctgtccctgcaagttactagaagatgtcaatgttttaaatgtgactaccctgattttccatacttccatgtgcaagccttccatactaactactcgagaagctgtcgcatgtgtctgtttgggaaccaatagtgaacgggtggactaaattccatacacgattgacaactccatctgacataaaggaaaacgcatcttttgcggctctttgacatgcttccagagctctagaatcaccaagcagttgttttagtgcttccaaaagttcatattctcctttgacctgaaaaacatttgcattaatcctcatagaatgaaaggggctgtagctccttgcgatgtttaggtgtaaaaaaaaaaagaatcacccatgcagtaaagcagcatacccacattgcaagcataatttattgaaagagcaagtagaaggcaattcatcctgttaccgtccaaactaatttccagaagtagggacaaggccaagtcaataattaacaaaatacctcccctaagaaggccacgaaatagtagtaatcccactcttaatcgaacatagtgcacaaatgatgcggcattttttgtgtcagttagataaataacaaagtacaagacagattatcacctgcttgacagctaaaggatttatttgccacatttcgaccagcatatgatagaagtgcccaacactaggacctgaaagacaattaatgaaactctagacattccgattttgtagaaaaagtcattcaaaatagtcagatgtgtcttgcactcttgcgtaccagtcataacagcgcaaccaactgcagcagcctcagaaatattatgtccagctaagccgggcaaaaaagaacccccaataacagctattggagtaaccctgtagagcattcttaattcacctattttccatggtatttcattcattaactaacattcaaaagaatatacacagtccatactccatactgaaaaaatgtgcaaacttaaggcataagagatagcacaaacctaacgtatcaaccacatatatactggtgtttgaagacaccacttctcttgttgacctcagcacaaaattcactttctgtttcttcagggtctaaaagaagatgagtaaagaactaaagatgtggcccatacatattatactatcagcattgaagtgagaatcatatgctacatgctctagaaccataagaaatttcaagtaatcgtatacaaacagttataagcaattaatttcaagcttcatacagtgaactaagttagttccctttttttcattacaacaatgctacacctatagattacccaatatgataatgtattaaaaaaaactaaaagataagcagtacaacccaccaactacttcatcaactaaacaggaccagatataaaagggtaaggaagacaattgacatacttgagaaacattcttgctgtcctcaggatgccttgggacgagaattaaaagtagagtaggatacgccctggttaactcatcatgaacacggagaatgactgaaaaagagaggaagcttgtcaacattgtttttatgttgagaacataagcatagtaaggcaaggattcaattattcaggaaagcataaagaagtcagcaatgactttagggatatcaatggtgatcatcaccataggcaaaacagctacatatatacagttttagtcctgcacacagttccttggaagagcagataatactgatccaataaaaagaaaaggtgggtgtctgaggtgcttactttcatcttcccctttgtggatagaagctgccatccagatgggcctattgctgaactgctgctgaagatcttctattgcagctacctctttctccccagcagcaatgtcaccaacagctaggtaaatcacatgattctctataattattgagtttgtgaccctgttatcttcaaagctcccaagataatccttgagaaatgcatcactcatatgtttatttcaaacatactctcatgaacataggaagccagagaaaaattggcatggcgcataccgtattttaaatcgccagcaaaatggatgatctgtggtggtgcatgaagtaattgaaaacgaacagcttgaatagtactctggaacagatagaaatgaatacaatggcaataattttacatcaaaataaggtttagaaccccaccactccataccaatgggataacaagtgatagtttggagagcatcaaagagactaactgcaaccctagaggcaaggaccaacggttgaaagacttcaatgacatgcgcgcatttaaaagaaccactgcaatctgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagacatgctataaattatttttagt

SEQ ID NO: 18389 - DNA, 12295 bp, Oryza sativa
tcgcctgtatctcggggatgattccattgccgtacgtcgtggcgatgacggcgatggcgttgaacacgccgaacacgcggtcacgggtgttggcgccggcgatcgagtagtccttctcgggcgctccctttgagcttcctgcacaaaattcgtcagtccaattttaatccgtcgcgtcgacaggccaaattaaagcccaatagctaatctaaataatgggccgggtcgccgggaaacctaccaaggtagatgcaggcggcgacggcgcagaagctgtaggcgaggcacagcacgagggagatgaggttaacgtggcggagagagtggaacgacggcatctgcgccaggatcatcatgaagacgccgaagattgccacgaacacgtacagcttgatcgtgccgcccgggttggcaatcaggtagatagcctgcaacgcgatcgagtaagaaatgtggattcataccatgtgcaattgatgaacgcgatccgatccgatccgacacgaaatcagttcgtggactaagttctgatgaagataccttcatgctctgaccggctaggagagtgcacgcgacgactgccccgaagcagaccaggaactggatcggcccgatgtagaagcgtccccatccaggccctgcatgcatcaccgtggaaaaattaaccatgaatctcatctcagtgacagtgattttgtcgcggtgatgaagatgaatatccctttcgaaacattttttgtcagatgcgtgtgtaattaaactgtatgaatctgctgccagatggcactaaggacgattcctttttcccaacacgtacgttaaacctgtgcttatctgtccaatgtcgtatcagctaggatgctagtatatgactgattctactacacctggtacagtgctactccctccgtcccaatatataagaatctagaaccgatgggacattttctactactgtcctgtccagattcgtagtactaggaaatgtccaatccagttctaggttgttacatattgggacggagggtccagttctaggttgttacatattgggacggagggagtatttaagattgacatattgacaagaaacggcgcgcggtgctggtttttttccttcgcaagcagtatcaatcgatttagacaggcaatcaagtggaaagctggaatattaaattccacagcaaatacttgccgacaaattcgtcaaactcgaccaattgcatgatctgtagtactaatgtgggaatactatccctttcgaccaatcaagtttttctctatatatccgccaagcgctaactggagttttaattagtattatctaaccagtggggattctttccctcgtcgactcttgacagtgacaaaatacgagccctagcagctggacttttctaacctgtactgtaccgtgttacgattttattgaatgctgcttagtcagttactgaaatcaagcaacatgtcggcttcagacgctgcactcactccggttgaagagtttaccggtccgatatagtatggccatacccattgctcatgaatgctgcagacacgtacatgtcgcaaactcgcaaatgcgaaatgggacttgatttggccaaataatacagctgacttgttccgcacaagaaaagggggcgggcagctgactttcttgtgaataaaacaggacatcaatgatcagtcgctaaacctgtcacgtctacaagttggtgttccttcctcccttcctttcttttctgaaagaacactgcacttggcgtttctgcccctatattcaaggtgacgacataggtgttgatgtattgactcatcctcatgtctcgtttgaacgcaagaatatcacaaactatgtaaatgcttcgaaagaaatggtccattacagaaaaataaatcccgtgttataatcagaggttgttttctccaaattctcaattcgggcctttaggagccagggctaagtgaagacatgggcgagagaatcttacctgcctcgtgatggatactagtacccactactgacttgtacagttgtactgtattcgtttttttgggtgaaggctgaatgccacgtccgtccattgtgaacgcccttactattgtattgtaatgcttttggtattgcacgtagtatgagtttgcgagacagttgtcagccaatgcaattttatatgcagattctcctccatctaccaattagcttggagttgctacgtgccttccttttaatcacttatgtactcgagtttaatgagtatattagcatcaacctactacattatttccattttaatgggaacctaactagtaaatagtaatagggtgtgttcagtacctattcttgctatagcggttacggctgtagcagtactaaaaatggctgtagtttacagcagcgtttaggctgtgtttagttcagtgtaaagtttagattttggttgaaattgaaaatgatgtggctgaaaagttgtgtgtgtatgacaggttgatgtgatggagaaggactgaagtttggattcaaactttgaatctaaacacagtcttaattgtggctgaagcaacaatccctgtcgatcaatctcattgtttaactgtaattacggatagataggtatacgagtgattactgacctaaaatatcggtggccatgtccctgaagcggagctggcggcgtccttgctgcgcgtggtgctcgaggacgagggagatgaggttgtacgagtagaaggtcacggcggcgccgatgacgaggcagatgagccccgccgcccaccccagcgacgcgaacgcgaacggcaggctcagcagcggtggcgccacgatggacgtcgtcaggtggtacccgcagtgcagccatgaccctgcgcatttatacagcagcagcatgatcagtttttttctgttaaactagctaaaggtactgtgcattgcggcgaatatcataagagataaatataaaaataaaaattacaaacctactaacgtagttagttaattaggcatattatgtcatatcaagtgcaaaaatactcacatttgaggatcttatggtctaatatgttaacttatggtgatggggaaaactcagacaccctcactaatatcattcaaagtagtatatcatagatatagaaaaagaataacattactcctgctagtagttagctaatctgttaatcctactggtattttttctgtttgtattagtcgctggatgatgataagctgattgggagaggcttccgcagctccactcggtcaaaagttgtaggagatgaaggattggcaaaagaaagttcacaggttagctaaacgcttggaagttggaatatggcgagtaaacacgtttctatcagtcgtttcaaaaaaaaaaaacacgttgccatcggaagaaaccccatccctccatcaaacattgatcaatcctgcacaatgcccatacctactttccaaagctgtatgtcttacacatgtagtactcctcagtcactaaacttgctttgacaatcgaaagataaaaataaaagaaattttgcagtcattaaaaaaaagtacatcgagatacctaaattttacattaaaatttttggtacttctagatacatttttaaggatggtaaaattatcctaaaataaagttgttgatactagtatgtttcaggggtcagcaaatcaacagggaactatgaggcattgggggcagtgagcaatttgattttgttaagcctgcagtctcacacctaattcgattttcctttttccaaaatagaccaaatatgatttgattagtacattactcctaccatattcctcactccattccaaaataatcactacgatgagtttccgtgtacaattttaattgtccgtcttatttatttttttaaaaaaaaataaaaaaaatataagtcacgcacaaagtactattcatattttataagctaatagcaataaaaatactaattaaatttttttaataagacagacgattaaaattaaaaaaaaacttataactgcgcttattttgaaacggagagagttctagctaaccaacctcccgatgccatttataatttcctcgagtcaagagtatctgcgctagtgcgcatgataatcaacgagatggtgacctgtaccagttctcctatacgatacagacatcacgctaaagactgaacgattcatgcctaatttatttttttggaataaaaataacaatacatcgttattatacttttatagttcacttaggtccatatattaatatattttctgtctgcttcaacaagaccaaatagacgtgtaaccatttcatggagcccgaaaggttgactaatacgagtactgtatcgtgatatgggggatcggctgagctagcagcctagcagaacaataatatgaattgcccatgtttacaactttacatgcattgctattgataataggcttgatagccagggagcccatcatccctgaagtacattttctcttgtctcttctctgaatgttgaaaaagaatagatgtaggcgtgcaggcaacggatgtaggggaacggaaaaaagcgagcaaagaaagaagagagtttttgttactacatccaatcttcatagggtaaaactgtgaaaaagtagtgcaaaaggatagatgggcagggaccattcaaacatctacatctgtccaagaacttttaatcagagttcaggagacgcacccagtcattcaagtagaacagtaacgcagtacccctcacaatggctgccgggtacatgcgctgaggaaaattaaccgaaacaatttgtaaaccatcatttttttcccgttatcttggtagtttgtacagtttttgggtacgattattaacatgagccaaatcatttacatacggatcatatcaatcgggatggcatagccaaatcctgcacaacaacacttcatcaaaccatcttgatatagcagccagaacaatctattaactcgtacatgttagttggctagttgctactgattagttagccagctcttttgcttattaatagctggggacaatccatcaacagtctagaatatacggcctccgatgctcccagaacacaaacaggttacgcttatatgtgcagctagccaaacatgcttgctgcctgacatgcgccaaagaggaatcaagaaagaaataacgaaagaaagaaagaatagtgggtgatcagaagcgagtaagcgagaaacaagagagctcatgtcagacacgaacgcacctttggactgaaggacgaagagagccccggcgtcgagcttctggccgacggtgtcgccgccggcctccatcttcttcgcctcctcatcctccctgctcggcgcccccatgacgcctctgccgtcgaacgattcggtcgctagctcttttgtcttgcaggtaaaaccaagggagcgccaaactacgggttgatggcctgaaactcttgggggactcggacgatacgatctacagttctacacggccgtacgttgtttgtctctgcctctgcgcggtgtttctcagcaggtgagcgggctctggttttgccttttgcgcttctactgctgaagctgaactgcgtactccatatatagagaagaagaagcaagcgcgctcgcggaccgggtggacaccgtatgacgcgcgggcgaaagggacagtgcggcctgtgcgcacgcggcacgtcgcgcgtgccacggcgggagaatctcccgcgcgctcgctcccgcgaccaggccgggcagtcggcagagaatcgctaatacgttaagatcacgaaaaaagtcatactttggaaaccaaaaataaaaagaaaatccgtcgagaacccaaacgaggaaaatttttattgtacattgtaatgcaagtatgagaaagtccatctagtactactaggattttaagccaaaggccgtccagtatcgtaaacataaaaaattgtcaacggactcaaaacttcacaattttattcgtgtacaacctttttgacaggcatggatcctctgcattacggcaacagagaagagctagtgctacacacactaatttgtgcctgctacattctttggtagccttggcttcgcccactggccactaccctctccttgccaatgtcacgtggccaccgaaaaatagaaaacatgtcagggaggggataagtacatactccgtggctccgtcccacagtgtaggaacctctaagacctattctagaactacaaatatggacatgagttttatcataggttgctatattgtgggacagaggaagtactacatatttaggtatgcataatgcatgtactagtagatcctattgtgtatgtgtaagttgtagtgctaaaaaaccttggatttttttatggtataaacaaagccattgtaaatctcattttgcattagcataaatgctactccctccgtttcaggttataatatgttttgactttgatcaaaatcaaactacttcaaatttgactaaatttatagacaaatatagtaatatttataatactaaattagttttattaaattaataattaaatatatttttataataaatttattttgggtcgaaaatattactattttttctataaacttgtttaaatttgaagcagtttgactttgaccaaagtcaaaacatcttataacctgaaacggagggagtaatatttgtctttcctagccatgttgaagaccggcagtttaggccggttagctgtatatagcataggtgcagcagagctgcgagctataagaggctgttcaattggtggagcattgcggtggtgacgataagtgcgaagagggtgttgtaggcgaaaacctagcctgaggtttctctgagccatcaacgccgatgcctacggacattattatcctctcttagagcattgttaagccatcatcgacacctttccactcattaacatcattcttcatgtcaaaacccagtccgaatggatgggcggtggtggcgtctaagatgtcatgatctctttggtggtgttgtttgggaagtttttttcctcgctttaccgtcttttcttagctttttcttggcaaatttttggttgacgtcatctggttaatgtgagggacgagcggatcttcttctctctcgccctcttcctcaaccactctacatgaggatgattaggaactcatcgatgatttgtctgagtaggatcttgcaggtctagcagcgatcggtcaaacttagcggcggtcggtttgttcctagtgtcttctccttagttgtgtagggagctgttagcacgtggtggttgtgttttgtttttttttcattggtcacaattttttcgtcatgtaactttgtaatttttctatgccatatcataagaaatttcacgttgtcttgtgcgggatcgttaaaaaaaaatcctcgtggctgctaggagtcacttattatcatcgaaaggcggttgatgtcaattatcgttttctaatcatgaaaatgacgttgtttccctatttaatgttacaaaatttaaaataaaatacaaaaaataaattcagttaattaaacttttgattttgattacattattttttgtttacactgtgaacagtactttatatttcatattgctttcagtttataattttcaaaataatttcaacgttttgaattgcaacagattctcacagtaaaagatggcattaaaatatactccagttttctttgtttcgattacaaactccaaatatactttctacacgattatttactttgaactatcggttccatgtataacgatcatagtattttgattaatagtctgcatacatttagaagacaatatacataattaacttagaaaaagtaaatagatttatttataatacgacacaactatatccctttgaaaataaatcaacaaaaattagttgctgaattttgccatatctctatctctgcaaagatgctcatccaataagccagatcgaactgttcctagcctctcatctcatcgtctgtttgttggtttgtttcaatcgcaaccaaatttgagttccgaagtttaattttagagttgatcttttttctttcgtaagtttatttaaactgctaaaaataccgttatttttttttaaaaaataacatttttagttcatttattcgtttacgacttagccgaaactcaactaatcaaaggataacatacaaaacggttaaaaaaattccttcggattatcgtgtggtttgcaaggtgtcgaagtcgacggatcgagcggcgagaccgcgagatggacacggattaaatggtgcgcgcatgtagcgcggccgagaggcttgcacgagtccgtggcccatgaggccttgacgtacgagtggcttatatgctcgccaacttggccaccatatatagcacagaagtgctcgtagagctcagagtactcgttttccttaccgactgatgcacctaactaatccgccgattggtgtctcgttctcatctctactagtgctgtgaccgtgcacgtcggtcgtcggagggcgggcgccttcatatcgatcgtgatcctgacgggacgtcattcccgggggtcagtactgttcgttttcagaggagcaacagagtacttcctccatcccataaaaaataatctaatagtatgaaatatgacacacagagcctgcttaggccttgtttagttcgcgaaaaaaaaaatttaggtatcacatcggacgttcgaccggatgtcggaaggggtttttgacacgaataaaaaaactaatttcataactcatctggaaaccgcgagacgaatttattaagcttaattaatctggcattagtatatatgggttactgtagcgcttatggctaatcatggactaattaggctcaaaagattcgtctcgcgattttcacgcaaattatgtaattagttttttattttatctatatttaatactacatgcatgttgtcagggttatggataccgcatacctaatagtagtcgactaaatctcggcaggacccaccaaatatcatgtcttatacggaaacaacctccggatatagaaggagtttcgtataaggaaggatgaatagaattctacatgtaaacgacatgtactactcggattgtatccatattggttttcttagttctatttggacaaggggacacctatgggtataaatacaaggccccctagaaggacaggggacacgaaacaatagatcaagacacaagatcaacatacaagccaacacgcctccaaatatcaacatcaaaaattagcttagacaaaccctatctggtacctgcgggggccggcaagaggggtcaagcactatctctgatctcgacgagttcgtgctcgaggaagaagactaccctgtcatcgactacgagttagttatctagccgtcaagtcgacgacagccagatatgttatcccacatgttgtatttgtgttatccagatgaataaagagcaacaccggtttcggccaataggatgtagggttattacctgacaattcaggggcccgaacctgtataaaaatcctcacatccgtctcttttacttaagtctcgcatatatcctagtaccaacgatccccatactatgcaaataccggaatcgcgacatcaagcgtcgacacatgtgtacaaagattcaaattgacgtttttgggaaaaaaaatttaggaactaaacacggccttaggctctgtttagggtctgtttagttcgtgaaaagaaaatttttaagtgtcacatcagatgtttgaccggatgttggaaggggttttcggacacgaatgaaaaaactaatttcataactcgcctggaaaccgcgatacgaatcgtttgagcctagttaatctgtcattagcacgtgtaagttactgtagcacttatgactaatcatggactaattaggctcaaaatatttgcctcgtgatttcctcccaactgtgcaatttgttttttaatctatatataatgctccaagcatgtgtccaaagattcgatgtgatgtttttgggaaaaaaattttggggaactaaaccaggccttagtttccatgcaaaaacttttcactttcacatcgaatgtttggacacatgcatggagtattaaatatagacaaagaaaaaactaattacacagattatgtgtaaattgcgagacgaatcttttaagcctatttgcgccatgatttgacaatgtagtgctgcagtaaacatttgctaatgatgaattaatttggctcaataaattcatctcgcggtttacatgcggaatctgtaatttattttgttattagatacctttaatactacagtgtgtgtctgtgtatccgatgtgacacgccaaaacttttcacccctggaactaaactaggccttagttctcaaacaaagttttttacgctgtcacatcgaatgtttggacacatatatagagtattaaatgtagaaaaaaaaaccaattacatatttcgcagaaaattacgagcctccaatctcattcctagcgtgtgttagggacgcgcacgcatgtgtgtcgtggtgtgagtgcagtgtgtgttagtgtgcgtcctgagttgttcccttcttaaaaaaagaaaattacgagatgaatcttttaagcctaattgcaccatgatttgacaatgtggtgctacagtaatcatttgctaatgatggattaattatgcttaataaattcgtctcacagtttcaggccggaatctgtaatttgttttgttactaaactatgtttaatatttcaaatgtgtgttcgtatatccgatgcaacatgcaggggcaaattttttttgccacctaaataggctctattggggagatactgtactctctccgtccaagaaaaaacccaacctagaagaagatgtgatcccgtccagatttattgtactaggtgggatggagggagtatgcacgtagtactataatattagtattagaatgtgttgtattcagttctaatatttattttttatgggacgaagagagtacaacaacatatatgtacggtgcacagctacggccatgtatatggatgcaattaatacgtcggaatcagaaggccataggttgtaaaaaaaaaaaaacgaagcggcacaaaacaatatatggttaaactttatatatatgtctcattaatagtttgatgccaatacttaaaaatatacaaatagaaaaatagaaatcaacttttaggtttcgaaatttaaattttggatgtagctaattaagctactctatccggtttgataatactctacttgttattttggacaaaactcatatcaaactttaaaatctttaactatagataataaattctaatggagatcatacaatatagattagtcttacaaaatactttaacaaaatcatatatttattgatgttttatatatattattaaagcctaacgattaaagttgttttagatcacgtttttatcccaaacgataaatactatcacggaagtactctctccataaaaaaaaactaaacttaggaggagacgtgacatctttacaatgaatctggacaaccctttatccagattcgttctactagaaaacattacatacttgtatagtttaagtttttttttaaggatggagggagtatggttgctttttctttttttttttaggggggcggggtttgatcgggctgtcaatctgtcaccacctactatggcgcaacagcagttgagaagttgagaattgttcagatgaagcgagtatcacgagtatcggggtttgtgatgcttactacttatataatataaaactgtatttttgggtagcagacagataataaactctttagaaaaacaacacctgaattaattattgcagctgaagatgacagcatatctgagccaactcgctgattaattagaactcaggatccaaccaaggaaaggattattaatccagaatacatgaatgcaatcgcagaaactgcgatgcagtcactcattggcaagtggcaactgggcatatcattgtatatttgaagtttcatatgataagtttttttttaaaaaaaggggaaaacagtaatagattgtgccttttcattaaatatagggagaatagctaatttagtccctaaagtttctctgtaggatcagtttagtccttaaccttttaaatggtccaaagaaatccttaaactttgtcataaggtctagaatagtccttgggtccaccaaaatcattatataaatatgccatgtc

SEQ ID NO: 18390 - DNA, 5572 bp, Oryza sativa
tttcacccttttgaggtatatttttgctcttacattttactttttggtttttatttttctatgatatatgtaagggtaaattggacaaatcatatagattttgcatggaaatgtgacatggcatatctatgtggcgattttggtaagatcaaggactatgtcaacccacgtgacaaaattaaaggatttgtttagacagtatgaaagattaaagactaaaatgtcccaggagcgaaattttaggaaccatattagctattctcccttaaatatagcagaagaaaaaacagcacaagtttcatatgataagttgatagcgctgtagttgctgacttcgtaagcttgcatgctcctatggtttccacacttcagcaaactagatggctgctaaataaattagtaaactttttgatccgttccaggctccaggctagctagatccacgtactttgtggcagcaaagacttttttgcgtaggtcgatcgaacacttgtcgtgtatgcatgaacgccatcggttctaattctaaactaacaccaactaatcgatcacgggcttctagctatagataattaattagtactaatatggagtacatgagtaatgtaatcctaacaggaacacgcctctctggtgcctgaaacttcacgctgctcgccactaatcgagtactctatttggtcagaagagaaataaaatggtatagcaacaacacatattttgcagcatcgtctttctatgacgtctttcacagtaacttactctgaaatatgaatcaaacgacctcgagtccttgacaagtccaagagggagtaggcgaaagaatgtgacgccatttctgttcttccgcataaatgggcaaagctcgcgttatttttattgtaaaagaggaaagagatattgctgtttgtctaaagttggtgatccagagataagaaaagttctggaaggctttggatttgcagcagaaagtgcgtccaccaccattagtggggactggtaaaacactgcattgatccccttgactacttggctactgcatccagcagtgaacatttcaaaggataatcatgtggatagatgtgtcggagtacggaagcgagaaattaatctcagtttcggcgactctcttcattaaacttctgcgtgctggctgcaattttcttcacatggaatgcgaatttcttcatatagagtaggagtaggcatactgctactgtgctagcgaggaacggtctttttttcctagtccagtccatcaatgacatggggtgtgtccgtgtgtgtcggtatgccgtgaaatgcagtatgcaagcatgttcaggagacaagaggtacatgatctccatgttctcaatcaggtctgtccctgttcactatgagacattacggcgaaaccgcgaaagggcgaaagataaattaacccttgatggttcatattgtaatacacgagatctacctttcaattaccacgtgactttgtgtgtcctgaaatcgaccagacatagcttggcatagagattgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgtcatcctcctccggcgcggctcgccgggcgcgccccgggccatggccccccgcaccgccgccacagccgcaggcgcagcccctctcctgggccaagcgcactggcttccagtcccgcgtctccggcgagtccgtcgccatcgtctccgcctccagctcggggcaggtatcgctgcctcgccccgccgaggcaccttccgatctggagtccggcccaccggccaggcccaactccgccctcccgccccctcccgccgccgccgcggccaatgcggaggcaaagccgcaaccgccgccgccgccgcctcttgcgaggacgcggaggagggattcggatggcggaaggccgaatgggcaggcggccgcagcgccgcttcctcagctgctggaggaggaggacgacggtgcgccggagcggcccaagtacgagctccgtgacagccccggagtatgtaagtgctcaaaagaggaattaaatatcccacactgtcatgtgcgagcgcgctgatttacgaggttttacgatgtgttgcagttccaatagcggtatatggatttcagcattacatctccatgctcggctcaatcatcctgatcccacttttgatggttcctgcaatgggcggttcacctgtgagtgtggcttcaatttagtagtagttctcacagcatgtttggttttgtaggtttagtacttaatatacgctgttggatgcttaggatgatatggcagcggtggtgtccacggtgttgcttgtctcagggatgaccacattgctgcacacattctgtgggacaaggctgcctcttgtgcagggaccatcctttgtatatcttgcccctgcgcttgcaataatctactcccctgaattctttgggctcaatcacaatgtatgtttatatgtataaattttatttgtgttggcgtgatgcaatgccacatgttgtcatgtagggattgcctcatcattgctttagagcgtttgttgttgaacctaacacgttgtatttcattgcagaactttaagcacatcatgaagcacctgcagggagctatcataataggaggtgcattccaagtgctgttaggatatacaggcctaatgtcactatttctaaggtgtgcagctgttgctgtttattagatacaaatacattcatctttttctcctagttgtctgctatcatgtggcttgttgacatggcagtatatttctctatttaccatggccacatgattgggtttggtagtaagtcgatcagatttttatttggaatggtgcatactgagtactaacacattcttaagaaaacaaatgatccaaaatttctactgtactacagagatacatctcgtgatgactgtgaacaactttctcttatctatgtggtgtttgttaacaatggtcacgatatgttaataaacaccgattatgatacaggtgttttactatggtctctattggtattttatagaatcaatccagtctgttcatactctctaatctaatggattgatctatttatactaccacctcaactacttgtagaatattttttttctactggtagtagatatcataaatcaatggttgatatcgcttctactggtgatgttagtagaagaccaccatagaggtattcaaataataaaggaaactttgttggatattactagttattatacatatttcctgcttctgagcatccctgttatgaattaatttctttgcataaaccgttgtttctcggacaataaacatacttttgcatgtcttataaactgatgaatccagatcaatgaaacattagtaagcctgcctctatttcttctgactgtaccatcaactgtatatttttgtgacaaatagtaatacatatgtatctccatcttcactgagcattttgtcattaactacctctgtttcaggttgataaatccagttgtcatctcaccaaccgtcgcagctgttggactttcgtttttcagttatgggttcactaaagtagggtcatgtatagagatgggcctattacaattattgattgttgttatgtttgcactagtgagtatgcagtaaaccaacttgttaaatgcattgtaatattttgtgcaaataatgtcttaagctgatgatctgtctatttctgtgacagtacctccgaaaagtaaagttatttggctaccgggtgtttttaatttatgcggtaagaattgggctaatagttatttgagctaatacctccatctatgctagtcattagtgtgattatgcaattctaattgctgaacttttggtgctgccttcttaggttcctcttgctctagggatcacatgggctatcgcttttggtctaacagcaactggagtttatagctacagaggttgtgatgcaaatattcctggctcaaacaatgtatcagcctattgccgaaagcatgtactgaggatgaatcttgtcgcgtagacacttcacatgccttgcgatcttcaccttggttgagatttccatatccgttgcaatggggcactccaattttcagttggaaaa

SEQ ID NO: 18391 - DNA, 13420 bp, Oryza sativa
attgcggttactaaaatgggcaatcgaaggccgtttggatttggtgctattgtacttatactactctcttttggtgggaagcaactatttgcactttttcccctgtgtgtgaagagtagacatcatttacctgtgcaagcattcaggttcttgctataacaattcttgtgtccccattgtaggaaaagttggtgccttcattgcttctattcctgatgttctaggtgctgctcttctttgtttcatgtgggccatgctatgtgcccttggcttatccaatcttcggtatagcgccaagggaagctccaggaacagtattgtagttgggctagctttgtttttgtccctgtcagttccatcgtactttcaacagtacagattacagcctaattcaaactcatcagttccaacctacttccagccatacattgttgcatctcatggacctatacacactggatctagtggggtatgtattcatccgttcttttctaacactatgctgtttgcatactagagtttcaatggaaatacataaacaaaagactggtgatacacatgcagagtccatattatagtgctcacattatttatgaatatagatagtttgccaactgtaactcttcatgccgcttgcctggtacaataacaaatatctggtttctttcagtaacaatattgttgtggagtgtcttatggaagtatcctgaacatttacataactatattgtacaactggagaaagcagtagaaagaaacataaagaaaggaataaacaaatcctgggaaaatagtcggaattagaaaattctcattaaatatagtcctttttactcctctgttttgatatgaaccctggaactttcatttttcatgtatatactatgcttcaactgaaattagtcaagctataaattcctagtggtaataaactttatcgagtagaagtgcttaggttgagttccataacttacatatggttccagcatagtttccttcttaacaaagaacacaattatttcactcttatataccgtgccatgatattttcaatcccattcacatgaatgatatattgctttctaatttactgcgtaggcacatttgcagtatataagaactgttctcattttatttgtgaagcctgacaaattcattcatataagtctcaaaatatggcaatatttttgctatatgtttatgttaactatttgatttgcaattcctttatttccttgctctcaggtaaactatattctcaacacgttactgtcactcaacatggtcattgcgtttttggttgccctcatacttgacaatactgtccctggtggtcgccaagagcggggtttgtatgtatggtcagaggcggaggcggcaaggagagaatcagctgtcatgaaagactatgaacttcctttcaagattggacacgcattcaggtgggtgaaatgcgttggcctatagcacagttttggtgtggtttgtagccttggccaactgcacaaaaaatattctgcagcttccaagaatgaaaaatggttactgtgcaaaatctcaggcgaaagaaatggttagtcacgaatcatgaccgactgtttcccaatgtttttcaaccaaggtatcgactatcgagtgtacatactgaattgctctctaggttagttgtcttgtcctgatgcagatgctagatgcatcaggggcttcccacatttttttggactaccttttgtcatcacttacagattttgctcttctcctggtactatttaattggtgttagggatatctatttgtacaggcggtaaatgatctgaaccaaacctgagctgtgcttaattgatctagttatcttactttcaacatttcctgtgtgtggatattttactttcaacttagctactagtgatagcgagtttcaccgtgccaggttttcctgctgaattatctcatcctcgcagtgctaaaggctggcatccatgtcaactgttaagcatgtaaagctgcctgtctgaagtacatgggcaaggaatcaaagagtctgtaatgttacggggctatttttccagttgccacctcccaactttggcataacccagcctgtacacattggatctttgctgacttgttggttatcatggctggctgacttgttggttatccccgtaaccacgtatatagcccagttctgagaccactcaggcactctagagggccttgtcgtggacactagaccctcttttctgaggggtcaaagccaatggacctcgccaccggcctgtaccgatgacgaggctgacaaggaccttcacatggaacggccgtgccgggcacggcggcacgggtggcttctcagcacgctccttccaaattccaatgctgttgcttgtctacggctagctgcgtgcacggctcgaatgtcgcgtgtacagcagttagcacgtactacatgaggtacggcaatgatgccggttgtcaccggatgcagcacaatatgcaaaacattatgatgaattcactgggataaaaatgtgtagcaagcttgattccgaagtcaagcaacactccgctatcatgactgctgggcatgccacataaacaaaggacaagaactggggcatgccagtataaattgctagccgcaggccatccagtggcgcaaggctattgcttctttgtgacctgcaaggctgcaagtttgcaaatgcacttcaacatactcccttcgtcccataatataagggattttgagtttttgtttatattgtttgactactcatcttatttaaaaaaaattatgcaaatataaaaaaacgaaaagttgtgcttaaaatactttggataataaagtaagtaaaaaaaaataattccaattttttttaaaaagatgagtggtcaaacagtgcaagcaaaaactcaaaatcccttatattatgggacggagggagtaccaattgtcaaaaagtggcgcacttcccatgtcttggtcaaattatctcccctagtaatcgaacgccttcttcacaaggatatgcagccatgagaaatactacttgtcaattatcagtgctgccttccgctagtaaaaaaagcaaagagaacaaattcatgcatgttacaagctacagcatccacttattagaaatagtgtaatcgcagccacgctgcatgaacaggtctgcatctgcaaggggccttcccttcctgaaatcttcagcaagtccgggaattccggagaggaaagaagctccccttattgtaaaatctgaacttggagtgctacacctaccagaagtaggcacagacagcagcccagaactgtgtggatcgtaacatggcctcgttgaaaagccatgatcatctcttatctctgacggagctaccgtgacacgatcagcagtgttgctcacgaaggcgttctgaggagcagctgcagttggtctcagattgagctctgaacctccatatttgttgcaagttgagaccatctcgtcctttggaaatgagtctgttggcaaccgaaacaagccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattggcaggcaaattctccctgtcatggtaatcctctggtgcagggagagccagtatctcctgatcaggagattggcttgagctgcagagctcatctcttgcagaattgaactcgtcgtcgacgggggagtagccgtcgtcttctgaatgttcatggtcccctggtgcaggaagcgccagcgtcacctggctgggtggaactggcttgctcagcttctgactcagggaaatcctggcaagctgaagtgcctgaagaacacactctatgtccatgttgctcgttggctgttgatctggccctgcatcgacctggttgtcgccatggtcatggaagcgtgatgagctccaatcagagaccttgctgttcagggtggcatcactcattgacgggctcccatctgatggcgctttgatgtcacagtagcttgaacatccatccggattctcgtttccttgttcttgattcttccctgtcattgtgccggcgacattagagtttccttgagactgtgcatgacagtggccgtgaagctcctcgtgcgagtcacgttggtcggctgctgcttcttgtcctgatgtgtcttggggtgattcaggaagggaaccattcaacagaagtccagcagagcggttgttgctggcgctggggtgatttttaacgcctggttttgcctcttcgttgcaatgaaccgcttgatccgcgagcctagaatgctccttgctctgctcccaaccattttctatctggcacgccttattctctgcctcaacatgaacctggagctccaaagacaaaagtatgagtaaaatgtcaaattttgaaccaaaacaaccaggtttcactcatgatactaactaacctgtgggtagcactctgcagtgcattttgttattaaaaaaaagcattttgagagagcaaattatttatacttatcaagttggtggtacacatttttgtactgcatgtgcactaaatttggtagcatgtggaagtcaaggggaagttgactctctctgtggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctttccatctcgccgtccttctcgtacctgatcacatactgaccaccagcaacctcgccgtccatgtccgcctggccgtcgtcggtgcaatccgatccatcttgctgccccttctgactccaggcgatctcctcgacgtcgccgcgctgctcttccggcgccgtcgacttgccattgctgatgagcagagccgtgggatgttagaattcgacaaacaatggcgtgtgcggtgtgccagcgtctatggcgggacggagctcacctgagctccttgcgcttgttcttgcggcaggactgccccatccggtacttgggcgacgggtcggaggagaggaggtagaagtagctcctccggtgcttctgcttgagctgcctcgccttgcgcgggctcacgctgcggcctttccacgacagcccgccgccgggctcggccgtcccggacagcgcgtcctccgccgcttcgcactgcgccggcggctgctcctccccgcgggagccggccgtgtcgccgtcgctcctcgcgtcgcgtgggtcgtcatcctcctcgccgtcgcggtcggagcccgagtcgagcacgtcggagaggttgccgccgaagccatgtgactccagaatacccagcacctccgtcgccgccgctccgcctgccgcctttgcgccgtcaccgcctggacctgctcctccagctccgcaacctacaaccaagtgacccaacacacgtaatcaatggcgcgaacgacagcgagagtaggctgcccctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgccaccgcgcgcacgctcacgcgctccccgagccgagccgcgagtgacgttgctgcgtacgtatgccgctccgcgcactgtcacatgccggcggtgtggcttgaccggcgccgcgtattaaaaacggcttggtttcccgtgagccgggcacggagcacacgcagcgcgcgttgtactcgcgggcgcgggcgcacggggcaccgacagcccaggacagggagtacgctacctacgcgcgacacaagcgccccgctgcagcacgagggccacgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatgagagtttggatttatggtgtactgtgtacatgaactccagtagcacttgtttatgggggtaaattcgtcgaggacaagagtagtgaacgtggtacagctttgccatgttcgagcaacgcgacgaagccagcaaaactactcgtcttctcttgtgctactgcctactgctactggtgctgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattatagcatcgagtaacagatgtttccattaaaaaactttagaatacacatatgcagggtgttgaggccgatgatcaagcaatgaccatgcggcagattaatgcagaccgtaaccacaatctcaggtacttaaataacgtcatacccggtaggcgggtttacaaaacgttttcgtaaacgtttttagccgaaatttcgctcaagaaacattatgtctgcttagtttgacagattcaaacaagataatgacgatatctcaatcaccgctggcacagcctctgcatccacagtgaacacattctataaccttctcctctctgagatgcttggggacccggcagacgcatgtagttgcaaagttgtggtctcgtgtctgtatgcatcgaagacagcaaaggcgctcataacccggctgaaaacacacaaaaagaagcaatgatacatttgatataagaatgcctgacaaactcttgtgacaaaaaagcatcttctggatttgcatctaaaaagtgactgaaaactttgacagttgaattcgtcacgtacgtctcacaatattcttagggcaatttaggcccctcgttatcaatgttcagacaagtatataaagtagtaatatggaacacaagtattgcatccctcccaaatctgccaacttttatcagatgtccaggaaaaaaaatatcattgggtgttagaagtctatccatgatttgatttctggttacatcagctgctagtatgccaataaaaatacatagcggaaaatatataaacatcttttagtcaactgccttttctttttgctcccaaaatcttatttttcatggtgcacccatataagagaatatctagtccataaatccccacgtcactcatgctgcattatttcactatttcatacggttcatgtgcaagaaatccaataaggcactactcaactttgacatccagctattaatcgcaggttcatacatatagattagattctaaaacaagatttatgatgtgtcatgtcaaactagatcagtatgtgatagcttaacccaatataattgatttactgcaagaaatggtaggatgcggttagtttagtgttttatttttcatagtacaagtacaaaaagtatggttcaaggcttcaagcagttaagttacattctaagcatggggaaaaaatgtgagaaacttagcggtgtatccaggggtctatggcttcatctgaattatctttgtacacaagttaattaaagtcttaaagattatacaaggtggataaggcatcttactaaactagcacagagtataaggaatgatgggcatcttacagagcaaatcatgggtcgaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgtgtgtcattttcagctacatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctgtcaatgaacgtcgagcggctaaagcttgcaaagaaaccctgaggacatagagtaggtgtaagattcacaatgcaatacatttgcacggtcaagctcttccatcgaactcaagagattataagaacataatacacactattacatagaatttagccccacattgaagccttacatcagatatgctatatattccttactataaaggaactgtgttgaacacaaatagcacaacttaaacaggtattttgcatcttcaggctaacagtcttgtcgaaccatgatttaaccctattttgcaagtacaaaatatgtgcacctcgaatcggtgaatggacggtctaatacctaaagaactaatcgacacgatgataaaaatcgtggaaaaggttccccaaaccctaggctactcggaagttttttttttgagggaatactcggaagaatttcgtcccaataaccacatacgcgagaatttcgtcccaaggaggagacgaattgaacggatccaataaacagcgaggtagaaactactaaagcatccagcgaatcatcttcagggaaaaaaaaagggaatcatggagcggaagacgaataataacctcttggcttgggcggccttgcagtcgccggatggaagctgtggcgcgcgggggagcggcgatccagagggggcgcgcgtcgtccacgccgttggcctgcgctgcgctccgctccggtcgagcaaagacggccgaagaggagacgggcgggtttggagtttggaccggagctaccagctatatgtcgtgattctttttcccctccttttttttttttgagaggagctatgccggtttgacggttttctcctctggtagcagtagtatttgctacatcatgggcctcaagaatcaaaacgggacaccaactgtgctgaaatccaattcggcaaacaaggttggtttggtttgtagccagggtatacgattccgacatgctctttcgtttcggacaccggtggaattcgaaatttttgaaatccggtggaaaaccggtaaattccgaacaaatttcataaaccaaaatttgaatacaaatccttgagtttgccggcaagttctcgaaaaccggtcggttttggcgaaattccgatcgaaatcatcaaaatttcgatcagtaatttgttttcttttttaaattctttattcttttctttcttgatgtaagtttcagtaaatatacataatacatcatttttcgaacatttatatcccaataggttctatgaatatcatactccctccgtttcacaatgtaagtcattttagcatttcccacattcatattgatgttaatgaatctagatagatattgtcgaggagcgatcctctctagtaggtggtcgtgagacccccttttgtgagttcggctgggggaaatggcgcgatgacaggagtttacttccgctcgcagtctagctgcttgatcgttgtcgggactgtatgggagatcgaggattatacaggttcgggccgctaccgagcgtaataccctactcctgtgtgtgggattatggtgagtttttacaagggatttcaagctccgacggggacctagctgttcttccttcgagcttgagttctcctcgagtcctccctttttcccggtggtaatggtcctccttttatagttcaaggggataccacatgcaccgtttgcacctaccccccacgaaaaggggtacccacatggtcctaatcatatcgctatcctttgcttcaaccggaagcaacatggtcgcctggcttcaggtggggcccaacgccgtcctccgcctgacacgggggacatccctatcattctctattaattgtatgaaggcttcggcggcccatcacgcgcgtggggcgcccctagcagcgtgccgacgggacagggcacacctgcccccactccgcctgacacagggtggaacgtgggggcactgccctccgtcccgtcgcctgtgaccggtcacaggccggtcatgctcgattgacatgggtcaatcgagcggcgccgcacgtcccccaacgccgcattgaatacggcgtgggacggttggggtaccgcgcattaaaggcgcggagcatcgtctttcgccccgcctcctctccccgccacgtggtgctcagatgagggccccgggtcagctcgcacctaaagcacgaggggtagcgcggggccacagaggctccctgtccacctctctacccgaggggcggggggaaacgaggctgtgtggccacgcgaccagatgggaaagatatttccctttactgtgcgtacccctgggcccatttcaccgacagatatatatgtctagattcattaacatcaatatgaatgtgggaaatactagagtggcttacatcgtgaaacggagaaaatagtatttataagattttttattttttatcaattcaaatttgaatttggatgaaactcctcaaaatatctcagacggtttctactttcgagtctcgtcgaaacatcgaaattccgacgaaatccgatcggatttcgtcggaatcgtaaaccctgtttgtagctcaactttgctaagtcaatatttatgcaatgttaaactatatagaatataaaacgattggcatggttgaaagccaaatgcaattttgataacaaaacaagcaaatgcctagtcagttttgttaaaaaagaaatcaacaacaccttattcttaaccatgataaagtttgataaagtttattttaacaataaagtaaataaaatttaactatattactccctctaggtcttttaatgacattggctagtttgaactagccagcgtcatatatacgaagattatggtggtataaatttagttagttttatttcaataataaaaggaactaagcgaacactctttgtttaacttatgatattctatcaagcccattcaaacaatgatattataacgaaacacttctctatctctgctattataaaaattaaagatgttttaaccggtattttggtatatcatccatgtttgagtcattttttaacttccttcgcttttagaaatacatatatgtgtttgagttagaatttaagctcatttgcttttgaaaatacaaaagaagtcgtacaagaaatctcttttagaaaatacccgcatactaacttaagataaaaatcggactcctaattgtagctcgtgattttctaaaagaaaaatccaagcaaattcctaccgtgaattttatcctttctaaaccgtataacaataataaggttaaaatagtattcacccgttgcaacgcatgtgtatttttttatactaaaaatgctcgtgcattgcaacgggtaaaagctattttaatcttattattgttatatggtttagctaggatgaaattcactatgggaattcacttggattttttttagaaaatcatgagctacagttaggagtctggctttcatctcaagttagcatgcaagttgttttaaagaaatttcttatacgacttcttttgtatttccaaaagcaaacgaacttaaaatccgactcaaacacagatctatatttccaaaagcgaatgaatttaaaaacctacttaaatacgggtgacgtaccaaaataccgaccggtaaattttttttcaatttttataatagcagagattgtaaatcctatcttagtataaagttatcccccactaactccttaagcttaacatgcaaagatgccacatcatcatccactaattaacaaaatgctacatcatcatccactaacaatcatcacatttaaacatcatgcaaacatgctatatctttatagtttttataatttaagagcttttcaaatacaaatatgttaaattatcatccaatataattcacataatgtttcaatgtatatctttattatgttttatgatatcctatatacttatatagttcatccttaattagttagtgcttaaatgattaatctatggtccaaattatctttctccttttttcctctaattaagtcatatcacatcaattgtttttagcctttagatgattaatctacggtccaaactatctttctgcttttctttttccataaagtcatgccaccttactttttacgtttgaatcaacattctacatactatttaaatttaaattatcataaaccatattaatttacttaatttgatgttatctaactatcttgcacgttatttttttattgttatcatactaaatttccgcagcaatgcgcggggtttcacctagtatctcaatgttcacaccacaacacattcagagacaaacatccaccaggtgcccccatgagcggaaactctaatgggcgatcgatcgcccatcccatcgggtagcaatcgccccgcgccccctcccccctctctcccttcacctggtttccatttttttcaccgcattacttttctattttagtaaatttatgcatctaaagtttatacaccttaagtttacacatctaaagtttagagacccaaagtttataagtcaaaaatttatgtatccaattcaaatttgaatttgaattcaaatatttttttttatatatagtatttttatacatctaaagtttatagacctaaagtttatagacctaaagtttataagtcaaaagtttatatacccgtttcaaatttgaatttgaattatatccaattcaaattttaatttgaattcaaatagtttctatatatagtatttctatacatctaaagtttatacacctaaagtttatagatccaaagtttataagtcaaaagtttacatacccgattcaaatttgaatttaaattcaatttaaatttgaattcaaattttatagacctaaagtttataaactttttttatatatatagtatttctatacatctaaagtttatacacctaaagtttatacacctaaagtttataagtcaaaagtttatatacccgtttcaaatttgaatttgaattatatctgattcaattttgaatttgaattcaaatattttctatatatagtatttctatacatctaaagtttatacacct

SEQ ID NO: 18392 - DNA, 6315 bp, Oryza sativa
  unsure (1)..(6315): unsure at all n locations
cctcctccatcttcggccagcatagctcctgcctggccaccctcaggtttgctctcgcggctcttccctcaccggtgcgccgcaccgtccaccgcccgccggagtcgccgtcgtcgccgccgagaagagggacgcagctgccgtgcgcggccgagtggatgtggtgtgaggcggtaaggtggagggaacacggggagctgggcgcacggcgcttcgagaccgccgcccgggcgcgccgcaccgcctcgctcgcgctctccaaccgcaaggagttcaccaccccgcacaacggcgccatcaactccctccaggtccacccccttcttccccctcactccccttttccttctctcaccttagaggcttagatcaatttgatttgtacacccccgtagatggaatcttggcgtatttgatgtgcaatgtgtgagtcgctcccgctggtgttttgtaatttcacaatatggtcaggttgatttgacagagcggcggtacctactcgctggcgcatcggatggatcagccgctatattcgatgtgcagaatgcaaccgaatacgaagccgggttcattgccaagcacaggagcattctgcttgtggacaagcagcatgaaaatggccacaagttcgtggtatcgatggccgtatggtatcctgtggacactgggctgttcgtgacagcttcttttgatcagtatgtcaaagtgtgggatactaattcgactcaagtatgcattcatctgctttgtggattgcttatttttcttttctcttgcctcctttggtggtggcaacggtgtgatcctgatgttctgatttttgccttggctttcttttcctaggtcgtaatggattttaagatgcctggaaaagtgtatagcgcagcaatgtccccaattgcaacaacacatatgctgatcgctactggaagtgcggatgttcaggtccatttatgtgacattgcttctggagcctttacccacacgttgtccggtcatcgtggttagtttcttacttctagtgcagtgatgaaaatatgcttgctttgtttgtatggttaccaccttatccttggtatctgacatgtcagatggtatcatgtctttggagtggtctacttcaagtgagtggattttgatgagcggtggttgtgatggagcaatacgattttgggacataagacgagctggatgctttcttgttcttgatcagtcacggtctcaactaggaaggcggcctccttttcttgagggcacctcagataagatatggtcaccattatccatcacttacatttgttttcagaatatttggttgcaatgctaaagctggacttccactattattttctgcaaaagcttcaaaaatgttacagcttcaagtaaaatattatggctgtaatgctagatcaatacagtcagccttcaagtaaaagctgatttctgcggctattaatttataggtttgtctcacatattagtgtcagtatataggtgctatggtatgtttagtgctccaattcttacaatataaggtctgcatacattgtttcttgttgattgttgtgtcctagaaatgacgcgcaaactcagccttccactctagttgtgcaaatgatcaatgtattcatttttaattttgaccaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaattgtgcaacggcacattatggtgctgttacaggattaagaacaactacagatgggatgtaccttcttagctcaggttgattgaatttaattgctatttctatgagcattcgattgctattgcttgaaaggaattattgtctatggctatcttcttgttatgcctgtatgcagtatgcattaatgattgttatcctctctcttcaggttctgattctcgcttaagactttgggatattgattcaggctgcaatactttggtcaattttgaagctatgcgattacagactagcaaaccgctacaattagctgtcactgaggatccatcacttgtattcatcccatgcatggcaagcattaaggtgtgttgtcattttttagcttctcagtttggacgctgaattttagacttcaccttgtgttgccatattcatgtaggcgtacaatttatggtctggtatgacatttcaaacattccgggggcactatgaacctgttaattgctgctactgtagtgcacaagaacaagtaagtcttccctgtactcctatcctctgttaaccctgaatgttcccgcatcaataccactgctgagtcttttggaatccaggagctttatactggcagcaatgacatgcaaattcttgtgtggtctccatcaactccagcgtttactgaaatggtatattttctatttcttgttatcatatatctttctgtagaattttcctatatcctatcaaattcaaatttcttaggagtagtcgggcatattaggatattatcgcataagcttttttaggcatttgattgttagcacttctaagcctctgcaagaagatgatggcaagaggcaaacggattttgtagtcgatgacgataactggagcgactgagaattattcatgaggcaaacggattttgtagtcgatgaggataacttgagcgactaagaattatgcatgtatagttgtattatacactgaacattgagcgactaagaattatgcatgtatagttgtattatacactgaacattgacattagggatgttaacaggccacgtttttttttctttttttctttttttaaggggagccacgtttattactactgtacagtacttcatcctgcagtttcacccgaaatatcactttgataaagacagctaagtgaaatgtaaatatgccagattctctctccgataatgaaaatgctcctatgtgtttacccaactgttatgatatcatgttaacaaagatacatcagatctctttatctggtaaggagcaaggacagaaatgctcctatgtcgtagggtcgtgctccctacgagaacttgagcacagcagcgaagaaatgcctaaacacgttgctgttaatttgtttaaaaaagcttcgacagcctaacaactcaccaatccttaaaaagagatgaagcaacaaggctgtatgacttccaaaacttaaacagcgatgcatgaaattccacctaatatcgtgcagtttttcagctgcatcaataatatgtttaaggaaatgaataagaatagctatcaattataattacaattacaattacaattacaacagatttagcgaatctggatcgccaaaggcacttattgcacttatttcagactaatgtcgaggaagaatcgcatggagtgacagtattttctattttcaaaccaacctgcaatgaattgctggtcccaaaacgcagagaacctcgcagctcaggtaaagcttcagtccataaggctatacagctctgtcgggagttccaaagataatcagttatattgcaagcacattgcaagaagtcaatacatacaacccaaaatggacacggtgatcagaataacagtagaggaaagaaacggatgaaacataccacagcatgcaacagtttattgtgtagatggacacatgcagattttcctgatatgcaaggagattcctcaagtgtgctcttgtttcttagatcctctgacaccggataatgcctgcagcacctcatagcacaaccatttctcgctacctttattcatgttccatctcaaccgatgcaatgctacagctttaggaggaaagacctcaaaattttcaggggattcactacccctgctggtgcttgtgtcaaaattctcttgcattgaaggagcagctaaaactatggcaccggtttcttgtccttcatcaggttcatcttgttgaccatctctgatgctcggatttatagcaccattgtattctgtatggtggttaagcaggcatgtcaggtacaagcaaaatgatacaagttgcaggtgacagagattacctgagttggtaagaagtttcccttcttctataacatgcaattgagctacatctttgcaagttttagtagcccgtttggtccccagaggaacatttgacaaaggagagtttggtaatgcgataccaattttaatggttgttccctcctctgataatgaaccacaaagaaaatatggtacacggttcctcccaggttccttttcccagaatctcggagtaagctacagtaagttgaatatttctttagcaatgttatagagaatcacaatagcatgcataaatcaatagtatatgtgctgtttagtttacctcaaagcaaacagcagttccatcagccacacaataagccgcatagcctggatatcagcaaaacaaaattacaaattcatgaattatcatgaatatttgacatttttactctgctcacatgtggggaactaaatattgatatangctataaccaatattccgatacttgacatctactatgngtggacatgaagtgaaatgcaccttgtatttcttgagcatggacacttcagatcaaatattcagacaattgataggtagaaacacnctgagttttcgttccaacaaatgtctttcagtaaaaggaacatcatttgcgattcttgacaagctaacgaactttaatgtgccatcttccaatgatatgacaacacctctgaacacaaagataaaaatataacagttaacattaccattctagtaaacaaaagggtatgtctggcctatatacacacaatatcaccatgaatgaaacaatgtggtctatgtaatcacgtctactttgatccagttatacatcaagaccatgtccagcgaaggaagcttgcatatttagaaggtacgtgggcaaatacaaacatttatattaataattatgtaaacaagtgcaaatagagtgtttgcaaaaaaaaaagtgcaagtagaattgcttaaaaaaattctgatgatttaatggaccaaattatataacaaagacaatatccaccttagcacacaataacagagaagtacaggttctatgaaccacgggctaagaacataaattacatgactaaaacaattgtcaatagcaaatatggtttctagtatgtgttccaacattaatgaaaacatacatctccatttaaaattagtgcagtgtttcaaagacaaggaaaacagcgtaaacaccatgttagtgaagaaaaatcttgtgtaatgaagaaaaacaagtacatttagtgcttaacaaatattaccttgcatccttcaaccattgaagacttattacggcccttggagcagtagttaactcccaaagatgacgatatggatctctgcagcaaagaaatcttatgagatgcactaaaattcccaaatttacaaaacaaaaacagtagaaaacaacagcaaatccaaggcggctgtgacaggtagtgatttaaccataacaatcaatatatctattagacaaacatactgcagcttctagaacaagtttcttagcgcccattgaaaaattaaagaaaaaaaccgtatatcgcactggattcataaagaaactcctactgacatcattggtccatgtgataataacatattctgcatatcgtgcctatcttttgtttgttaactcggaatttttcccattaggaaacaaccagaaccaaatatgaatggttcagaaattggtgggtgccacgaattcagagaggaaggggaagagactaccctcaatgttaagacctctgaggacccatacataatattagaaattcatgcaggataggagagtagtttgaaagatgctttaaacattgcttcagttcacaacaaggccaacacctaccttaaatcccagaatttcagaccatcctctccagcagtgacaaaggtattcacgttttccttactgacagaatgacaagagtcaaaactcaaaaattatcttttggaatagaccagaagtaacagtacaactggctacctcacagatggtgcccacgacacggttctgatgggagcagattcagcagttacacacataaaaggttttgaacctgtttatcaacagaacgcatgatttagttttgtttgcaaacagaacagaataagaaatgcgaagatttgggaactccagtaacttgcttttaaaccaataaagcagggctg

SEQ ID NO: 18393 - DNA, 2665 bp, Oryza sativa
aaagttcatgctgaggaatttagaaatatatccaaatcttccacctagtttgagctactactagcaaaaaaaaaagtctacaggtccaatacctttgtctgttcccgcactttactttggcagagctaaacacaggcttcagctttaaaaatcgagggtcagtaccctcctttgaagaagaggaatatattttctgaatcatgcttggagatggaacttcccatctgtgcacaaaaatgaattacaagatgataagagggggtgatagatatttaaatgagataaataaggatctacaagagcatacactcacacttcaagcgagccattccccaagagtactgcaagaaaacccaaacatgatttatgttctgactgatttgctgaaggaggtttccattttacgtcccaagcaacttttccattatgagctaaacataagacaacccttggtagagaaatgtcttttgggacacgagaaagggtcttttctgcagaacaaatcatattatcatctttagttgattctttgaatcgagccacttctgtatcttttagttcatcaataacctgagcactgttttcggaaggaacagatacagcctgatttgtctctgcgttttcaaagttacaagcaggagtacaacatgaagtatatgcagttgatgcagaagatccgtccatgttctgtgcttcaacactaagcactactgaacttctttcatttgaaacagatttctttttatcttgcactctgccctttccgggacatgattctttcttgcaattttcaaccaaggacgcattgtcgcttgacttgggaattgtctgagttttttgttcttcacccctgcatgctttagaacaaccgcattccgttgaaattggctgctttctaggtctgcctctacccttcttggcacttgattcttccttgcattttgcaagacatatgccctgtgctggtgttgcagcatgagatgttccaacactcaaatggacactgttctctatagcacagcttgatggaccaatatcatttgctaaaatgtcacaattactcttggccaagaccacgagattatttgaattggtcagagtagaacctttctttggggtctcagtaccaggaacaaatacacaactggttgtactcggaaatggtttcttcctaggtcgtcccctccgcctcagaccagttgagttactcttgttgcctgattcaggtaaaatatacgtaggcaacatggatcctatgtcagactgtccagattgcatggaattctcaatatgaattacttccttttctggctgttctctacccctctgacctgacaatggaactggggaggctgcatcacctgcagcatgagttatattagcaccagacccagtattttcagtgggacccaaaccaaaatcaattgaaccaggctgacagacagaatcatttcctaattcagtatcagtgcctgaaagatgcttgctgttgcttggagcagaatactttcggggcctccccctttttttcttgggctccatgcaggttaaagctattggagatagagctgtagacaagtcttctgttagtttaatgccagacaaaccttttatttcaacaggttttttcctaggtcgccctctaccttttcttggagttgattccacaggattaacagttggcatgggataagctattgcaatgtcacatgaaacaactgctggactgacaagaggataaataagagcaaactcttgacttctgtcgttttgggatgaatcttccactttggcaattggcagtggatattttcttggtctgccccttggtcttttgacacttggttccaagtgatcatcagaagttgtgatggtctttcttggtctacccctttgttttggttgattggatggattatatttattgcatgcaaccaatgactgatgaggatgaccctcttcagatggtgctaggagacaccaaacttgaattatacctctcccgattaacggcatgccaattttatggtaagaagaaccaggagggtgagcagcaacagcaagatactgcaatgtataggagacgtgcaaataaggttatcagctctcaataacttgtactcttagtcatatactttttttcaaaaaccagcaaatacttgaagatataaaccataaaaagaacataatactaatttcatagacaccgcacattcaatgcaatcatgcaattagtctgcatgcaaagatgtccttgggaagaactcccttcggtcattttcttatacatgctttatctcagcgcaaggttttattaagtaaaaaagaagtaaactgccattttatcgtcctgcaatgcacagcacatagaactggaaatgttgaaccagattcactgctttaacaagagttggaaaagatgagaaattttactttgattcctgtgagcatctaaaatgggaaaaacaaatacagaaaaccaaatatgcctaataaaagtaaacgtggggagtactgcaagagatgtctttaaattcatgtcaccataaagtatgtcactcagtgaaacatgttaattttccattgacatatgaactaaagagcactcatcatactcatagtcacagcaggtagtggatattggaacaaaaaatatgctgatgca

SEQ ID NO: 18394 - DNA, 2717 bp, Oryza sativa
acaaaaatagtattagatcagatctattttcatcaatcacaaaaaaaaaaagcaaccccccacaacccccaaccccaaaaaaagaaaaggaagaaggtttggcacgtttgccaaacccaatgtacgattgttcttctggaccaaaagaatgacccactactcccaagttgatgtggttagtagttttgaagtgtgtgcagtcaatttaagaaaccttaataactagcatactcttagtagttttggagactgtactgaaatctttaaacaagtttggagggctttcaaaataagattcaagtcccgcatctcgtgtttcatagaagacctactcaaagagatcaaaggaggtattccctgaaacctgaaaactactaaccaatagcaggaatacaatatatgttgacaattagtctgcttattggtcatgttacagcaaattatcaactagtgaattgccaaaggagctaaaataatacataagcagacatcttgggttattcctaatatcaactgagaaacttaacatagcctatctccactaacagtatgacctttattgacaaatatggggaaaaaacagacaacaagataactagattgacaagattctaaagtagtacagaaagaactccataaacaatacctgtctgttttagccttcccattgtctaggtgtgtgatctgcagtgtgatccgaacttaattatgagaatatggtccaaaaggaacaaaagatgatataagaaatctcattcagctgaacacaacaaaaaaatagcctcaagaacttagcgcaaggcaccaacagcaactgagtaataacctgggggacagatgcagacgagaactgtggtaagtttatcttgtgtgtgtcaactctggatggagctgatctggcgtcacaagtgaaactaacattttttggctcataagagaagtgcctccattctctgcaaagatatgaaataactagcagattaggtactaaataatattgattttttttttaaaaaaaaagaaggcaatcagattagacaaatgaaaaagcagcttgtgaattccatttaattgatgctcagaatgactgttagaactttccacaatctgttactcttggtgctgaaaggagtcgtcctcatgtgcataagcgagctgaacacggcgaacctaaaatctgacccaactatagactatactatgccaaggaaagtggtctaacactatcagtggacaaattcaatcattgcagatagtctgtttggacaaaaggctaatggttataataaatgcagataatttatctaatgtgaactgctaatagttgacacttgacacatttggataaaaaccaatgcattgcacttagggagcaagtatatgtgacaatgtagaaattttagtcagtaaaatttaaaatgggcatggaggagaaccaacaatgcagcacgttgaaactatgcagttccaattgatgcaaatcagcttacagtgagatggatgatactagaaagctaaggttctgagcagcctttgtatggctgtaccagctgatcagtctcagttgagtttaacatccttatattggtgggtgctaaaacacagtgagtggtgctttttaaaaaaaaaaatctttctggtgaacactgggcacataaattttttcttctactttaattggtgattaaatcaaagagtactaactagttatagcatgctactataggttgctaataactaaagctgttactgaaactgccaatcctgaatacaaagtaacagctaacaagtagtctgcacaaataaaggtggggctcactgacttagtgacttatagataaaggggatcaagtttcgctactcctctgtgccttaaaccataacatcaaatggtaagctagaaagtcacaatgtgcataaatgatcatcgatcagagtcatcaaacaacaaatgagtacagattaaggaaatatatctaccagaacaaaagtgacttaaacttagtgaattagtaataaaacaagtaacagtgcaactgcattttgttcatgacatgaaaaaaaaaatccttgtatcgttctaatcaatagaaaaacagaattgtgcattgagctaatattgttacctaaggacactggaagtaagaatatggccaattgcagtggcaaaagccaaatgaattctaatagccacaacaggaataatgaaacggcaccaaagcattcctgtgacaactgctttttttctgtttgtgtggcagcgatgtcttaggatctaaattaacaaattccaataaaatttgccaccgtgtgtggcacataaggcaatgaataaactacagagagcttacatgccacataaattttcccattgaaagctccgtgaaattgcatcaatgactaacaaattaatgctttgctgataaacgctactattaaacacaaattcgtccactccacccagctaaataggccaacaacagaaagttaccaattttgccgcggtgattaggtaccggattagacagagcaaggagggagtttctcacctgaggaaagttattgaggaggcgagccgctcgacttcggcgtcagggaagttcggctcgtgctccccggttgtgagctccgagatggcgtgcaccgctctggagaagacctccggtgactcgtcaaatacgcagacctcgacgccatccttaacctcctctccttca

SEQ ID NO: 18395 - DNA, 19302 bp, Oryza sativa
  unsure (1)..(19302): unsure at all n locations
atcccaaatcaaaatcaagatccccacaaaatcaacatcccaaattaaaaaaaaaactagccgcctccacacccggtctccttgtagtcattcgccgccaccgtcgttgccgttgtccgcatcgctgctttcggccactaccggctcccgagcccaccgccgctcctagccgcgtcgccacaccggggatggggccgacaccgtcagtgccgtcagatccaccgtggaaggaggcgagaggggtcggacggagccgccgccgccagatccgtcctcggccgccaccaccgcgggcggatccacccgcggtcggcgtcgccggacccatcgcacgagaggcgagagagaggatgaggggaaggacggtcagaggaagagagagggggagcggcgccgctggtgggtggagggggagcgacgccgctagggagggggagaggcggcgcgctgagagagagggagggaggtgggtcgcagtggggaaggaaaggggtcagcgaatgagggttagggttagcggttttgatggattcagaatcatccgagccatcgatgaaaatgaacggctcaggttgatcccgtgtcgggccggcctctcttcccgggccgcaacactgctgggctgttgggccactcgcgcgaatgcactagcagaccggcgggtctatactctaaagaggccttttctttcttttttttaaccttcattatttctctagaaatatattttcttaaaggcccatataatgtaaaactcaacataataatataatattttatatttggtataattttagtttacccgttgcaacgcacgggtattttttctagtacactaaaaaattaaatagtagtgggtcttttggggtggagtggagctgtggagcaaaaaaacccagctccacccccgtagtacaaattctgtgaagtagctatgccaactctgctctaaaaatagagaatccagattgtttggcacagttttggttccacgtaagttggagtgggagctagagatggccaaatggggccttagatactcatggcatgcttttcaaactgctaaacggtgcgtttcgtccaaaacctttatatgaaagtggctttaaaatatcagattaatccatttttcaagtttgtaataactaaaacccaattagtcacatgttattatcacctcattttgcgtaaaatacttaatcttcatctttatcttcaggagattcaaacaccaccgtagctagagtttaggaaagaaacggagaaatagctcgcttcggtcttgttcggtattgagaaggattgagcgggaataattccacaccacaatagatgtggaataaatccgtttcaattcttccctgaggctttgttcggtttgaagtggattaaagatgattgaaggggattaagagagaataattccaataaatttcctttaatctctgtctcaggattaaccgaacggctccttcgggggagggattccgtcgccggagtcgcggaagaggagccaaccggcatccgtatccctggacctcgcagatggggttgttcaatcgagtcggtggcccgccatcctcggatattctgtcggtttcctattgagatctatacgggcctgaagttatgggctgaaagcgtaataatacattaggcccatatagcttctgactttctgcaagacaatgaacaatcaatcggctagtaaacttcctttagagcaaggataataatacagccagctgcttacttgtagcctatctatcagctcattcatataatggttaactcttcactataaatatatggtctacctgtctgtctcacagattttcttggttcttgtgcctaagccggctgtaaacttacagtccgcttctcatctctctcctctcctctctcatccacatcagcattcagccttcttatagccctctattatatttgctcttatcttctttattattatcagcgctgtatcatcatttcgacggaatcttagccaccatatagtactccgggtgccctttcgtcagcatccaaagtcgccattagcgatagtgtaaagaaaaagacagacactaagggcacccacaatggttatctatatgctctctacaagagatccatgtcagcatattttcctacttggaagagattaaatggagagagagagcaaagttatctactaacctagagatagtctatagagaaaaacgaggcaatggattagagagttatagatacccatgtagacatactattgaggtggtttactattaatttagtctattgctgagatgtacatgttttatagataacatcttactttaccattgcagtaccaatgtgctcccgcttttccgtcactgcatcactgcatgcacgcagaattcctctggcaaatagcgaagccggtttgctggaggatgtggtccgcgagacagcggggtggtcaaatctcctcctcccgaaattaggttccaacgattagttttttctttttttaaactcatgtactccctccatacataaatattcttacaccgttgactttttaaaatatatttgatcattcattttttttaaaaaaataattaactattaattcttttcatatcatttgattcattgttaaatttaattttatatatacatataattttacatattttttaaaaaaaatttaaataagatgaacgataaaacatgtttaaaaagttaacgtcttcggagggagtatttatctaagagaactagggtcaagttacacacttacacgagtagcagggcggaatggcggatatagcacggtttactggggtacaaccagttttgcagaaagggccctctagaatgaccaaattacaaatatgtacaacattttgtagaaaaagacctacgcataagtagaaaaaacaacaggtccttctcgtcgatctgctgtcgacgccaaccgccaacgacggtagcttggagctcagcttcggtggtgcttgtagaaaggtgagctgcatgatgtagatcccacacacaaaccttggaggggcctcccaaagatgaaggttgaagcgtcggaccgaaaagagaaaaacttggcatctccacagaagatttccacttgagttcttgaaagaaatcaacataacaataggcacaacgaaaaacagctatatccaaaacaccagcaaagataacaataaaagcacagtgggagccaagatacatatccaaatgggcctccttgaatgggaggttgagggcctctcggcaaacttgtggattccatcaaccatctctttatgaactcttgtcggaatttggggaagaggctgcttggcttggatagtgcttggcagagatgaaattgtaggccggtgtaaccttcttttgtgcaaaaccgatgacacccacgacggctaggggaagaacccaggtgcctcagctcaccgacgacaaggaccaagacaacaggacgagagtagccagcgccggtgacggcgacagcgaccaccttgaggagagggagcttcgagagagagcaatagctgagttccaacgtttagttgaatacactttccgcttgacgcacacacctgaagcctttgttccggtgggctggactgctggactagatcggccagaatctacgccgcgcctagtgcccggtgatccgatcgggaccgatgctccggtacgcactagcccctcgtgcaggaaaaagaaaagctgccggcttcggtcagatggagatggttgggctctatgattgcctttgcacgggaagcgaatgatacggcaggagaggcataataagcatgagttgtcgaagcaataacggtgaaacccaacgacgagttgtcgcgctagtgtgtggtacactggtacggtatagtgtagtacggacgcgacaccgatcgttaacgagcaacacgcacgggatgtgactgtctgtgagtctgtcggagtttcagtgcagagcttggacaggaaacccaacacaggagcagtatttccgggtcttcatagttcacatacacacgagagcaacgagccaatttgtcatgaattcagttcttttacacagctcactgccgctcgatcaaaacctcaaaggtgaaaatggaacgacgtcgtcatcacacaagtcgccatcgccactcgacacggtcaaaatattcaaacagtatacggcagagcagcattattcaaccattcttatcctagattgttggctcttggctgtcctcggcacacctgaaaactactgctatagattttaaggagcagtgggtaaaaattcagctggtgataaaacttttagttcattttctaaattctatcactacatctttctaaaatctggatgaaaaactagattgtttgaaaaaacttttaattatgaggaaactgcagctttaacctgaatcctgaatcctggcacacgcattgtcattttcagccgatgaaaaatctacagacgggaccaaacgaaatggatgccggcaaaaaccatttactgctaccagtttacagtggaaatgtctgacaagaaattgtttctgctggacacactgaagattgacctggtccatcttatgagctttgatgcgggaggacagggtcaaacgcaaccatccaacaaactcgtgtaaaaccaatgcaaggtgtgatggcgcactccatctctctagattcgtggtgcatgggtttcgagattggaaagagtacgaattacccgatgcatgcgtgacaatccagtcagtattttctcgttttttaatggtggggcccacctatcatatatataccctctcatctccttctcctcttcccctctttcactctctctctctctccctctctcggcgagcagggcagctcacggcgacgggtggtcagcgcgcggcggcggagccggacctggcagctacagcccacgacctgggatgcggaggcggcggcagcgtgggacacagagaacacgcgcagaagcaacgtcctctcctccggcgacggcgctagctcgtcttctccggacgacgactccggtatgagcaaatccagcgtcggcgtacgtccaaccacgccacaagccagccgtcgtgtctgcgagacggccgggtcgaaggcgatgaacgcgccgtcgtgtctgcggggccacggggtcgccggctgcgtcaagaaggcccaccgccttgtcgttgggttgcacacgtacgccccgatggtgtcgctgtcccggtcgacctggaagcagagcaggaggcctcaaggccggcaccgcctgcgccgtccgcatcggcgacggcgatgtgatgcggaggaatcacattttagatagtgatatgatggtgttgaacatgcgcgcacgcacacacttgtccttggaaggcattgggaattctggttgaagttacagatcgagacgaacaccgcatggcttggagaatgtgttcatatggaccagaacaagtaaacgttcatgctcattttccttggtggtcaagttgcaattccagccgaagcaaatggggattaacacacgatttgatcgataaagcacacccaacgtttcgtcaatcacagcagttgcggaggcggcggcggcggcactggatgcggaggcggcggcggcggcgtggaccggttcaccctcccagccacctagctacggcagctgctactcggacctggatacccgaccggcaggcgcgctgctccgccgacgccctggacaccggcgcgacgagaaacgactccatcgctgtgcgcgggttgtacggcgtctcggcgtcggcgatgttggtggcgagcaccaccttgcgcgcgcccgccggcgctggctcgaagatcttggcctgcagctcggcggggaggttggcgtagatggggcagatcactagctccgccaccttgccgctggctctgtcccacgctgccgacgcctcagcatcccaggtggtgggctgtagctatccaggtcgggctccgctgccgcgcgccgccgactgcccgcctccgcgcgcgctgaccacccgccgtcgcgagctgcccctgcttgcagagagagagagagagtaaaagaggggttgtgaagaagaagatgagagggtatatatgacaggtgggccccaccatttaaaaaaaaagagaaaatactgactggattgccacgcatgcgccacgtaggacaaaaccgctctggtttgggtcgaagggggtaaatcgtccggtattgaaagttcagggtgaaaaatgtctggttttcgggttcaggggataattcggtcaaccacaataattcaggggggtaattcatactttttccttcgagattctcttctcaaacttttacttatcacatttgtcttaaaacataacaactttttacttatatgtaacttgagagggaggtaacaattttgacgggatcgatcgacagtcgagctgaccatacagccgatgaacggaatcaagcgtgnagttgnagtcttattggcacttggcatcctaaccttttggcatgtggaaatctcaggtctgccttttcggaagcgccatggaatttgcctagcttagttcctgtagatcaagaaggataataagtaaagggagagagtccccaccttacctatcttttactgccattgcgtccttggctgctctggatgcaaaagaaaacgtgcacccgggcttcttgcagctgctggtactgcgtactagtttaatggcacttggttggcgagaggcccagacgaagttgggacggacggcaggaccacgaggaggatctaacacgagcagccagcggccgccccacgagcacatgtgcgccgcgttggttcttctccccccgagacccaccccgaccaccaagaattagcatctgtttatgtcgccgtactcgaacatatgcgtgcaacgctctgcgcctctgctccaaaagcctgctcgtcgcatactatactcactagctaccacgcctagattctgtgccacggccacgcctcgcatttcaatttaccactataataatcgctaaattgatctctttccacgcagaggaaatcatattagatttgcgccgcgcgcttagctatagctagcaaacgacttcgagtctactctactgtctacgacagtgttgccgttcgctgattcctcttctccagttccatttttgtcccgtatatgttcttctttgaatgaaccgatcgaacggcgccggggattgatttgatcgcagacgagtcgggctacgcgcgatttggtctgataggttcgcaatcgatcgattcccagaatctaccgctccatctcgagtggtggaggcaactgactagtcgtccagcatcaagtttggtgctgccaagtgccaacgcactcagccactcacgagtggtcacggagtcatcgatcataatcgacatgatgcatgtaacctaattaatattccagttcgaaaagaagcacagaagaacaaatcgtgatgacacgaaccagtttgtttgctctacctattaaattggcgggttgtgcccgctcgcacgtgctcgccgccggcgcactctcaccggcaagccgcctgcgaacgtggcggtcaggcccggcgcgaacttgggccgccgcgagctccgcgcgatcgcctcgatgtcgaagctccggacgacggcgacgatgacggctttcatctccatgagggctagctccttgccgatgcagacgcgaacgcccgcctggaacaccgggtaacggtacgggctctccgggacgaaccggccgtcccggagccatcgctccggccggaactcggcgcagtcggggccccatacggactccatccggcccatggcgtaggcgtggtaggtcacccgggtgcccttcgcgacgaccgtgccgtccggcagcgtatcgtcgccggcggcaaacttggaatcgaactgcactggcgggaacaggcgcatgctctcgtacatcgcggcgtgcacatagtgcatgtccttgagcttgtcgaatgtggcggccatggttcggttgccgtcgcccgtgacgcgggcgacctcgtctcggatggcggtggcgacctctgggtgatcggagaggagcagaaagaaggcggtgagcgccgaggcgatggtgtcgcggccggcgagcatgaagctgacgacgatgtcgcggaggtacttgtcgtcgtcgatggagcccatgaagcgtgaaaggaggtcgctgccggtggcagcgccgccaagcttccgccgttgtcggatgacctccgccgcgagcgcgtcgaccaaacggaccgcgtcccggagcttcctttcgtccccgacgttcaagaaccgcttcagcctccagattatctgcatgggcaccgtcgcccgccgcgcggagagtgtcgacgccgtgtcgaacgcttccacgagcgtcgatacaggcatcgacagctcgaggcagccagggtcgaggccaaacgagatcttgcatatgctgtcgaaggcgaagcggcggaacatgtcttgcaggtcgagcaccttgccgttgccctcacgtgaagcagagtggagcagagggatgaggcggcacctcagctcggaggccacgacacgcgccgcgaaggcgcggagcgccggagaggcgagctcggcagcggcgagcttgcgctggaagagccacgcgtcaccgtcgacgttaaatatcccgcggccgaggaagtcggcgaggatggcggagaagggagcgcccttgggatagttgtcgaagcgggcgcggagcacgtggtcgacggtgaccgggttggcggtgagcacgttgcggaggacgtgcacgtgcacggtctgcgccggcgaggtgcgcagcaggtgggcgtaccagtcgcagaggttgtcgaactctcccgcccacgacgccgtcaggaaggcctcgcacacggtgcagtcgcaccaccacggcgggcgcaggcgcaccacggcaaggagcgcggcgagggccaccgtgcacgccgagaacacgaagaaggcggtggccacgtgcggctgcagcgacccagccagggcctccaccgccccatgcaacgcctctgcctcgacgacacccatggagacgagctgcggcgcctgcgactgcgtgcgtgcgtgtgtgcgtggtgcgcgcgggctttcataggcgggggcgcgtgcgtttgcttgtgacgatcgtggcgtcccgggagggggccgttttataccagcgggacgtctcgtcgcccgtgataaggggtgggttgggtatatatgagtgagagattgagaggtcgcgtgtcacgtccgtgtgcgcgcgcaaggacgttttgaccgctcaattgttccggtaggcccccattcagcacgttgttattcccctcctcccatgtttgattcccgccatcccgtgtgggggtgtttcagttggcgaggcggagcatgtgcttgataatttcatctgcatgattccgtcgctgcagtggacacatgcatcgcccctgcgccggtgggtttttacccccgagccccattaggatgttctcttttggtaataaaaaaataagtaaatttcataaaactattggtattttgattaaattatcacaaaaatacaaatttaaaatgtgtatcataaaagtacggatttaacaccatatttatcacaaaattacatatttaaggttaaatatcacaaaactatatatttaatattgaagttatcacaaaattatgctggagctataaacattattgttgtgtgactaaattggttctaaacttgtagttgtgttactaaacaagtagttttgtgacacttcatcttaaatgtgtagttttgtgatacatcaagttaatctgtagttatgtgataatttgatcaaagtatatgtactttgaaatttactctaaaagacaatataagacaatataaaccattaatctcattggatcgaagagtatagatctatttatactattattctagttagccgtactacaaacgtagagggtattattgtaaaaaataggtctagatagatataataattatttaattgtgacaatatttttattcctttttgccttttttatagagacaacagaatgaatggccatatatcgatctagaaaaaaattataaataacaaagttatccctaatccatggattagtaaattaccgatttacctttaatagcaaacgatttatattatttttagtgatagtagagagctccaaagcatcactcggcagagaacacaactgaacggaagagagagaattgaaaccacgtactccctccgttttctaatataagggatttttacattttacttgtactgtttaaccactcgtcttattaaaaaattagaattattatttattgagtaaattgcacattggtctaggtatttttacctaagtttcaacatggaccatcctaaagacaaagttttcactttgggctagtttcttttaccaaaagctttcactttggactagatgctctcacatgtcagtagatcaggagataagggaggacgccggcaagcttgtgatggagatgattggattgtggacgtcggcaagcttgtaatagagattattgcaatgtggcaacacctagatatgcgaaggaagttctgcacgcatgaaacgatagcacacatctccttctttcgtcatgtcatgagtgggcttagccatctctacctaaaccgtgccacaccgcgcatcaaaaagttgtttgaattgagtgccatcacaatccaatcataatatctacggcgaggtcagtcacacatgcccaggttgtaaacataccctaccccaaagtgcaactcttggcaattggcaaagaaacatggtgtaaagtgaaaatcttgacttagccctagcccaatatgaaacactggtaaaaaaaatatagcccatgatgaaatttactcatatttattttatttgtgacttactttattatctaaagtattttaagaataacttcttgttttttatatttatataatttttttaataagataagtggttaaacagtggaagcaaattatcaaaatcacttatgggacggagggagtaccttcctgctttggccagtggccagtgcacgtagccttcagtgtcctcgtccctatgtgacgatctacgattccaggggagataaatagcctcgctctctggtcgaggtagtaccagttcaaatgaaccaaaaggatcggatcagcacgtgtggtacagtgcacctacacgagctaactaccgactggccggtcgagagagcttatcgacggcagggcgcactgcaggaatttactcgtgtccacgtcggatatatatcatgactaaagagttgaccgtacagttgtttgcacatcagtatattttaaccgtagtctccgactccgaggaactctttggacagcatcatattttgccacagaaccttcagaaaaacttggacgcaacacatttttacgggctttatattttgccacaaacttttttaatatgacgagtggtcaaacagtacaaacaaaaactcaaaatcgcttatattatgggacgggggagtaatatttatgctgcaaagatatgtctacgtatggatttattggctaaaaaggtgtgacatgacatagttatgctgtaagctaatggcctattggttgtcctaaagagaataggccaaagcaaaatttaaaatttaaaaaacttcacttgtttcatattataagtcattttgattttttttctagtcagatatttttatatttgatcaagtttagataaaaatggtaacattttcaatacaaaataaacataacatcaaaatatattcaacgttgcatctaataaaactaacactactaaaaaaagctttttttgttggcggacaatttatattttagctagcggccagcccaatcgctggcaagaaaaggttagtgaaaatagagtattttcataggctggaattaaccacttacgaaaatattgctggtgggtccgtaaagagaaccgccagcaaaaatcccccacacaaatccaaaataccccactccaaatccaaaatcctctcccaccctagtccattcacaaatcacaaattaaacacatatccattcacagatcacaaaaaaatatgaaaaaaaaatccatccactccaaccatcgccttggccgcagcagcacggccttggccaccctacaagccacgccagctttggctttctgtcgaagaagaagatcatctggttggaggagaggagcatgaggatggcatccacatcgagcaccagcccgccaagcagcagcgcgtagatgatgccatggtcgatagggaggatgccggtcttgtcgaggagcgcgaagaggacgatgacgccttgctcgtcgtcatgtacgcgcccttgaggaggaggaataagcatgcacacttctctcctcagtcgccgccccctcccggcgtcgaatcttcgccgcccgcacttatctccgccgccgccacccctccctgcgccagatccccgccccccgtgcttctcttcgccaccaccgcttgcgcgagctaccgacggtggggagggaggaggagagggagctgtcgccggtgagggaggagggctgggtgggtctagaggaagagggggagttgggaaaaggagctgaggaggaggtgttgggtggcggtggattttttttaatgtggcgatattttcactagcaatgctctctagtggccaccaacgaaaatcgaatttttgttgacggctgtttaagtgggttgccagcgaaaagttgtacatattcgctgcggctaccagcgaagatccattttcactggcggtccatagcccctcatccctcggagtattttcattgacggtgatcatgtatggctgttagagaaaaaaaataggttgacaccatgaaaaatcgattttttagtagtgataatatgatgttgtagatgttgctaattttttctacaaatttgatcaaacttaaagaagtttgactagaagaaaatcaaaacggcttgtaatatgaaatggatgaagtagctttgaagtttattttaagatatttttaatctagtttcttttttatcattgacttttaagttgttaaaaacacatatataaaagttttacagaaaaaatattttttatcactaataaaccgttaggattataattaataagcttttgggcaatcaataagaccctaaacatttatctcacttgatcagatttggttgtcaaaagtataacaaagtttagccaccaaaacaacccgaatttagctggtccacgatttaacaacgggaggatgttagcaatatagttggaaatgtaatttcataagctatatgtctgcagcggacgattatttagctaccccacgataatagtataatttggggacattaattatagtattattttggagatgtaattttgaattgaaattaaaaaagttagctatattttgagacagatgcagtgaaattaaacagttatatcgttctaaatatgcatgggaagtttcatatatataacatcactgtcatcaaccgacgacccaccgaatctagtgcacaaatatgatatcttgacttgatcagatacttaaatctaatcaggtatgtcgcatgctaattaatagtttcatcacttcagtattttatcctatcctgcgcaacaagattcccaaaacgtgcatggtggtgtagacacgtatgtacagttggagcaagccatgtgagcttgtgttggtcagttggtactaaaatattgtccaatatatgtcttctatggataatttaactatattacgttccgactccgttgcccatcgccagaccttcgccactctaagcttccctctaaattactagctcggtttttaaatatttaacgctgttacttttttaaacatgtttgaccattcatcttatttaaaaaaaattatgaaatatgtaaaaatttatgaaatatgtaaaactatatgtatatatatttaataatgaatcaaatgataaaaaataattaataattacttaattttttaataagacaaatggtcaaacatgtttaaaaaaatcaacggcgtcaaaatatttaagaacggaggaagtaccagagaactattcccctcttcattccctctcccctctcccccaccccactcaaaccatgacctaacccacagaaacctaaccatataggcttgttggagatcatggagaacacgttagagatgtagtctaaggtactggcgcactaggtggtgttcttttctccattgagtttgaattattacaaacttgaaaaatagattaatatgatattttagagcaactttcatatataaagttttcgcacgaaacacaccgtttagcagtttaaaaagcataccataaaaatcttaatattcatccaactcttgttggacaaaagaacaggacgagtccgtaagattttacctcatgttttgtatcgaatgtgaagtagcatatctgattttataatttttagtctagttaaacataaccaagaccaaaggattgggaaaatcgattactaacactacatttataaatattaaagtaaatttcacaaaactacatatattttgaccaaactattacaaactacatcatgaaattatagatttaaaatgatatgtcataaaagtaaggattactaacaaaattttcacaaaataatactactccctccggttctatattaattgacgttttggacaaggttgagttcaaacttttataactttgaccatcaataactttaaaaatatttagattaaaggaactagaacaatatatatagatttatcttttaaagcactataataaaagtaaacatgtatttgtttattatacatattataatagaaaaataaggtcaaacatatatcttgtagaccgtgtcattatccaaaacatcaattaaaataaaaccggagggagtaggatttaaactctaaatctgttgttttgtaatataattgcttaaatatagtctgctgtcagtttgataaaaaaaacatacgtagttatgtgaaatttttatcatgatgaccgaagatagctagaagacgccgtcatgacagcgcaatgatgcaaggtgatatacgtgttcgtgaatatttttagtctacttatttatctggttaccttatcaatctaaaagatatctactcagggttggtgagctgtgcttatatatttctgtcatcatgctggaccagagccaagccaatatatgttgcggcgaagagagatgagttaatgtagacacgtgttgccctggcaccgatatcccacactatattgcgagatgcgtactacatgcaatgcatggtgagtgtattattagattcctgaataatagtggttctaataatcttaattaattaagttctgtttttcttcaggcaaaagtggttctgccttctgtggacgtatctgattgaattacgaaaggacccaccgtttgtattctatatagttcttgtccttgttgccattcaatgattatttctagctgtgccttgaagatgtactatatagatcacatgtacatattacgtcgctgtcagtgtcaaccgcttaagacaaagattgttatacccgtcatctttgaaatagttgtcgcagagggacctgatagtaataacattggcagcagtaggcctggtgtgctcgaccaatgtccggatggaccggatgtctatcctactggtcactggagataaaaggagggaagatatccttttcttaccgctgttcaatgataggcccttcattttgtcgttttatgtcccgattatctgtactgattttgtgcaaatttgttgctttgggcgcacttttccaaaggttatttctatctgaactgttgcacttttactagaaggtgttaaagttgtctgaaactctgaatattcataccgcaggcgttactccgtacatgatccgactgagaggatttgtagccaatcagactctcatgtcatttgctaataatccctccgtcccaaaaaaatacaacctaatactagaatatacacattttaatacaacaaatttgaacataaagtatatctagattcgttgtattaggatgtgtcatgctgtagtacgaggttgagttttctgagtactcctgtaagcacgccgattgtctattcttgttggatattgtagctagcgcaatgtcatatttttttttcaaaatatttttctctcataaatcttcatgaatacatattttaaagaaaattctaaaaatatacctgtctcgtcacagcaagtggtgataccctcattgccgccatatggcgataagtctaacgaccctacaaagcccaactagcttgtcatgcaaatgtcatcgcagctagtgatgacatgggtatattttctatttctttaaaggtatattcttaaaattttgttatattcttgaaattttgtatgaacagtgtacgtatttgaatatttaatccaatatcatgatttcaggaggctaaacgtcatctatttagacttgggacctacaactatggaattgttaacttttttattgttaaaatcatccttatcaaaattttatatataataaatattggtgttatcaaattttggtaccgatggacgtgcttggtttggaattttggaattatcaaattttagtacagtggcaatggctatgtttagtttattagaattacctgaggatactacggcccagatatctcatatttgcgaaatattgaatggtgcttcaaaacatataaaaaaaatcagatgtttcatcgctcaataaaaaaaatgttttgggtgttttatcacttgataaaaaatatttcactgcttgataaaaatgtttcgatcaaatgtaacactggtgaaaaactgaccataacacaaagaccatattttatgcaacatatgtatatatttatcagaatataatcatgtgagatcttgataaaaagatttaattgtaagtaatataatgtataatcggatcataagaaaaaaaataaaaaaattgctacacataagtggttggctgtgtgcagaccgagtatgcagcagagaggagaaagaaaccatatagatagagcattgggtatttagtgggttggctgatattgatattttcagcaagccgtctgattttccccttcgcattggtcggccagactaaagcattttcaagaattacacagtacaacgcagacactcacaacgcacgcgcactcaccccctataaacacacgcacgtaaaacttacccctatgagtatcttcgaagactaggccggcaaatccttgagagattgacgaagtcaccacaggcgccttgttgtcgacggttacgtcgcttaccactgaaagcacaacgccgttaaattctaaaaaatccacttttgtggggagtcgaatcaaggaccacatgtgctactgagactcttgtaaccattaggctgttaccaaattttagtagaactaaaaagccgtctatatcgatatgcctaacctggaaggatgaagccgaggacgaatccggatcacctgtctgttagccctagaccggcggcatgcaggtgtttgccgacacgacagtcgacgactcgtctcttttccccgtttcgggcaccgggggcgccttgaccctgacatcgccacgattccggcacgctgcggttgcgctgccaattccccccgtggcccgcccatccatccgcttcctttcgaccgcgcccggggtccccccacctccggccaccaaccgttaaacgatacggacaaacgcgccaaccgctgcacgcgcgcacgcatggccctgccgcgcgcggggctccgctccggttgagttgatcgcctcgcgcgcgaggtttacggccattcgcgaccgctcggagtcaacctgtgcagtgcccacacaacgcaacgagacgcgcgcggaccggcggcaaggcaatgccccgcggcgccggtaatcgatcgaagcgagcagcgagggacgtacgccgcatggcaaccgatccgatcctcccagatggcgcggctcggcaaggcgacagggatggataccgcgcgcgcgccgctgctctgattgtgtgtgtgtgtgtgcctgacagggacgtgcagccgacgcgcggccggcacgtctagaaggcacgggttcgccggcacgtgacagttgacacacttcaggaaaacgagcgcaaccgccgcgctcgcctcggccaattaatccacgcacggatcggtcgcgcgcagcggtatgcgcatcaaaacacgtacacaattacacaattacagctcccgatcgtggtagctagcttgcaatgacttgacgcagaacacgaccggcgtatatgtatccatagaaacgacgacagtacatatcgagacaaagagaagagaagacggtagcacagatggcaccatcacggaggtgtggcacgagtgcaattcggatttgtcaacaccacgggcggagatcacacgtcgtcgatcgcccacttgcaggacctacaaaaataaacactatgattgtgtttatacgccatctaggatctacgctcttttgtcgctcgtgctcactttctctccctcgctcgcttatcctccaaacgctatatatttttcttttctaacgtccagaagcattcgattaatggtgacctttcttgtcctgttgcgtttttttacaccgatatctttccgtaaaccaaatgatttcggggtcttttcgtggtgactggggaggacgtactacaccatgggcactgcaccaacaaccggtcttactgtttgctatttgtgagatgggagagttgaaagatgtgcaccagatctcggcatggccagcaagccggatcaatttagtgataattaaatgccgcactcaaaatctatttcttttcctttgtgtcgtgaacacgttgcttgaagaagcccgcccaaagcaggggccatcttatggtgtagctaggtctgcctacggccctttggtaggtgatcaaggtgtgcctttctattcgaacttggtagtcttggtgtaaagctcaatgtagctaactaaagtaaagcatggttaagaggggcctccatggtatcaaatttcacaaataaaatgtcatttaaaaaagtctccagggatgatagatcagtggaccacttcttttctctctgattattttgtttgctatcaaaattttggaacaggggctgc

SEQ ID NO: 18396 - DNA, 10758 bp, Oryza sativa
agttcaaaataataacgggagcaccagaaaatatttttgtatacttatactttgggcaattaaaaaataaaggtaatcacctagaaaatacccatttttttttctaaaattaagctctataagccgcaactcaagcagtcacctttcatcgtctgcttgttggtttatcatccataatttttttttgaacttttagagtattttgatatttttcttccattgtagcctattcttttgttattgacatgtaaatcactaataacaaaaatatataaaaaatacttataaattatttttgttgctctagtcattttccacaacttaattattagccatatatagcacaaacaatcatagaaccatgattgctagcacgtgtcatttaggtagatatgcaccagctaaacaatcaaaacaagctaaacaaacagagttctaaaatatatataacagagggatgtagtactgcaagatgacgttattttgtttttctctccagttccttttcagtagaatatatgaaagattcagacggttgatgattctagattttagtattcctggcaggcagaaactttggactggacaatggctataccttaattgttttctcttacaatattgcactgcagtacaacacctacactgccctgaagaataagtgttttttttaatatcacacctataattagcataagaataaccaagccacgtcatactttaatcatccgcctgcaagcatgacacaagaggacaagcgttgctgtaagcacgataattataacaagaaaacgaatgatttgaaccgtgataggcacatcagacaaaacgaaagagggtgaaaacctgctctccccctcgtgatggcgatcggtcagggcttgaaattctcatcaccaaatggtgacacatggctttgtttggtactcctacttggcatggttttcttgatactccctccatccctaaatatttgacaccgttgatttttttaaacatatttgatcgttcatcttatccaaaaaatttaaatgattattaattcttttcctaccatttgattcattgctaattatacttttatgtatacttatagtttcatatatttcacaaaagtttttgaataagacgaatggtcaaacatgtttaaaaaagtcaatagcgtcaaatatttagggacggagggagtatgacccactatgtgatgttttggagagcacaaaagatattatcgagaacatttttttcattttccgtaacattttaagatgtgtttacataaaagatgtttgacataaaagctcatacagaactaatgcgaaataatgccgcttgatggttcccttgctgttctagatagatctagttattaggtgtatttataaaaccaattggttttaaacatctatatcacaaagctccgtgtgtaaaatttatttcaagaaaccacaaattttagggcaaagtgttccacaaacctcatacttgtacaaaatactccaatttcattataatatccaatattttcaagcatataggccgagaatacatatttctataccatttattctttttacttcctaactcccccaatttactgtatcagcatcacgtgaatggagtacatagacccaacaatatgtaattggtaattgacgtttattgagaaagtaactaatatatgtatctacttaaaaatatgacattatttttatatacatgtattatccataagtataattgccaaacaaaagatatatgcattaatatggggttttatgaagcattttgcactaaaacttaggttctttgaaacaagttgcaaaatctggggtttttgttacgaatgtcccagaacgtatggttttgtaaaatttactcaattattcaaatttgattagatataactcgtgagatacggcaggtgagattttccacagttgtgtgcttaatctaaacccaatacggcaggtgaaagcattgcctggtcgttgagccgacaaggatgatgtctcttggcgacgtgttccctcttaagggcattgtcgagacgcctccctccctacctgattggacttcatagtaaaaacctttgtcatgatcctctagcttgaagatctggacggacgacaatgacactccctatgttgcgtctgtcattggaggtgtcgtctaggaggcccctttactgcctcatatgcttttcaaacagttggtgcgaagcccttagatggtggcaggtcgcaggtctgtgcgagggagagggatatttcttaccctctccttctacaacctttcgtcttggtgatgttcaagaggctaggtgctcgatttttagggagtggtgctaggcgcgtggcacaattgttgctcctttgttagtctagcggtggccgatcctgtgctagacctttttcttggttgtgtgtaggtgctgtcggtgcatggtgacagtattgtgtttttttttcttttcagagtagtagtcttgtaatttttacatgcactatttaaacattgtattgtcttgtgtggttcctttaaataaatttaagcccatgcaaccatgcagcctcaagccctggaccaccatttttttatctttgatatccttgctccttcggtcttagtatatttgattggggtttttacgtaaacatagtattgtactatgacatatttatatttggtctaagatgtatatatatacaataagggttttgattcaagattcatgcaaatatatcgagataaccgaggctgagagagagagagagtaaaggtgggcatacatcatgtagcattggcaaaaacacattgtatagtgcttgtttaattcccaactttttcttcaaactttcaacttttccatcacatcaaaactttcctacacacataaatttttaacttttttctttaaactttcaattttagtcaaactttcaattttaacgtggaactaaacacagccatagttgtatctgatctcacatggtaggaactatgagtactacgagaacagtgagacagatctccagttgagtgctactgctgcccgtgcctctcagtttcacaacttaggcttagtttagttcacactaaaattggaagttcggttgaaattaaaacgatgtgatggaaaagttagaagtttgtgtgtgtaggaaagttttgatgtgatagaaaagttgaaagtttgaagaaaaattttagaactaaacacggccttaaaaggtgcccagccgtttaggtattctataccacgtcaggcatgataatctgataaagaaatggcagcaagaactgagccatcttatgaaaagaagtcttgtactctcgcctagggggctattcctgcacatgaactcacacatggacgtctggggcctgcttagaagtcatttattaagtcctatcgcaaaaaaaaaatcatttattaagtattaggctacggcttataagccgaagatacatgaccaataaaaaaacaattgtataaaagcgtgtgatgaaaaaaagaaaaaaaacacgctgaattaattttaaattaagttctaaaaatcaaaatttaacatttaacgtggcttataggtcacatgtaaaaaataaacaagttataagttaggtgtggaaagaactgtccactgcatcattggacgtggttgaacagttccattgggtgggacgtgatgactgatgataccatgaaaccactgtgctcataaactagaggcaaaaaccagccataaactacactgtggaagattggttctagatccgtcataaactgttttaggaacattttcttgacgtagatacctgcattttactatcttctaacatgtttaccgtcgaattccttcggtctttttcggtccgaatcggagtgctattccacacgtgaaatggcgcatcttggctttataagctaaatcatcctatctatacgcaaatcaaagaagggtgcatgtgattgttaattcctcgactaatgtttagctcgattaagatcgatcttaccagacagcatgcaataaaggccatattggacatggaacagggacattggggcctccccggcagggatttgtgctcccacaagatgattagtttcactcattggatggtctaattgtgttagttctgtctacataagtaccaacttatgtgcaatcaaggctgggtcacggaccatccgcattcaatcgatgtttacttctcttcgctctgaaatctgaatgcaattatatgctttgcttcatcacgctgcaacagtcaggggcatttaggtagtcagactcggaacgtgtactaccagaatggtaatgactggttcagctaatggcataatcttataatacgaattccatgcaagaaatcgcaaggaaaattatgccacatggcaacacctatttcgtggaacaggctcgatcttgctagcgcgcgtgcagcaatccggaaatgctcgtgtgcgtgcgtgcaacgggcgtccaaaattttctggagtatcaatcaagcaattagtagatgatttaggtacataggtcatggctcagcgggctatgtgatggcacaagatgacaagaacacactaggtgaaacgagatattatgtatgcatgcaaatacccgatgcatgttgatcgatgcatgaactagaaaaaaaaaagaggcaatggcaaatttatcactattttaaatcgttattgtaagactgccactagaaaattacaaaaataccactagaactgtcattcgagtggcatccttaccaaattgaaaaaaacaatggcaaatttgcaaatgccccccctaaaaaaaagttgtgggagagaatgcgctgagaccattacgaacagcctgacatcacttctggcactatcttttcatctacgtatatgctcaaccgcttatcactaattaaaaaaaatacaaaagcaaatgctacaatataaacttcgatgaaaaacaaagcacaaaatcaactttaaaattaagttttaaaatacaaaatttgacataagcttaagcataagaaaaaaaaggggctattcatcccaaccattttcagggcttgttcggattattggataggaaaaacatagatagaaaatgtatcgaaataggaatgataaataaagaaataagaaagttaagggcattcggattgcataggagtataggacttgtatgttggaagaaaaaaagaaagagagagatagagcacttgagatggatggggcattcagattacatgaagttgattacataggatgagagagataaactcatgagagactttttatgatattagaccttgtcggtgacatgggaccgggagtatcatgacttagagacttgaggcagacacgatcacccacgtggcctaaccccctcggggggggggggggtcgggcccgagggtgatacggccgcccttccctttgtctccccgaggggtcggaccgctcccgtctcggccccgagggccgaggcaccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcaaacatgcagattgatgaactgacacgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaaaggggatgatttttttttgggatccagaacgatcagagagggagagggtaagagctctctggttctccagctcttttgtagcttcttcatacatagatccaccaaaacacaggagtagggtattacgcttctcagcggcccgaacctgtatacatcgcccgtgtcttgtgctttttccaatctcgcgaactttccacagactaggagcttagaacctcacccagggcccccggccgaaccggcaaaggggggcctgcgcggtctcccggtgaggagccccacgctccgtcagacctcatggtaaaaatctcaaaatctaatatgaatttgggcattccttagaaatttgataggatttaatagttttcaataatcctttggttcaaaaaatcatatagaaaaaatttctatagaaaaaaatattgttcctatacagaataaaaaaatcctatattttcctttcaaataaaggggtaccatgcgtggcaaagccacgcggtttttctagtagtataacatatttacgtataagcaccaaactgggaggttgacaaatactgcccctatttcatactataagtcattttaacttttttaaattaattttttatgtttaatttaatttatagaaaatataacaatattttcaatgcacaataaaaaatataaaaaattgttcaacattagacgtaatgaaactaattttatgctatagtgttgctatatatttttttataaaatggttaagcttttaaaaagtttaacttaacattttttccatcatacttcttccattgcacggcatatgaaaagctatggaaagttgaaatcggcgtaaactaacgagctgtatcataaagaataaaaataatgttagcatcgcaacagcacattctaagatgagactagagactatgaaagcctcttagtactccctccgtccaataaaaaaaccgaatataaagctagatgtgacacattttagtacaacgaatctagatagagatgtgtctaaattcatagtattatgatatatcatatccagaactactttaaatttttatggaacgaagaaagtagtaatcaacgtacaatttgcttcaagtaacacaatcgatgtctgaatgaactcaggtccaaaggcaataaacaatggggccttgccggttggctgggcgataatctctggaagcatctgtctttatgttcaaagttcagtgtaggacccgacccagttgacaagtggatttaaactgctgtccattgtatgcatgcttttcttgataggtatcaatggcggagtgagcacatctaaccgtggtccataaagagagacactttaggctgttttcgggggtgagtattgggaacccatctcctatacatgaaaaatggaacagtacattaacacgtgattaattatagtggcaaatacataacaaaatgttggtgtggtatcgatgtccccctgccgtgagtgaccactggcccaaaggccccaaactcgagatggattcgactctttcgaggctcattcatcctcgtgtaaagaggtgggcttcatgtgatgctgccgtacaagctacactgttccttgtgctggggcggacgaccgaacgtgtgctacgctgctactacgacggacggatgccgacctccgacacgagatggccacaacaaccaccgccgagtttatgagccatcatcctttcgtcctcgttccgccgtacgacaacgtctcgcgccatcagcagcggagagagacgatggacgcagcggcagcgagaaaaacgcgcgcattactactacccacgtgtggcgcgcggagcagaggcgagtggcaacagcaacgtctcactagccgacagccgggcggccggccggaaggttttctttggatcacggcctcaccgcgcgcatcgccgtctcgtcgtggcgagcgcggggcgcgacggttggcgcgcgcgggctccgtcccgtcctttgtcaccgccgcgagaggcgcctcgcaccggaaccggccggccccgggcccgggctgcctgcctcgccctgtgcggatcgtacgcctgaatcagcgtggcggtctgtgtggccttcgtttggtgagagcctgagaggacagccgttcgctcgcaaatcgcaatgccgcccccgccacggccagcctccgaccgattcgtgagcgcgcgcgcgggggcgggcgcgacacgtgactgcacgagataatgtctccaactctccagggaaaggtaaggacagggttgatcccgcggtcgatgtagccagccagggaagacgacgaggtctggtggtttccgcgcgcgccgaggcggcctcacacaagtcacaattggcggggaacgatgggtggtggttcgcgaggggccgcaccctcgtactgtctctttggaacaaagcgatcgccatcgtggccgaccggtcgagagcgaggcagcatcatcagtgaaaacgtcacggcctcgcgacgcggtaccgttgaggcggtgacgccgaagatgacttgactgcggcgagggtacagtcgtacagatggacacctgattaagcgacgttcgtggatggaatcaagggaggatgcgggtcaccttgcagcatttgtagagcaaaagcgacgtgcaggatgggtgttctgcagtgaggaggacggatcaaggaagatatttatttctgatgacgtgactcaaatggctagaatcctaatattggttatttgtagagaatcaaatttaggcaaaagtccaaacggcatttcttctctgggcttagacagaacagagtacatattattggtttcacggcaatgagtagccaatgacagatcagttgacacaagatagggtcagacagaagtaacgctccactccaagggagtgactggtgagcagctgttggccgctgccccatagccaggcatcagctatagaatgactgttcgtctggggcccgatgtgattcccaatttctcaagcagaaatcctgaattggagcaccatgccattgcaagttttgagtattaccacggctgaacggttgcaacttgcagctgaacccaaaataactgaattagcatttcaatagatctactcttcagaaaaagcatttgtacatgtaatcttgcagtcctactaacggtcccaacagttgtacagtcctataatacaacaagccaatgccaattagttgaagatgtactacagcacatatcgtccaaacaccgaatatgatgacaatgcattgatggctcaggatttggagggtaatcctattgaatttctttcatggagagcctgtggcaggtggcttgggtgtctgatttttctggttagctgcagcttgcgcagcagagccctttgcgttactttcgctggccattgacttcttgatctggacaggttcagacaaaacaataacatatcacaccgcaagcaaagacaacaatcaaatggacgtatcggcagaacgctgtatttggtgatgagaaatgaccatcaataggttaattttgaaacagcattgagaatagattaggatatttgtcaattcacagtttgtactactttgaatagagggaatcaaaacaatatgtttccaagatataagatgggaagaacagttaccagagtaagcctctccctgtgaatatcattgacatgctgcaaattgtaaaggaaaagattattacagttacaaacaattgtgagaattcatagcaagcaatcaaaagcgaagaaataagtatgcaaatgtatgaattaccggcttcttgtacagttttatttcatctccactgaagcctggcaaggtaatattccagcttctctctgcaatggatgacaattaaatcatatgaaaaatgcaattgaaaatttgaaatgctatgacttgatagcatcaccacaaagattctagaagaacaaaaatattcaagttacctgcatggaggagtacatcttttgcttctaaaatgcttgactttctatgttttgctaaagaacaagcaaatgttgcaacctgctcaaaacagctaattaaaaaaaaggtacagaagacatcctagatacaccaggatgacaaattcacatgttgctgatgattaaagggtgacaactttcttctatatctaaagacagcataacttcgacccagagcttctaggcctctagcaaccattaggcagtgtttactatttcctcacacaagaagaaccagagaacacatccccgtaataagcatacttgcaaaaagaaactattggagaacagcaatgatggtggagggaaggggcttacagattcaacaaaatcttctgcaatgtcaataagaacatcttcaacttcaggatcaagcttttctgaaggatcaatctgttggaagatcacagcatgagaaagttatgatgacacttaacttttgcaaataataaaatgcctatttctacttaagtgatgatgatccataactgataaatattggtaaaagaaccaactaaatccatcacaggcagtggggtttatgaacctacaatacccataacatccgtgaacccctatggttgcagcccctacactcaacaactctagacaatcatgacccagataaat

SEQ ID NO: 18397 - DNA, 2828 bp, Oryza sativa
  unsure (1)..(2828): unsure at all n locations
ttcctgcagcccggtttaactgtgtttttttcattactaaagaagggtatactttcaggtttcagttcaggaagttgtgtacctgtgcaactaattcatgtatactcctcttggaaagcagtcgattaccagatcctccagcatccacatcgactgaagccatgtctccagattgcacattagtagcttttagtacagcaggagaatctagcttctgagccattgagacaggggtacgagcagtttgctgctgagaaatttgttgctggtttctgagtgttgtagtctgttgactttgctgcgaggaatgttgtggctgattttgttgttgctgctgctgctgctgtagcttttgttgctgctgctgctgctgctgctgtagtttttgttgctgctgctgctgctgttgctgtagtttttgttgctgctgctgctgctgctgctgttgctgcaaatgttgatgttgtggtagtttttgctgctgctgtgttaaaagtgcattctgtgggtgcgaaattgcaggagcatggtatggtcttggatgtggcctatgttgagggggcctaagtggagcagatacatttggcggagtttgctgtaaaggcatcgagggggaagaagccatagatggtggtcttgccaaagcttggatgggggttttctgttggaatatagttaaatgaagttagggttaataagaggagtgttcccttgtaactggattgaggaatgaaaaatacaaaaaataaacaatggtgcaagttccaattgatctcattattcacagaacaaggtaaactcataaatgagttacagttgccaaggaaaaatgacaaaatatgtacaaggaagcataagttatattgtaaataatcttattcacataattaggtacatcatataactgaaacagaaagcttatttgcctatagatagaccagtctttgctttttacaagtgaaagtttcttacttgtgaacttgcaatctggctatcagatggagatggtgctgttgaagatggaaaatttggccttgtctgctgtggcagactagagattgctcctggtctcacctgagatgtgttaatggaaccaactgtcccaatattttggatcccaggggaaggctgcctaggctgaagaccataatcattactaagaatcttcactgaattcaaaacaatagagaaaaggtgcaatatgtttcaactaacagcgtgcatgtactttgcaatggaaattggctctctttatactggattatattgaacaacttttcggactatatatgtttttttttggatgtacattngagntggctgcgtgggaactgggaattaatgatctctagagaggatgaatgtgttggtgtaaaaattttatgcgagaggagatggagcatgtagggcctgttcactttgatgccattttcaaccataccattttttggcaaagttgccaaaattttggctacgttaagtttgttgccaaatttggtaaatacataagaaatcctgccaaaattttggcaatattgccatcttgccaaaggtttattttggctacaatctgaacatgcccgtaaccaaccaatcatcattagttcattagcaccaactaaaatattataagtaccaaagatgaagaagtattaacaactatagtcgtttagaacagtagtaattagtaagtcacagaagaacaatattagagttcaataagctccacttaatgttttacgcagctgaactgtcagatgcatctacatttcttctacgcacacaaatgtcagctggatttgacaatttctgggattgttggctgaaagaaattagctaaaacatcagggggtaggatttaagcagccaaatcaccaaggtacagatttcgcgaagacttgttggtctccatcccacattcagacccccatgctgaataaggataactaaaattgaaaaatgggttccacaaaactgcagataacaagcatgtgacatcaagcaagataatcctactaagtcatggtttcctcaagaaatttactaacatgggatcagatatcgtgtcattattatataaaagaatgtaattcttgctgtcatccagatcagttatttcctgaccaaatgaaaacctcatactaccgagagcttaatcacaccagaatataaaagtgcggagctaagcatcagatacagacctgtgtagaggatggtgggggctggtcaggaccccgatgcatcgagccgaactgcgcggcgagtgtcggcggcggcacgaacccggtgtagccgacgggcgtctgcggcgcacgcgggtgcgctggtagcccaagggctacacctccccgtggcatggcagatgaggacgcagaggtggcggccggagcggaagcagaggaggaagaggccgcgcccgtggccggagaggaggacatcgtgatgggcgaggccaggtgagtgtacggaggcctcatgcggggcaccggcggccgcgcactggcggggcttggacctggggttttagggtttggcggggggctggggtgggattggggnccggggcaagggtggtgtcnngggtggccggcgcgccggtgaaggcgaaggggttgggattagggttgtggcgcgggatgagnggggcagaagcccgagggtcgaagttgggcggcncnngcnggcnccncccgcggcggcgtccggttgcgcggccgaaggcgcgtccatggtgttcgacggctcagcgaggcgggggtgtctttgataagatgacagaaatacagatgaaggggaggacttgaatgcaaaatttctcttctgaaaag

SEQ ID NO: 18398 - DNA, 7924 bp, Oryza sativa
cgaggactccgacggtgacgacaccgacgaagcagcagccgaggacgaacacgaagggggtgtggatggaggtgaccaggagcagcgggaagtaggttccatgccttccaagttccacctgtaccaactctccgtccaggtaatctcgctagcttcactagtgggatagatcggtgaaattaagtctccgtgcaccgaacctgttcgacgaaatgctaacagtatgcgtctgtgtttagtcgccaaaaggggacattagctacctgcagaagttcttccttatgtacgtcggcgggcgcgtccctctgcacttccaagaggatttctgtggcacggccctcctcaggtcaatgcactaaacttttcgatgaagtccatgtctgtcatttttcacacattgcatgtgtggttgaagacttcagcagttccattagcaagaaatgtgccaaatgcttgaatggttattctttggagaactttgatcaatgatgctcaacaatcaagagatcagttaactttagtgtgtgactgtgtgatgcatgtgtttttggcttcttggtcatgatatattgtttgatttcctgttggcagtgctgagtggcttcgtactgatgcaaggcgtacagcagttggcttagatttggaccttgagtcacttgagtggtgtcttgaaaacaacctgagcaagattggagctgatgggtattcaagaatgctacttttccatggaaatgttctacagccaaatgtagctcgcctagtcaagcaaaagatctgtgatgccatgcaagatctgcacgtaaacaatgataatgactctttagcaagtaacatctgtgatcagttggatcctgctagcccaaaatgctcagccaattcaaccatgtcggatttggttttgccggcaagagacattatttgtgcattcaactacagttgctgttgtctccacaggagaaaggacttggttttgtattttaggcatgctttcaatgcactgtcaaaacgaggtggtatatttgtaatggatgtgtatggtggcacatcatctgaacgcaagctacgtctgcagaggaggttccccagcttcactgtgagtgatgttgtgttagttattagcccttatactagttacgaatccactaaatgctatcttcttgctcaccagatagaaatgtggtaggcatataatgccctgaaaaaactgcgttcttttttatgaaaattcacactatctgcttgtagaatctgcttattccaacataaagatgttgcagtagtagtagtatgcaacataaaagaatgttttagtccgaaatacaattttctattgaccatgcctcctttttatagattctaaagcggttagctatatttttatacaacttcaatctagctattctgaaataattgtaaagtatatatgctatgttgttaccctttatggtgagattttgtgcctcctttttatgactcgatgtccatttcacttatcagtcatataggtttttcccttgtgtagtttattctagttgaaataaacaacagatagagttgtccaattatcaatggcgtgcgatttggagaatgagaatgagattatatatagatttatattactgttcttacatacaagatacaactatgcattcagtatttctgggagcaagaagagttcgatatcataagtcaccaaacaaggatcagtctccacttccaagctggaaagaagcaaatgttacggcatgctttcacgtaccattggcgcctgtaagttgatcacatactattgagaatggtatatttcataattattattgctctcctgtttccttagtggatcttcaccgtgttatggaaaacctgcaaggttgtaactgtcaaaaagaactatagaaattcttattaaaatataaagttgaaaatattttgcttagtccggtcctccggtctacaggttcaggggggaaactagattggtattaatatcatgtgcaaggtgtttagaatacatgtgtattagtcaagggtattgtagtcatttcccgtttctaggccaatcttgtaatctatattttccctttaggcctaactcaagataacagagagttcattacccatttacatcttcttcccaaattataacacagggaacaaccaaaggcaatgccactttattacctctgtgatatattgataccaaccacttctacatctactatatctctgaggagatttttcacgtgctatatctttgcactcttcataatgaagagtatgatgtacgggattgtttttcaagtgctgtgtgtaacacaccctacactacctgcatgacttcctcgcatgttaactttgttttagagttgcactggagtatcaggacatcttagtcctgtgcaaagaggaaggataccttcaaattcgaaattcatgttgctcctttgtaggtggtcgataccagaaatcaaagactgcttggaggaagctggatttaaatcaatccatgtctggatcagggagatgccaaatacccaatcaagtggaaatgctaaagaatataatgccaaccgtgatgtgaaatatgaagaattacagcatttcaatcaagcagatgcttggaatgcatatgttgttggagtagcaaatatctagatgattcatgctaccttctttttttagagagaagatgttggaaacctttgcagttttccgttctgatgctatccggtcagtttctctgatgctgcctgccggagtagtatctttttatctaatgcacaagtgcttaacatggattcccttctcgttgaaactagaatgtgtaattgctccactctatgccaggaaactaggaaagttgtatgtcttgggctatgatgtttgttctagatgagatgctagctaacatgtagtatcatcatatctgtaccgatcaaatagagagcagtcaaaccccaaagacaatctactgaagatggtgattcactatttcttgatgcagtcatacaggggttgtatgtccagtcagtttcatgcagcataaccttttcaggtttgcatgccaatggtgttctgtgctgattaacttcctgagccactgagtcccctaagatatgctgtcaaatgtttgattaaactggccgagttaccagatcatttcctctccgcaataatctctgcattgtgaacatctcttctggcagcagatgtcctccacaatagaatctgtgaacctgccatcaacagcatccttcaaatcatccatgcccattgacaattactcgcaaggaacgggggagatctaagaaaattgttagaatagatgtcgaatatactaattctatttggttacagttggatttaaagttgtaataggtggtagggggtagaggtagagtcggactctataacctagcaactctcttaaatagagaggcatggagatgatggtggtgtggccatggacttgtagcggctaggagttatatgggttgaggagcgcccataatcaaaaccccaggacataagcttcggctaaacctcgttaacaaatattgtgtgttcttgtgtcgttatctgacgtgtcttgggtgatcattgattgaagcgatcgagaagattagtcgtcgttccgctatatcgactacttcctccgtttcataatgtaagccattttagcattgcccatatttatatagatgttaatgtgagcaatgctagaatgacttgcattataaaacggagggagtaacttttatatataaaaaaggtctctacgagctgcaaacatcctaattcaatcatttccatttgagttttcagatataccaacacaaagtgctttgctggctctgcagagctgaagccgacgacaagccactccgaacagttaaaaaaacattacggtaccttatgcatctgcattaaagttttaaataatataaataattatacgtgtgtctaaaagttcatagtgttatctattagaaaacggagtgttctaaagttaagagcgttatctcttataaaacggaggaatacaactttttcaggttcaggcagtgtccaacatggcgtgtccaacatggtagtagcgccattccacacgcctgtatataaccgcgcccattgctccccaggacaacatggaatgcatctttctaccagaagatagagctttctctgccacgaaatattcagctttactggataccgtctacagccgtctccattcatcgtttcctttccatgatggtgtgacagaattggcttttgtatcgtgttcgttcgtccagtcattttcgtgtgctaagcttcgcaggtcacagacatgcctcgtcaaatttggttttagtcatagacatcacgtaaaatcgaccaactgctcggcaggccaacagtaatgatctcatgatcacccagctgaaactaatcttggcgtgcaatgcattcgcaacaacactttacgccagctaaagagcgagcgagcactgaactgaaggttccgatttccatatcaatcctgagctgatcaaagtgcttgaaaaaagattcttagtgcttgccattgtggatcccgactagattagaagatgcgaggccgaggattatggcgggggaaacacactgcaaagaataaataatcactggagttctagttgtcgtagtggtggacagagacagattaatccagcggcaaacgcgacgactccacgttgccgccgtgccaatgataatccgagaaatcgagctgcacggcggaacaaaggagagcgacgtaaaccggattaatccaaacggcttcgaccatctgaggggatcgagtgaacaatgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatccaatctatggccagctcgtcgtccaagatggcagccactaatcctttcggaggaaacacaatctcagagaaattagccaaaaacaactatgcgctatggaaagcgcaagtcctggcgtcggtgagaggagctcgtcttgaagggcatctcactggcaccacagcagcgccggccatcaccatctccgtgccaggcgagaaggaaggcgacaaggccaccagggcggctaatcccgcctacgatgaatgggtggctacggatcagcagatcctagggcttctactgagcaccctgtccaaagatgttctggcgcaggtggccacctgcggcactgcagctgccgcctggagcatgctggaggagatgtatacctccatgacaagggcacgcttcatcaacactcggatcgctctctccaacaccaaaaagggcgatctctccatcacagaatatgtcgccaagatgagagcacttggtgatgacatgacggcggctggcaaggtcgtcgacgacgaagatctcatctcctacatcattgccggcctcgacgacacgtatgaaccggtgatctcctcaatcgtcggcaaatctgagccgatgtccttcggggaggctttctctcaactgctcagctttgagcagcgcaacaatctccgtcacggcggcgagtcgtcagcaaacctggcgaatcgagggcgcggcaccaccggcggcaacggaggccaacgcggacgcggtgggaacaaccgtggacgcggcggcaatggaggcaacaacagcgcaaaccgcggcaagggtggtcgcgggaatggcggcttcaatggaggacgtcaaggaggtggcgtcgacactaggcccaagtgccagctatgttacaagcgaggacatacggtaatcaactgttggtatcgttatgatgaggattttgttccagatgagaagtatgcaggttctgcagccacctcctatggtatcgataccaactggtatgtggatactggggcaactgatcacgtgacaggagagttggagaagctcatcgttcgtgatcgctacaaaggacatgatcaagtgcataccgctagcggtgcaggtatggaaattagccatattggtcactctattgttaaaacccccagtcgtgatattcatttacgcaatattttacatgttcctaaggctaacaaaaatttagtttctgctcaacgtcttgtttctgataattctgcctttatggaactatattctaaatatttcaatcttaaggatctagccacgaagaaacttctgcttagggggccctgccgtggtcgtctctatgctcttccatctacaccgccacatgcacactcaaccaaagaagtttatggagtctccaagccatcttttgaaaggtggcacagtcgtctcggtcatccctcctctccaattgtagagaaggtcattagcaaaaataatctcccatgtttagttgagtctaataaacagtctgtgtgtgatgcttgtcaaaaggcaaagagtcatcaattgccttattctatatcatctagtatatctagtcatcctttggaacttatttattctgatgtttggggtcctgcccccacttctgttggaggcaaacagtattatgtgagttttattgatgatttcagcaagtttacttggatttatttaattaagtttaaatctgaagttatccaaaagttccatgagtttcaggctcttgttgaacgattgtttaacagaaaaatcctagcgatgcaatctgactggggaggagaatatgagaaacttaattccttctttaccaaaataggtattactcatcatgtgtcttgtcctcacacacaccagcaaaatggctcagctgaaagaaaacataggcatattgtagaaatgggtcttgctcttcttgcttactcatctatgccattaaagttttgggatgaggcttttacttctgctgtttatctcattaatcgtactcctagcagactcttgaaatatgcaacgcctttggaacgtctgtttaaacaaactcctgactataatattctttgtgtatttgggtgtgcatgttggcctcatctccgaccatataatgctcgcaaattacaattccgttccaaacaatgtacctttctaggttacagtccccttcataaggggttcaaatgtctagatccttccaccggtcgcgtttacatatcccgtgatgtaattttttatgagaatgtttttccctttgcctcacttcatcccaatgccggtgcaaaattgcgttctgaaattttattattgccatcccatcttgatattcctattattcctggggtgcaacaaatgagtaccactgtggctaatggtcctactaatcctgctaatcaaatttctggagatgaattatcgctacaggaaaatttggcagcaaataatgcagctccagatggtgcggacgcagccacagctgccacgaaagatccagcggctgactcccctcacacctctgacgcagcgtcttcgagcgtcctccagcgtcgtgtggaggccaccgtagagtcctcctgctctcctgatcggttgcatgtcgagctcacaccggcgcactcacccgtggccatgcaatctccagatgccacgtctcctactgcttcctctgactcacaggagccatccacgtctcttgatgcttctgttgcaggggaggtagatacacagcaacaacagcaccaggtaatatctagaccggctacgaggttgcaaagtggcattattcgtaaggaaaaagtttatactgatggtacagttaaatataggactacttt

SEQ ID NO: 18399 - DNA, 2575 bp, Oryza sativa
gaaggatcttggagatcttcattactttcttggtattgaggtaactaaagtgtctggtggtatagttcttactcaagataaatatgtcaatgatttgttgagaagagtaaatatgtttgactgcaaaccggttagtacacccctgtctacaagtgagaaattgtctataaatgaaggagatcctttaggaccaaatgatgcaacacattatagaagtgtagttggtgctttacagtatctaacattgactaggcctgatattgcttttcctgtaaataaggtttgtcaatttttacatgctccaactacacaccattgggcagctgttaagagaattttaagatatttgaagcaatgtactagacttggacttaagttaagcaagtctagatctatgttagtaagtgcttgttcagatgcagattgggctggttccctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaagttgcagatggttttacaaaggctttgtcagttcgacagttggagaattttaagtacaatcttaacttaggaaagttatgattgagggagggtgttaaacatgtgatatgtatttgtgtgatgcacacggcatggttagatggatagatatgattagataaggctagattgagtttgttgtaatagaataggagcatatctatccatccacctgcgccgatctctgtaacctacagcggtggttattatcgctaatataagattaacaaaggtacggcctgagagggttgaacgcttctgaacctctgatgtttgataaacaagacaagaccaagaccaggacggctgggggcggcaacatcagggcgtggattaaccgaggcggattggttccggccaaagttgaccccaagtctaccggcctaggctggctgagttggaaagaattcaatgaatcgattgcgacgagtttaaattctactatacagacacgtaaaacacaacgaaatttctctgtttttgtcatagcttacacgccgaaaacatacgctactactagtagtactagtttttttgaacgtgtagcttgcacacgtaaaacactggatgcaggttgttaatactccgaggaggccgtataacaatcataaaaagcgtcatgtggcgcgaggtacagagttcattgcgtttctgcatgaatcacacacatcgaacgctacgctggacaccacgtggccacgccaagcttagcaactcataccgacggccccacctgtcatgcgtacaggcttgttgtgggacccacgcccgcagccctgttccctgcagagaatcattatatactccctccaatgcacgaacccaaccagagcacattggatcccccgttcccccgaacccaaggtccaaccaaccgcaaactgcaaacatatcacgctccctattttagtaccacctcgcgaaccggaacgcatcgcgtccgataaaaaactcgtcgccccacaccgcgcggcactcggagctcagctcgcacggcacggaacggaacacaaccctccctgtgtctctctccctgatgcgccgccccccatgcggcgggcccgacccacttagcccgcggcggcggatgctgcggcggcggcggcggcgatgaagcggccgctgcggcgcccgttcgcggtgctcctcttcgtcgtgctgtgcgccgcggcctcgttccctccgtgtgcgcaggtcggtgggcccggctaccgtgctcgcgcagctgacgccgcttatcccgcgcgccttaacgccacgctctttctgcttgcagcgaccgatccatcggaggcgccgctgcgccgcgacgtggacgacctcctcaagggccggctcccggcgtcgtccgcgcgcgccggcgcgtgcgccctccgggcgacaaggctccaccttcacctccgccaccaccagttccccgtctaccggcgcggccaccacccggatcacgaccacgaccccttcctccacccgctcccgcgccaggagctccacctcgacccatccctccgccgcgcgctccgctcctggcaccgcctccgcgggcacgaccccggcgtcctccgcaatctcccttccctcctctccctccccggccgcatcccctcctgcgccgtcgtgggcaacagcggcatcctcctcggcgccagccacggcgccctcatcgactcccacgccgccgtcttccgcctcaacaacgcccgcatctccggcttcgccgccaacgtcggcgccaagaccaacgggctg

SEQ ID NO: 18400 - DNA, 27350 bp, Oryza sativa
gcagccatgattgtgttgtattagtggctcagtgtaaaatgttgcttcgtaaggtgggttattttttgtgattagattgatagacgaattgaaatagtagcgaaattttgatatgatggtgggattggaggtgtgtactaagcattaggatccctccattagcatacgaggacgatttcttccgcttttggcactgtaactgtaatttagactgatctttcttcgtaatttcatgaagaatcaattgtacatcttctatacagccttgctgcaactttgctctccatgtttcccaaatggcaaatacaactttagctttgcattgtgtcatctgtgtaccttccaaattccaatttgactgctcatttcacctcggaaaataacttgtgcaagtccttccctgccaatgcacttcttctacctctctaatccgattgctaaccgaaggctcgaagctttgcactaggttggtttgtgcatgtatgtgttgccagttgccactcctatgttttgtagtactatgttcatttcatttttataaattctttgcggtgaacgcactactatgactttaatgtattacctgtgctgagaaaaagatgctttgatatttcagggagcaacactacaaacttaacagtgaatctagaggatttgtatttgtgtactttataggggatgtttgggagagatctcaaaaacataccgtaagtctctagggagggacttatacttttgtgagagggactaaagtttagtccctaaatcccaaaacctccctagtatactcgatgttttcccactgtaactaaacgatctcatggccggccatgatttgatctgacaacaatattctccttgtttctttgaagtgaatccaccatgttcgtggatgcgccagttccgcacctcatgtaccttcacacatcatgatgaggatacattatgggagtaaccacttcaccgttgttatttaatccagatcaatgtgtgaaatacggagtaagcgattgatgatttggtccaccgtgttactccctccgtcatgaaaaaaacgaatttagtattggatgtaatatattctagatccagattcgttgtactaggatgtgtcacatccggtactagattggttttcgaatttagtacaggatgtaacatattctagatccagattcgttgtattagaatgtgtcacatccggtactagtttggtttttttttatagaacggagggaatacacatctgctgatccgctatacatcacgcggtggtttattaagtttaaggaaactcccggcatgatattgagtgtgctggagcttattttaaactaaaagtactaagtactacaaattataacaactttatatcacttttgacatttatccttgtcttaaggactcttctgtttgtatctttccgatcccgcctagtgattgactcaaataatcgtccctattatagtgatcgaagtgctagcgtgtactgatactgaggggctactctcttgaaatggggaggttcttttatgaactcgggatccatacacaaaatgatcctgatatagtatactcctactttgaaatggctatccatttcgatgaatcatatgctaaattgttaatggttgcacttggtcaggatgatccggatgctctttgcttgtattgcttaattttcgacaaatatcacttgaaagtttccttttcatataaccattcgaaaggagtaggaggatttggctatatacattacaatctgaatcttgtgttttgatctcagtatgaaatatgtgtttgatgccatgcctcaacttgtacatgcctatacctagattaggcacgccacagtagacaccctttgagactttgattcatgtcatattgagtttcttccagctccatggtgagcatttgagatgcaagtagtacatgtatagtccacatgtgagaccacttgttagctgttactacagtacaatcaatagagtaaatgagtaatattaccactgtactggggtctgagtagatagatggtcctattacctgttctttaccactatgtactttggttgaaacttggaacgacgaccacgcatatggctgtgtacgggcgtccattttcccaacctatattcctcgttttctgcacgcacgcttttcaaactgctaaacggtgagtttttttaaaaagtttttatacgaaagttgcttaaaaaaatcaaattaatccatttttttttaaaaaattagctaatacttaattgatcacgtgctaatagatcgctctattttccgtgctactgggaacaacccatagcgaacacagccatatgtgttttacaccatgaacctactactattaccaggattgattcaaaggacgcgcccgtgctactgcagttagcattaaaagaatactcgaatcagtacctaaaagctgcttatcgcttgcctgacaaggaacttttgcaacttctgccactaatcggtgtatcctaataaagtgatttgacagcctagtcatgttttggagctcactgatgctcccagccttccaccagtccttgccggcttcgtggtgcatcatgctttgttgctgctagtgctgctgtgacattggagtgcgtatgtcaggtacagattgccagtttatggctgtagtctgaagtctgaactccgcagctgagcagattggactattggagtagtatgaagatgggcttcagttcctaaaaagagtccggtgaagattcagcctattgaaacgatgacaacacagcccagtaaaggtccgagtgtagaattacagcctccctccaacaaccgggctaaaccagaatcagtgagtacagagacaaaatcaataaatctagaacccaaccttagagccagcagtgtgactagtgactcgtagcaactgagctgagcatgtcatgatgccatggacgccgagcttattttattattcagagaatgaaagagacagacaaatgtcacagactcagtgtcaaccagttaaggtgctgtttcgagtgtataccagtagtggttattttgtggtaggtggttaatttgacttgggagctaaatggctgattgtgatatttaccacccataactcagaagagtagacggcaaccgaaaattctcagaaagagaaaaaaaattacagggttcaaccaagttgaactcctacacatatgttcacccagttactaccattgacctgctgtcatctattgtatttttcctgttcaatgcatagtttgatacgattttttcttcgttgattaactttttaatatggtccatcctgaagactctacttgtccaaaggcagagtttgactgtttgaatgtaatcagagccatgaaagattgaaagtgtgtgtgtgtgtgtgtctgacagtgtgagacgtacgtgcagctatcgaacgagtttgtgcgtgcttcgccagcgtgactatgttctgatgcaagctcactggaagtccattgtttgtcgccactacgccggaaggtcggaactcggaaccacctcctctgcagtcaattacataaagtacagataacccaatgcattcagacagctatgtattgtcgtttttaatggagactttgactgatcagtgaaagaatactgtatagtactaccttcaacacggtggttgacaggagaaagttaagtactccatcgctctatctcaaaataaatcaacatcctaatacaataaatctgatataaaatatgtttcaatttgttatactttgtactaagatatatcacattctagtataagattagtttgttttgggatggagggtgtcagggttacagataaggcataccctctatcctacgacttatggaatataccgataaggtataccttcacgtatacggttggtttctgtatacaccgttaggaattcacctcaaattagggaaaatatctccacgaagttaaggaattgcaaaagtcctactcggaaagggtaaaatctatagtatatcgtgtcggtttacatatctccaagttttacttaagggtcaaggtatcccacggtataaaagggacccctagggaggggcaaaaggcatcgcacctcatcgccaacacacccaccaaagtttacgaagccggagtccacggagccaactcgccgggagatcttgtcgagtccctcgactacgatctcatcggtattgtctgttcggttactctctttgtaatctgttctcatcatcatcaatcccatataaactggactaggactattatctgataaggggcttgaaccagtgtaatcattgtcttttgtctgttttgatgtcgtactacgtagatcctgttctaacgtaccccaataccctattcttctggtccgcgagtatcactcgtcgacagagggcacatgcagcataaatggacagtatcatctgtcttatatcaaaggtatatacccctagggtcctagcaagtctgtgtaaaagtgatgttgtaataagctcaactgatactgaaaacgaaatatatactccatatatcataaaataaaattattctttatttatctcatacatactaataaaatataaaacaactaaaatacactaccgctttatcatattctagtataattattcactttatttagttctaagataactgttctttatttttataaactttgattgaatgattgctaaatgaatttattttaggataaataagagggtgcaagataaacctattgtggatagatggaagtaggcatcagttcttctactccctccaccccaaatataagatattttggttagataagacacatcttcagtactatgaatttagacaatgcaaggagcatgtctacattcgtagtattagaatatatcgcattcaatcaaattttcttatatattaaaacagataagtactccttgtcccaaaatataagcatttttagaatagtgccaagtcaaatactttaaacgttggctattaataacaaaaaaaaaaatcaatcatgtaaaattgatgtcactagatttattattaaacaaactattctaacatgcaactttttttatttaaaatatcttaattttataaatattattggttaaagtagtatctcaaaaattatgctgaagtctaaaaatacttatattattttgagaaggacggcgtagattatttccgtcaggtaagctgtacgaggaccaaattagatgtcaaaccgacacagctttattcctttcttgagattttgaggaccgcttttctgagtgcatctagtggtcgagctatgggcgcatgcaggctcaaaataaattaacaggtcgtcaaattcagtaatctgcctgatgtgattgtcgcacattgtctaatattgttttgctcaacatttccttgcatacctgccgcgggcatgctatgaaattgttggaattaatgaatgggccttagcccactcgaagattaattctttggaaaatcacaaaagcccacctcatgggatgacatgcatgtggagtttagtaccaccttgcttattctaggagatggggacctccttaaaagggaggatgccctcctagccacttgaagcatgtgtggtggagagaagaggggaaacacacgcgcgcactcgctcgcctcgcctggcagggcggcagggcgggcggcgcgcgtgcacgacgtacgcgtcgaatggtccgaaaaattggctcctcacccttgcgcagatgcagcctccttttgcagttttgttttgctgataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttacgcatatttgatctgttcatgttattctgcgtagtttacatgtgtagatctaatgatgcgttcatgctagttttcatatgtaatgtcatgatttatttatggaataaattaaatcattatatgcccataatctcaacagaaatcacatacgtctatatcccaaaccatactcagccaggataacactgattatgtttgtggattattttactgtaaaggataatttggttctaccggtcggcagctgcaatcttcattggattgctaagtttatcttgtctggaattttatactagtacgtattgtgacgagagcatgcagattagaacggttttaaaaatgaacttgtcatcttgagattgcaccagcatctgcacttatatcgtccccaaggtagaggggttttgctttgcataaaacattgctgattatgatgaatattatggttaattaatcggtatttgtacgtgattagttggttcgagcaatatattgtcccgttgggcaacagggcaagtacagcatgggtagaaatatgcatgcatgatgcattatttggctttgctgccgcaaatagcagaatgtagagacaggaaaatgcatgagaatcgaactatggccttaaacttgccgatgttgaaaaggagattggaaggtgcatgaaagattttggacaacatgtctgcagagagctcctgacaatgtgtgaaacaaaacgagacccctactcgcttttggcccttgtctcaatagtcttctggttaaagtcgttctcatccggcgtctataatcatgatcccctgagactcggtgaccgtgaacgagatgaaatatgcaactagcagtacgcacgaaatctgatcacatattcacacatgcatatgtcagtgcacatcgtgcacgtatatatggccccgctgctgcacgtatatatagcaccgatcggttattcgtttcctacgtgtgaccatgacgttgatcagatccaacacgtgtacatgcaacgtacggtaaaccgcgtttgtccatgtgaacatgcatccttgtataactgctgctgctctgctgcatgcgctgtcgagagagagatttcgtccctaatttgctacgcatgattaaaatccaaaatccaaattactacttgtagctaggatctcgtgtacacctggccttaatcaattcgctcgatcgagcactatacatatcgcttgcgggacacaatcgcaaacaaacaagtgaaccgcacgtcagagctagctagctaaaattagccccagccgcactgtacgttactacgcgttcccatcagtcgtcgcgcggtcacgcatgcgtacgtatatcgtacccgcatctcgcgccgctgtggctgctggtgccacgtgcacgcgtgatttccttggtccgattggccggcgcgcggtcggccgggcggccgaaatggggatcattcatgggcggccgattatttaaccgacaagcgctcgtggtgggttaataatgcttaatgggttaaatcgattgatcactgtaccactttggtggtgcgcagcgggttcttcttaaggctctgtttagtcccaaaaacttttcacaaaaacatcacatcgaatctcttcacatatgtgtggagcatattaaatatagataaaaaaattaattgaacaatctacattaaaatcacgagacgaatcttttgagtctaattagtctatgattagccataagtgttacattaacccacatatgctaatgacgatttaattaggctcaaaagattcgtctcgcggttttcaggcgagttatgaaattagtttttttttcatttgtatccgaaaacctcttttgacatccggtcaaacacccgatgtgacacaaaaaagttttatttcaccacaactaaacaggcccttatattctccccatgtagcacgtacggtatatatgcgcgaggcaggaaagaattaacgcgaggggaggcatatgcgttgcaccggaccaccggtcaccttcccccggccccggccgcctgttgctcgatcgaccgatcgcgagttcacgatacctttgccaacgcgcgcttcccctttttgacattcccccgacccatcgtcgtcgtcggtacatgttcagacccatgacgaggcagtagatacagcatggaggattactgtacatcgatcatgcgtgagtgttatgcatacggcgtaagtatatatattaagccatttcctttttcattttgctaacatactgcccgggcgtatacatgatgagactctggtaaacatgcatgcacatggactagtagttttactcgatcacattgttttcacgtggtcaaggtagcgcactaacacagatactacacagaaaccatttaattacacgatccaaaattccttttccgtgcttaccatcgcactcacacaaagactccaagtgaaggctggagacgatacaagctgctccacatcgctgcgtgtgtgtgaccagctggttgcggtccaggggagccacaaagttggactaactggtcgatccaaaaataaaaagctcgttattacgtcgtcgttaattacccccacgcagaagcctttagaaatgtggacgagggaaagcacctgggctcttagctcgataaagccaatatatatattcttgccataataattcaaaaaaactacctaacggcatcccgtagagacgggatagtagtactgccttatctcctcttcccctctctcagtgtcgcttcccctccactcgctctctctctctctgtctctgtctcttcccctccactcgatctctctctctgtgactgccacccatgagcacggagacggcgacggcgacgacggcggtggcaacgatggcgacgacgacgacggtgtcgtcaccaccaacccccgcggacgacctggacgacagccagcggggctcccgaccaccacgggcgacgacagccgagaagcctccccatcaagctcctcaagccgctcctcctctttgtcgttcttgtcattggcttcctcgccgctgccgccctgctcctcctcggcggcgctggcgcctcctacggtcagggagtgggggacgcggccaccgggggcgagcgcttggcacaacatgagcgacgaggagctgctctaggtggcgtcgatggagccacgggttcggcggtttggagcgaggcacgacgacgagcgacggaatggcacaaggtaggcaccagatatattgcctcctcttcctcttcctccgtcgccgccccgctgctcaacctccctgacccgcgactcctcctcctcctctctctttggatattacactgatacccaggtaccaaggcctgatacctaggtatcagctcgatacccagggtaccaggtatcagtcgatacccaggtaccaaggcctgatacctaggtatcagctcaatacccatggtaccaggtatcaatcgatacccaggtaccaggtattagtcgataccggggtaccagctgatatcagtgtactaggtaccacctcggtaccttacccaaggtaccagggaggattggataaggtggaatcgcaggatagtgtgggcttccccacgaaattgatggtgcttattaaatctctcgggatttttagttatcccgtgactgctagaagcaacggaatcccgtggggtagcagccctcataataattagtccgggttggtgggtgtctccgcgcgcgtttacgcttaatctaggtgcaccgcgccgcacttgagtccagattagccttttgatttttggccgtgtctgatgacgcgatcggtggctagctagtatctagctgcgcgtgaatccgtcgttttctaagtttgacttcgccacatatgcctccgcgaagaatgttgaaatttttgctagctacggctatggcgctagcaaacgccatataaggcgtgcacggtgcaccacataccagggctatgtttaatttctttcaaaattaaaagtttaggttaaaattggtacgatttgactgaaaagttatgtgtatgatagattgatataatagaaaaagttaaaagtttggatccaaagtttaaatctaaacacaacccatgccaaaatttgcatagcatcctccacgtcgcatgctatcctatagctagcctgactcaagtgatcaactagtagagtcgtaggagtcgaaattagttaggtgtctaactgcaaacctacatatatcgcctgtggcaattagcaggagttgctttagagattaaacagagctagcaaccactcgtatccactatttcctctatcccaaaatataagatattatatatgaagaatgtgacacatcctaatactctctgtccaaatttatagtactagaatatatatgtcacattatttcagaatcctttatattatataggacggagggagtactacgtaattgattttctttagattgcagacgaacagttactcctacctgcaaaaatcattccccggggttgtcatatgctagctgcaggtggcatgaagcagttgctaagggtgacaatctaaattaacctttttagtccatcagggttaatataaacactctattctcagtaaagaaaaaattgtactcggacaattttatacatgggtattgctaactggcaaaattttctgcctaatgcatggtttatttacaactggttcgtaacatgtgtatcattccaaaacggtctaataatctccatcgaaattccggtataggttatacgtgaactttattgtatttacataaaaataaaataatctaacttaattaatggtcataggttaaattgaaacatagatcttacaaaaagatcatgtagaatctacctaataacatttcagtttctttatattttcttaatttaataatttaaagttttttaatttaataatttaaagtttttcaattaataaataaaaatttgcgattcccatggagtcttaattttaggttttcatttaacagtttggggattaggagttgatattacaaagttatacatggtttggagccttcactatagtattgtcatgatttaaaatttatgaaaaatctaactaacaacttgctcttattttaatcttagccattatatatatattatcttgctcccacttggatttatagccaatttattcgctaattctccgattaatgtgggagcttatttaaagttgctaataatcagtactggtatgtaacttgaaccattatatatcggtctcacatggatatatgaacataattattcactatttctcctatcaaaaggagaattcccctgcagatgtatgatcgacccaagaatttcgatcatgcatggaaaaccacagaaatgacttcaacatatagcattatttcagtcatcttatcagaactccatgattctacttgctcttctataaattttgaaacaggcagatttcaagaaaacaaaattatatatatactgatgataaaaaaaattgtagtgcatgcatgcataattaataaaaaaaagattacttcatgggggaaaagggtaattaatcaagaactacacagatatatgatggtaaattaagcagtatccgatcgatataagttaagaattaatcagctctctcattgatcaataatcgtttaataaatgcatgtaaattaaaataggttccaaattacctgtttaattagcctgtgaagctgagaaattttctccgatacaaagctggggacatagcctcactaaacagctcacactctggcagaagaaaattcatctacttcacaggctcacagctttcgatcggcaccggctgaaagccaccttaattattgtgtgctaatagtctgcttaaatttcctcctaaatccccacggatgcatgcacatatcagcatacattactctctagctagtagctatagtttgattaacttgttgtctatatgctggacaattgcatggttaacttactaagtagatatatacgcgagcagcagtgctcacgtatacatagacttagtaacgaaccaggtaactgcagcctacacatcatgatcgatcatcgtcgacctcgaccgatcgatatttctcaccgttggaagcttatgatgcggtctttgtcggcgggggtggtggcggcggcggcggcggattcggcgacggggaggtggtgggcaccgaaggagcggacgtggtcgttgagggagcgcttgtgcttgaagtcggagccgcaggcgcagaaccagcgcttgccgcagttcttctcgtgcgtgcgccagtcgcccttgacggcgaagggcttggcgcagcggcggcagcggaagggcttggcgccgtgcttgcgcttgtagtgcgtctgcagggtgcggaagtccttgagcggccgcgccctcgggtgggcgacgttgttcttgcaccccgccgcgcagcagtagcacggcagcttcagcatcgccagtgtctgcgtccccttgagcgactccgggcccttgcggtactcccgcccgtgcccccacatgtgcatctgcatcatcatcatccccacatcatcaattaatattgcaacgtacgatcgatcagagagctatacgataattggagtatgtgttctgaataattgaagaaacgaatgaagtggttatatagtgtgtgttagtgttcgatcacttattagcgccgaagcacgagaatatctcattgtggggatttgtatacgaaataattgtgtgttttgtacattctcagatacgtaacacttcaggcagtcacaccacctgtagattcagtttgtgagtttgtgatgtccgtgtcggtcacagactcacagttgaaaatatattttctaaaactagatttatctgcgggggatttccttttccaaagatgagcatataagaatttcaaatttatgaaaacatgggatgtactaggtaaaaatcaaaatggaagctagctgacaaagatcaaggacgtcatgtagtacctgcatgttgttgtatctgttgaaggttttgttacagacatggcagatgaactgcaccgggccgacgaggatctgcgccggcgtcgggatccaataccggctgctcatcgccacgccgctctccgccccgaccccgccgaacatatcccccacggcggtgatgctgctcgacccttccaccgacgccaccgcctcgccgtactgctcttcatccccctccaccttgcaaccgccatgcataggcttccactcgtccatctcctcctcccctacgtcgtcgtcatcctcctcctcatcgtcctcctccatggtgacctcctgagcgctagatcctgtaaccggcaagccgatattcaactccacgccaggctccactaccccggctgcgtgtgcactgctcatgatctcttctttcacagggtgctcatgcctcttcgaattcccctcctcgagcatgctgagcagcggcaaacaagtcataccgctcttatgatcttcttgaatttcacctccgccatcttcaccaggtactactgtttcttgatccctggaagccatcgaggacgacgaggagaaagacgacgaccacgacgaggatgacgccggccgcggcggtggcttgagccactcgaagaaaggcgaggcggcgacgacctcaccttccatggcgctgcaggtccgcagccccatcctcatgtagtcctcgattataccgatcgatctctacttatacgcacacagagagctctcacttaattatttactcgcatgagagatggtatatagctttcttgttctcggggtttggtggcgtggggaagatgggagatgaggagggggaggaagaactagaagaaatgtgtatatagcctaatgtcaaggagtgcatgtgtcacggtcttgaagaaactgaaatggctggctgggagctgggggccatttatatgcctttgggtgtatgtctcttagtacgtagtatatgcaaggccgcttcttgatggtttttttgttcttttggaggctttcacacacgagccaaattgggcaaatccgccgccagggttgggaattgggatcatgggatagcgcgtgagagtgtgaatatgttcgcgcttgctagctgcgtggcccttcttcgctgaggatcgctggctgctggtgctatttgtggcgtacgtgctggtggctgctgcgtgcggcgtacctagctagcctggtttcggaccttgcatcggcggcccacgcgtgccgcgcggctgcaggagcgtcgtcgcgactgcagggctgatcggttggccaagtgcagtacaccgggtagggaatcagggagacagaggatagaattggggaaactattttaactcgagtggatgtccaccgttggttacatgttatgaaaaaatataaataagatagatcaatatgtaatgtatcaatccacaaatatacaagttaaaattcaacttttacagattgtaacaaaaattacaaacaaaatttaaattaatatatgtatatttacaattaaatttgttatttttttacccgatagaattgttcgtgtgtctttgtccggtgcacctacggcggcagcggtgtccagtttttttatttctttttgccgttctgttttggatttattttctgattaatttttctttttgttatttagtgtacacacgcaagaagagctcaaaagtttttacacaagatgcacaaaacaagagaatgtctctttggaacaaaaatccacttcccactatacgccagaatgctatacactgccatacgcggggcaacgcagtgctgctgctgctgccgccgaaaagccaaaaacaagcggtcgttgtggatttttcccgatcgcgagggaggagagcaaggaacaaaaaaatccatgttatttgaaccaactcatttcatgatgactccctctaaaagcaggtacaatattttaagaagataaaagagaagagataagagtgcggactacagacttgtagccagctgtaacacgaactccaagacgcatgtgtgtatgactggtgggaccagatattgattgtgtagtatatatttataggtaactattatatgaattagctattaagttgactatagataatttgtaaccagtagttggctatactataaacttgctctatcaatgatctactctctctctctctctattcagtgatcgccctcgtgatcggcaagatcggcgggagccggaaaaatacttatgccgacatggcagagtgcaactttaccttactcccagtagaacgagcgacgcccttgatcaggtggcccgcgcgcgagactccgtcaaaaaggcgatcgaccgaccgatgggcgccagtctgggtgaccagaccgcaccgaaggaagggagaaaaaaaaaatcatggttcgttacaacaccacgccgcgcgccaaccatcaaccgttcaaagctcttgagcttgagctgggacgtgtcaagggctcaaggcgggtgcatgcacgagctgcgcgcgcgcgcgtaggtaggcatacgcgtgcagcgtacatggacgagctagcgatttggatcgatcggtcgccttttgaaacggtggcgccatcattaaacctggaccaaaccgtagaaagttagtggcgaggtgattcaaaagcagcgcccgtgttggactcggtcgagtctctcgcgtcgcgtggaatatacgagtgcgctgcacggcggcatggggatcgtgggggcttaggcctttgggggatgatgagatgagctgaacgtctctaatagacgacgtcggacgttggaattgtaaggcctaattggctaattccggcaaggcccataaggccataacgacctatgagcacatgcgggcttttggagccccgtttcgtcgttctctccagccttcatggacaatacgctgatcggcccaatcttgcccagtaagtgatatggcccaatgtcaagtcctccgataagtggtccgacgggcccattagataccaaacattgctggcctgctgatagaatagactagaaaatcagcgcgcacgttggcacgctgggtatttagcctgtgtaacatcgagtattagcaatacatagtttcgatcagatgaatattttaaaaaatgaaaactaaaatctaacatatacctaaaaatgatatgtaagtgctaagaaatagggtgtaaaatcaagacacaaatctacttttattcaaacccctagttttctctcattattttgttttctcccatcttccctttccttactttctatcccttttcttttctaccgaggagtttttcataaatttcatgataattgtatttttgttccatcaatcctttgttgcatacactcctttttttatacttagttctcactctcattttctttgttttcatgctcagtcgagcacacctgtgatcgtttggagaaaacacatgttttattaggaacacatcttagaatcacgattttgatattggtttttttcctacttacttctataccctttaattttattgtttattgtaaatcttttttctccagaaagtacataatggtacgtgaagcgtcatagattctttatttggtcaatgtgatttcttgttaatatatgaatagaagcatttctaaaccattttgttctatcagatacctaggtgggttctgggctacatggcgacaccgtttttctttgacacctcccctcttaattatcttaatatataggaacattgtactaagcctataatacttttatttgtgttaacaaattgcctataatacttttatttgtgttaacaaattaacaatgttgaatttaatcagctaaacaaataaaaaaatacctaaaaatgatcaagacacaaatctaattttattcaaatcaccttgttttctctcattacttttttttctcccatcttccctttacttactttctatccttttctttcctaccgaggagttttgcatgaatttcatgaaaatgtttttttttccattaaacctttgttgcacacataccttttttttttgcttagttctcactctcattttatttgttttcatgctcgatcgagcgcgcctgttgttgatctccaaagaactatgaggttaagcgtgcttggcctggagcaatttgggatgggaaaaaacttgtgttggtctgtgagggcagtctatgacctataaaagctaccagatataagcgggcctggcctcggagaggcgggacgttacaaaatggtatcagagtcgactctcgcggtttcataggcacgtgtgtcgcagttgcgcaggcatggtgcgcatgactggtgtggacccggagtggtcacacattggagaaaacacatgtcttattaggaatgcatcttagaatcatgattttgatctatttttttggtttgaattatataaagtctacaacttacttctgtaccctttcgtagaccttttttttttcaaaaaattacataatggtacgtgaagcgtcatagattttttttatttggtcaatgtgatttctcgttaatatatgaagagaagcattttctaaatcgttttttctatcagatatctaggtgggtcctgggctccatggcgacaccgtttttctttgacacctccctctctcgattatctcaatatatagagacattgtactaagtctataatactttaaattgtgctaaaacctaacattgttgaatttaatcagctaaacaaataaaatccatcacgtaataaaactaacacactatgaatgtgaggttactctcacaacttattatagataaaatattttaactgtggattgggactttatagttttcaaaagaaaagattggaaatccactgtaagaactacgaaacagtaaacaactttgttatttgatcaccagcttaatagggtgaaaaggaaatataaaggaaaagaaaaggcggaaggatctcgatgccttgtcaccatcacagctcactagttccatcgtgctttgttgtttgtcgctgtcgttggagcttgtggccattgagagttgaaggctgttagatctggcgtcttggagccatggctaccgataatgcatgtctgagctcataaaaaagggatacaataaccaatgaggaagacgatgccagcgagagcaataggaagatgatggcggcaacaacgacgttgcccctcgaacctccccattgaggtatcctactggagacctccttgttccctccctttttgtcgattttgtcgagcttgagcttgtggccattgttgctatggacggcatggatatgctcgaccttggtgttcatcggctggttgatgcgtccagcatccgcatttacgaactaataaaccatcacggctagtcgtcgacgacttgatacccttgctcccctgaatgaacagcttccaaaggatccggaaaatgtcatggctaccgtcttcgttgtctccaattttgtggcggctacgatacaccgcttgtttctgtttttcttatctaggaatatttttttcctgttcagatctgtttctattttccctatctatttttacattgagatagatccttttcaccggttcttttacggccttattgtttggcttatacttatccttataagccaaattttgaattttagaatttaattttgaatttgatataatttattttatatcatttgcttttgagtctctaaggatacatatataaaaaaattactcatgaataattttttatttgctaataagcgatttagataaccatatgaatataagctaaacattcctgtgtgattttttatcaggtatatgttggaaagctctagatttttatctttttcttgagtaattgtatttccttgattccgttggaaggaccaagaacctgattttagtccacatttcaatgactgatgtatgtgcgtatagcgagaaagaggagagtaggcaagtagcgcagtgcagggagttttttttttcattttcttttttaccgtttgtaatttcaagatttatcttcaattctaacagtgacaactgacaagtggacgggttgttttttttctgagaatacacaagtggaccaatcagtggctggcaaaatgtcctgcttgagatatatggatggatgagatccacagccgcctggggcgagctcgagcgtggcggcggaagcgcggcgaggttcagcagcggggatcggggaggcgagccggccggcagaagtgcggaggcggagcacagcgaggagggagacgaactggttggccactttgcctcaaccatatacaaaaatagtgtttcaccggatgttcatcttgctgctctttttttccctcaaaactgtaagtatgcgcgcgagacttttcctatcttctctcacttcatttctgaacgaacatcttttccctcttcattgttccattcctattatcggaacggatgaacagcgatttttctcatggaatctttattcctctagtttcgtatgatgacccgggcaagagttcttgatctgtcgttatctacttatctttatatggccaagtccagctgcccagctccatgattgtattgcctgttaagcctagcctgtccacactttctctgcaatccatatactctaacttccatcaagagaagtcagcaataaatcatggacaagtaccaacctaatacttttatggactaaggatgtgcattgtgcgatatcatttcgaacagtaacaatcatgtgttaattaggagcacagtaaaacaatcctctcagaagacgccagtgcctcctgtcgtctcaaacgaacagatcgagcgagatcgatcggactgcaaacaaaatcaacatcacgctgttcttgttgctccccccggtagcacacagctcagcagccagaacggactcggcagttgcaccttacacaaaaaaacgcagttacggccaattcagcctgccagccggtaccaccattcgtagcaatcgtaccagtccccgcgtgtacaagtggagtcttggagacatcaggtacaattgacatggatatgggtgatgatgtagatatgtggatctcatagccgcgatctgcaagatcgatcccgcgagttcgaccaactctacaccccggcagaacaccacggtacaatcattatcgtaccattcactgatcgtctgatccactgccggtgttcgacatagacacttcacatgtaaacctgaccacgactccacgagaggtgaccacttcacgctgcacactgacgagtaaaactgacaaatgagattgtgagaagaaccgctccgtctctacgatttcctggtataaatgttgatgttgcctgcaccgtgttaagcatgctcgacctccggctaatcatcggggcgtcacctgcgttatactaagtttctttaatttcactgccttcgatctctgcaggttcgtagatcgaccaggaattcgcgatggttgcgctctccaagttagtgctgatcactgcagtggcgctgctgggctgggcgtacaaggtcgcgcggccgccgccgccgccgatcttgggcggtccgggagggccaccggtctcctctccgagagtccagctcaaggacggccggcacctggcctacagggaagccggggtcggcagggagatcgccaagtacaagatcattttctcccatggcttcgcctccaccaaggaatccgacttcccggtgtcccaagtaacaactgctgctgctaaacttgcatgcgcgatcgtcgatgtagttcttggttgtgaattataccttgatcccctctgtttaatttaactgcaggagctggcagaggagctggggatttacctgctgtacttcgacagggctgggtatggcgacagcgacgccaacccgaagcgggggctgaagagcgacgccacggacgtcgaggagctcgccgacaagctgcagctcggggagaagttctatgtggttgggacttccatgggcggctacgttgcgtggagctgcctcaactacatcccttacaggtcaaaacatatgcatcacagcatcagttcatctgatcggtcttttctttttcagtatctgatgagaggttggacgattgcaggctggccggcgtggcgctggtcgtgccggcggtgaactactggtggccgatgcccgccagtgtgtcggccagtgcgtaccgcaagctggacgtcggggaccggaggacgttctggatcgcgcaccacatgccttggctgttctacgcctggttcaatcaaaagtggttcaggatctcaccgatcgtggaggggaagcccgaggctttcactgaaaaggactgggagatcctagctgagattcagagaactggccaattggacagggtaagcacctgcaccggatcccatgtccaccaactatactaaaacttaggagtaaaaaaagacgcactcgtgcagaataaaccttaaatgaaaacgaaacagagagtcgctttgacacgggctcgccgtgcgtgtaaactgtttcaggggagggcgacgaagcagggagcctaccactcgctgtgccgcgacgcgacgatcctgttcggggcgtgggagttcgacccgacggcgatcgagaacccgttccccaacggggacggcgtcgtcagcatctggcaagggcgcgaggacaagatcgtgcgggtggaggcgcagcgctacgtggcggagaagctcccgtgggtacggtaccacgagcaccccgagggcggccacctcttcatgtgcgccgacgggttgggcgacaagatcgtccgggagctcctgctcggcgaggagccgcgagatttgtagacagatcgagttcgtgtcctgtttcgctacacagagaggggaacacaaactcacagattggggaggaatataggtccaagcggtgcttgtagttgttgatggaataaacctccgatttgctaaactagaaaatcgaacttaaaatcctgtgaatttctaacttctgatatgcaccgcagtctgtgctccgatcaggctagtgttgaatatatagattgtgttttcttttccgcgtaggtgaattaaagactgttcattcacaaccgttcatacaaaacaataaatcggcataattaaatttgaaaatatactgttcattcaattttttctcataaatattcggaatgtaaaattttttacataaatataccgtcgatctcgcacaaccgttatgcgaaaatgaggtgggtgtgacgtcgtggcggtatcgcgcgttaaaattaaagtgcgaaaccgcgtggtcgcgcgcaatgaaagagcgagactatatggtctcgcgaaatcaaacagcgacatcttccaacggcttcatttgattagtgcttaattacttaattgacaattaactaatagtaattagagactaattatcctaattaactaataatgattagtctcgctctcccataatgcgagaccgcgcggtctcacattttcgccgcgcaataccgtccacgacattattcttgcgcaatgtttgtacgagatcaatggtacatttacgtaaaaatttttgcatcctgaatattcatgagaaaaaaattaaatgaacagtatatttttaattttaattataaatcggcacggtattttattttctgatattgggccgtgagacggtgagagtgtaattggatcgctgctaggcctctttcgtatcgtgtccatcgcaaaatcctactcgggttaaaagcttggtgccactcagcccacatataggcacgaaaaagttgagctgcatcaacaatgggaaaggtccaattcaactatgagactagtgcatagaggctcctccaaattataaaatgagtgcacatcgactctctctcgagtggtttcagctgacatggctagttcatcctagtccaaatggctaagtcaatatatggaccttataggtccgtgcccctctctttttctcccccattccctttccacacacatcaacgagctcaagctaaagcttgcccaacaatggtgactggctagcctcttcgagctcgagctcatctgcccatccttgtgagggcgggggaggcggtcgaccaacccgctcaggtcacgatcctagtcttgagaggtttatagtgaccaacatgttgccgtaagctctcctctgccaactaccaaggcatcgatgaccttgggtgaattacgcgcttgactaggtggatgacagtgctccctagacagcaatggccgagaacttcacactttgaccctttcataatacttattttataatagatcttgaaaaaaaactataaccaaaattgaatatctaccttagcaccatgggtcttggcgttgagcactgtatattaaaaagatgttaggttgtcccttaacaaattttattaattggcctagtggtaaatttctcccttgtaaaccggaaggttttgggtttgaaacccatactctcgtgacctctttggttttctttttttttactcgccatttcttgtttattcttcttttttcctcaccaggtcttcagtttcaccgttgtgactctctctctctctctctctctgtatgtgtgtgtgtgtttttcaccattagggaattcccagcctcccataaaaaatatcatgctgcagtggggattcgaattatgatcttcaaggcaaaacaaataccacttaccactgcatcacactcacttgcttttctaggtgggtctagcatcattttaaaatgtcagaggtgccagcgctaatgggcttggcgctaagatgttgggcctcatcaccaaggcctatgacacagaggtaaaagtctatttctagttatagtatttgtcaaggtctagtttagtaaaagggccaaattatcaaaattgatgtggcaatgggcggtaagggaggcgatggcgcacgtgatggtgggacaaggacacgcctcctaggctccaccgtcatctgtagacaaagtgttatagccctccctccagaaccgcgcagcccagcccaaccgacgggcgggcccacatacacacaccaccagtgctaaactagcaagatggtactaaacatgcgcacacggctctcttaggccatacaaagcccctaatgtcgccgctaaagttgcctctcgtctgggataagctcaagatggagctcgccctcaattccacccgtgtgtgaccaagatgggttcgggcccaacacaatctctgctcgagttgcatcgacacacgtgcgtagccgcctccttggcgttgatttgatcgacccgctctatcttcgtcgttgcggtacagcatatcagggccaacgtctatcttgcgatgtcgttctggagctccttctcctcttcggttggtggctcgggggccgggaaggacctgacagcaagtggctcaggggttcggtggtgggatggcaagcgcatcaaaggcggcgtggcttgccccctagtcacctaacgacgttggagagggaacaatgcggggcctgtatgagcatagatagagaaagggtagagaaaagaatagtaagaggggaggaagagtgctgagatcatgacatatggccgcaatatttatattttagttcattgtttttaatgccacgtaacacattgacgccacgtaatatttagaacaagtttttttttttgcggggaaagatggagaacatgttaatgtgccacctaggcagtagacaccacgtaggataaaatcacttagcgaggaaaaacaaaccaatttgtcagttaagtgaacctcatatatggttttgtagttaagggaagaaattaagaccggagctacagttgaggaaggcaaaatggactcacctgtaattgatgacctcactcgtcgggtactcatttgaagtctatgttcgagatggctgaaattggtcagcttattctggcacgcgaaacgaggtgggttattagagtgtgataaattgattatttattattatatatttaaaaatatatttatttgattttctttagaaatgcttatatttatatttgtgaccggaaggagcaaaagaacttaagggctctattagaacacaaacgcagtgaaatataggaataggaaaaatgtaaaagtgagatgtcattattaattgagcactacagcaattaaaaccataggaattacgtagaatcttgtttggaaaatataatatttttatattaatttattaaagagtgaacggtgagagaagggggtgtaacattgaaatttctcaaaggaatttttaaatatatattaggtgagaccacgtgttaaaatatttcaccatcccaaagggttcatactattttatccttaggattaattctctagtttagaaaggattaattctctagtttagaaattttatccaattctaaggagacctaacgccggaggaggagggggggggagagagtcctttttttttaacgtgcatgctttccgaactacaaaatgtatagtgtgtgttttaaaaaaattctataataaagtcactttaaatatatattttagatttgaaataattgattctacatggaaaccgcgagacgaatttattaagcctaattaatccattattagtaaatgttcacagtagcaccatattatcaaatcatagcgcaattaggattaaaagatttgtctcgcaatttatacataatccgtgtaattaattttttatctatatttaatatttcatgtgtctaggtattcaatgtgacagagaaatttttttgtttgggagtcatcagtcttgtcatttcttctcatccagacacacctgcatgcccaaagatttgtcaggagtggtatgcctggtcaaacatcacggaacgggaaatgaatgcttgatcacgaagctttcttaaatgccgtatgctactttttatacatcatctatgcatgtgtttcctattgtttatccgtacgtatgtattttctattagtcgagtgattcatacagtaagctggaggcagtagtatttgacggtacgcagtttgtcgtccaatcgatctgggttaaactgcgataaagaaagaactaaaaatcgtcgaagtgacaatgaggcgcgccagtgggcagctcgtgccgaacgtgattgcttcatgtgacattgtgacccaataggcaacaggtctagataaagcagtagactcccttgcaatgaggatatcggatcggattcacacaggcacacggctagcatattaatcgtactgttcagcttgagttggaccggtaaactgcgagcatggcacgtagcctacacgtgtcagagcctcgtcgtctccgccctcagactaatctcttttcttctacggtgacaccatcttcgtacgccgatgcgtgccatcagccatctctgtgttgtcatggttgcaaacatcatgcatggtgatggagtaaaacaatcgacccgcggccgttcgttggaagttgtacgggctagattgatcgacaaactcggcagccatttggtgtacgcagctgccttttcggtgtacgcagctagtgcgcggcgctcgcgtagtgtgaaaccaaaaggcaatggcataacgcgggtggcagtctgcaactgcatgggccgcagagatgacaaaagcccgggcggaaggaagcagaagcagcatatagaacagtagaagcgcaggaaaatatatggtaatatatggtgaaagcgcaggaaaatatatggtgtaatataaatctggaactataagtggattgaaaaataaatctgagattcgtttatatcctcacgagtaaaaatcttactcataagtttattcataagtaaaagttttacggagaatattttttttttacttataatgatgtttgatgaatctcatacatctattttttcgattcaacgatagttttcaggttttcattacgtagactctgtttagttttcacgtaaaaacttttcaccctatcatatcgaatttttggatacatgtatggagtattaaatatagaaaaaaaaactaattacacagattacgtataaattgcgagacgaatcttttaaacctaattgcgccatgatttgataatg

SEQ ID NO: 18401 - DNA, 20567 bp, Oryza sativa
  unsure (1)..(20567): unsure at all n locations
cccccacccccgcgcgcgcgtgttgccccgcttgctggcgcctggcgactgtttggtttgctccgttgcctcggctcagctaccctgagacagagagcgcgcgcgagctagttggcgaagatcgaccccggtgcccgcgcgcccccgtgtctcggtgagacggtggctggccccgtcgctgccggaaacggctggagaatttaaggtacgcccgccccgcggcccgccgcgaatgcagtgcactctttgctctcgtttttcttgtcatctcgcgtatagctaccagttatacttgtagtcattcagaaagtattcaacgccggttacaattaaatgggagcaaatcgtagtggagttgatgaaatttatataatgcaatttatgtgtttttttagatgatgagaaatatatgtgcttgaatggttgaatgttccatgtaagttgtttagttgcggtcattatcctttttcctcgttttggtttagctgagctagcagggcgtaaatctatcctagcttttgcttctaaaggtgtgatcagtgctgtagctctctcttttaacttcaaaaaaaaaaaaatccgtctggcattgagtcgtcaaattcttttatttttgctgaaaaaaagaggtccggttgtttataatctgcatttggcccttagataggctggccgtacatgggtttgaagtgggactacatgagatgtatgggacaaagcacattgttatgggcctataacacaggttccaaatgttggttgattttatcggctaatgccggttagttaggataaggttaaaatcccaccggttttcctatcctaacaagaaacaagaaacaaactaagagataaatctgttttgtgtgatcggtacaaaatagattcgaattttagattgagataaacccccgagccccaccagtgtcgctatataaagaaagaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaatttccgcataagcagaaggtgatcatgtttaggctaagactcaattaattagttggattaaattccaacattgtggtatcagagcctaatcttagctacttgatccacttgatcccatcatccctgattgaagccactgtgccaatgaagtgatgaaccctaatctgttaagcccggcatgatgccatgattaatctgttaagccccttattctgtttattagttcttaaagttgctttgtgttgagcattatgtcatatttaagttaattagatcgaattagggttcatgcttaagtaaatcatagcttcggctagaaatcagtaagggaaggagaaattcaatcagagagagtttttttttctctcaaattttactaagcggagaacgagtgagataaaccagattgaaactctcattgttcccaactcataaaccctaggttcttatcatataagaacagtggattaagaagtaaattggggaaaacagggtataaactagattgaaattccccactgttaagcaaaagggaataaacaagattgaaatttcccagaatccccaataagccggatccaatcggcctaaaatccccaaatgaggaaccctaatttttgggggaagaaccctaagtcacaaatacccgaattaaatccaaattcaagtcaaattagggtttgaggtcgggtttattaccgattttagaccccataagctgccggagctctcgggcctcatcagggccgcgcgggttacccgccgtgcgcgcgccgccctggagctcggtctctccaccgtccctcaccggggatgggaagcgtcggcttggcggctgccttcgtgctccgcccccccccccccggcgccgacgaggtccggccgcatagacgcttcccgtcgctagcgcgccgcctcgccggaccgccgacgctgtagcacgcggcttggcgtcgccctcgggcgcgccccccagccagctgaggtggagccgctgcggcgctcgccgccgcacgcgcgtgccgtctcgccggaccgcagtcgcaacatcgccgccgattcgctcactcgctcgccggacgccgaatcgggaagagaaggggacaagaatgagctagggttagggttacacccattcccccctggcacgcgatttcttcggcgcgggcgaaatcttggccgtccgtttgatccgacggccgtcctcgctcccgcgtcgggccgtcgccgttaatgggccgagccgatctgggctgcggccacctcagcgccgcgcaacaataagtggaccggtccgttttgggacggcctcaccaataagagtgggctcttattaattttaatcttaagcccgtgaatttaatgttttatttatttccataaattcatttatgagctttcttagccatttaaaattgctagaaaattatgatcaattatttggtcactcagaaagaaattaatgatatgatattatatttgaccaacattaatatgatttcatgtcaatatttattaagattattatttccttaagccaattaatttatttctagttgaatggaaatttaactagaaagtatttatgatttcatgtcaacatcattatgatagtcatttccttaataacttaattatttatagtcgaatggaaccaacgagaaattcgactagaaagcattaagatctgaagatatatttaacccacgttattataattgcatgtcaattataatttttttccttagttattttctaccaaatggtgatataattaaggaattaattttaagattactcataattatttatgaccaatggtgttttgactatgaaattctaagtttattttgcatatgattgattaagccatagtaaactaattatatgcaattatcaatgcttattatttaagattagttggaataccgagtaaattatttctagataaatggaaccaacgggaagtttatctagaaagaaagatgatttcattaagattgttatttccttaattatttctgcccaacggtgatgtaattaagggaagaaatctaagtattgtcaatcattattttaattttctctgtcattttagccttaatggtgatatgacttaaaaatttatttatgccattagtgcattaattccttttatcacttctaccttgcggtgatgtgatcgaggatctaatctattagtaagcttaattcctttaccatttctgcccaacggttatatggctaaggattttaattttaattctatggcatcactaatggcgtcatttcctaatcatttctaccgtatggtgatttgatttgggattttaaattatttactttatcacttctaccttttggtgatgtgacttaagacattaatgtttattccctaatcatttctggccaacggtgacttgattttggattataagtaatttcatttattgattccttcgttttgtctctgcccaatggtgatacaaagcgaaataaagattaagttattgttgtgtaagttagtgtactattgtacgtaatttgcacaagcaaccacaaataatagtgccacttaattttatttatcagttaaagtctatggaattattattattattcctcattgacttaactgagcctaaggcctatttgagtatgacttagcattaacaaaggattccttgtgactcccgcagctaatgtcactaatttttcctaaactcaagaggcatctttagcctgggagaaggccaatataatgctatgtttcgcatgtcactcataaatattgagattatcatccctgttagtgttaaggggagaattttgagcatgacattgcgtctagcaaatgttgagatgaaatttagaagtttgtcaagactaatgcttagtacaaatttagtgcctatgcacatttgccgccataatttaaaggtagcacaagaaataaatcacatggcgtgcaaacttagtgggatggacattgcacatttcaaatgcgccacttgtccatttcatatgattcttctcccattagactacggtcattttcagagttgtaatactaagacaaagtggaccataattgacttggttcatcattctgcaaatcaataagaaatatagaagactaagaggcaaactaagtaagatcctgttaatcttgcatttgatggcaaagatggagcttcactaaggggaagtgttgcaacttccaaatttaatgataataaagctcatattcctcgcaaggggaattcaaattgcctcgatgtcctatgtatgctactcttgaaatattcttgtgtaagctctttgcaagaaatagggacatgcttaatgtcctgatttaatggcattattttgggttgaattattatgagacgttgtcgaaattatggccttattattcggccacatttctaggggagaatggacgtctcattgagatcgagacacttcacccttagaaatttctgacatctattattacttaaatgctaattcactaagtaaaattaagtgattcaagtttatgaaaaataagatagtatgcttccattaaataaataatacaatcagtgggagctcatcaagagctctaataagagaagattattctacctcattaatgactcatagctccattatgtggacgctagaattttgcatctcttaatttgtgacttgcacaattaaatatacataacatgacttgggggttttgttatggaaagacaagtcacatatagggtgcagacttaagaaatccatttgtggacttaatcaaacattgatgatgttttaatttccgctgtgtcattagtgaactaagcttaaataacaatgaggagaatatttattctataatgatggaagtaagacatcattgaaattgtgtcattgtcgcttatgtcacatacctaggggagtttggaacgtctcatgagatagagatattctttctcttagattttaatggcgttgtttagctttaagtgaaaattttatgaagttaagatattagccaacaaatgatttttatggctatgtttacctataagcgacctccgatttcctttaagaaatttaagacactaatgctaaaatcaaatgaagttatgagatcggattatggtggtaaacactaaataaagcttgttcaccttataagacattaaaaataagcgttcatccaaatggttttcgaaccatgtaagagtaaattgagatggatgaacaaaataagacattaaagtgttcatctaaatggttttcgaaccatataagaataattgagattgatgaacaaaataaagaatggttttcgaaccatataagaataattgagattgatgaacaaaataaagaatttagtagaagtttctgaatgagtcaaaatattgggccatttaagtgggttaataaaattaagcctgactctgatggaaatttcgaacaatccaagtgaggtggacagctgcatgaaaattaaaggtgggaatttcattcactggtactctatactaatgaaattttattgtcaagcaatgcatattgctgttagaaactgagaaaatttttccatgaattattttggtctgaaggagtactgggcttatatcagttagtcatacattgacaagaagaaataatttgagagaattcaattaaagttaatcaagctgaaattaagttataaagataatcatttatgattcagctgacagaagcttgagattggctcaaatctggatgcatatagatttggcatatatttttactgggaatcttggcagtatttaattaaatccagactagaccactggtattaagaatgttttgcattattgcaagacaatctgaagtaacatgctcatatttctaaagtccaatgatctcagaagtttagagacatttggacacttattttgtgagatgtttggatatttataaagattattcagattaagctatatccacacataggggagtaataaccatggaaaagctccaaaataatctcttactgcatagtcgacgatgcagttagattttaaagcatgttatgattaatcatatttcccagaactaagagtggtaaatagcgctcataaaccactcaaaaggtgtaaaccactcaattatactgtgtgcaacacaggtttctattctagtagcaacatgttatgtgttttctgcctaacacattgacatagttgtgaaagatatgtcccaggatcgaattattattaagctaagcttttgctcatggatccatactctaaaggctcataaagttaagattaattaagatatgttctggccagtacgtgcataaataagagcctcactaagatcctggatgagggggacttaatttttcaatcaacacccactaagttaagcttgagtttatttgggtactatagttcactataggtcttgttgtctcggtgacgcataatgttgttgaagacacattgccttggggaggtattttatttgataaactcgtcagttagtctcaaaatcaaggggagaatgttggttgattttattggctaatgccggttagttaggataaggttaaaatcccaccggttttcctatcctaacaagaaacaaactaaaagataaatctgttttgtgtgatcggtacaaaatatattcaaattttagattgagataaacccccgagccccaccagtgtcgctatataaagaaagagaaggagggaggctgggtgacgacttaactctctccaaccctaaaccctaaatcaatcgcccgatcgattagacactggaaggggttcgtgaggtatctcacaaaagaagaagaaagaagagaagcaatggcttcatctcaggtcagtgataaattaattccgtataaacagaaggtgatcatgtttaggcttagactcatttaattagtggatttaattccaacacaaaggcttttaaaaggaaaaaaaatcagccttggcccgcctgaatttcacatgatcacatcgtgacttcttgttcaaccaaagaaaaatgcaagaactaacaacagtccagggttctgttgttggtaaattacaattgcagtcgaaggaaaattatggtgtgttgcacaacctatagtaatatcgatgcaagtgggttggtccatggacactcatattggcctacgctagataatttggcttgcagtttcgcatccaatatgaacaggtcgggtacccatgacgtcatggatacatatccaatatttgcatccctaataacacacgtataatttctgcttaccttttgatagtagtttaatcttctaggtaaattggttggttgtgcatgcaactcaatgaagccaagagaaacttgtgttagcacaaaaaaaaaccccttatgtatagacgttttgtaatttgcctctaaaatcatgagttttatagtgtagagaaatttttagaggcactttaaaaattgtctaaaaacttttactctaaagacactttagaaacattttcaacacattttgttaaattttatctcgtagatgcattatttttgtcactttaaaatgtgtgtgcctgatatgtaaagatattttcttgagacattttaaactctgtagagacacttcttagaatacaaatatatactaatggaataaatataagtacataaggcacaaacacaacaacaatgataggaggttgagttggttagtgcattgaagataacattagtatacctaagagatcttgagttcaatgattggctatagcaaggggaaaaatactctatttttttgcattggttcgatatggttatggtacaatttaataactctggaaaatgtctccaccctcttacatgcataaaaagtgcctttttcacatttgttcttatagccataaaaaagtgcctctttcgcattggttcttatagacataaaaaaagtgtctttcacattggttcttatagacataaaaaagtgtctctttcacattggtgtgcagtttaatatcttaaaaaaatgcctctactctcttaaagacataaaaaaagtgcctctattaaaatgccacaagacatagatacattttataaaatgtggtttgacataaaaaagtgtctctttcacattggtttgatatggttgtggtacaattttgatatctctaaaaaatacctctaccctcttataaacaaaaaaaaaatgcctctattaaaatgccatagtccagattcgtagggtttgttaacgcactcaagctaagtcggcagaatgaggtatctttcgtggcggccaccgtcggctattgaaaggaacaaaccgcacgccaattaagtcagcacgagtttgtcctttcacaaggcccttatctcatggatgtattggcgatatatcccacacaagctaagctgcaagcaaatactccgaaatggacacgcctcctcgcatcctgtctatccatagtgaccggtccttttgaaaactgagctatagtggatatcacttgatttttcttcttttttaaaattatgactttcctttggacactgacacactagagggtgcattcatgttctcatgaaactctatagaaaaaattggcaattactaatatcggcttgaaataacaatgttctaaagttagctggcacatcacctattatctgattgggagtgattaagatgccatttaacctctcctacccgtcatggttcagccaaagcttatgtccaatatttttcttaagaaagaaagactcacagaaacgaagatatgttcaatcgagatataaagctttggccgagtttagttccaaactttttcttcaaattttcaacttttccatcacatcaaaactttcctacacacacaaacttccaacttttccatcacatcattccaatttcaaccaaacttctaattttggcgtgaactaaacacaaccaaactagtgcttttaccatgccttaggtactaccatgccagaatgacaaactagtgcttattgtcgtttgcaaggtgggtgacggtagtgaagcccctcgccgatcacatgtgcatgccaagtcgcctacggaaaccaccacaatcaggggcgaagctacatgcagctatgagggttcctaggcacctgggtaagagaaaagttttagctatggttaccccatctccaccatatatgcacccccctcatcccaacaatgtgtacccccaagcagaccatcaggccgagcaaaggtaacaaggccaacagagaagcgcacagccatgaggattttcttgtggtgcagcatgtttagttgacaaatttgccctgcataacagcgttgttaactacttcaaggtgaaacagaatgcactcggtggccagccacagcctatggtcttatcacctattaatcgtagcaggcaaggggtgacgtcaaaagaaagttttgcaatttgctttcatagtttcattccattttttcgataatttcaaacgaaaaattaagttgttttgtctttttttttccttgagatgctgatgttggacgagtagttctccaattttggccacctattggttgtgattttaatcttaacttcttcaggacactgcgctgataagtatcgtcattgggaattcccattttggcaagtagttttataatttaccgctaagttttcgttcttatatcactcgttcatgttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgctatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtgagatggcatcggagatgagcaagaacgtgaaggtcaccgatgatcaagaggttacatcacaggagcgtgaccaaagtggtggtacaaaagtaggtggggaggaggaaattgctccactggcgcggcagtcgtcaatcctctccctcaccttggaagagctacaaaactccttgtgtgagccaggacgcaactttggttccatgaacatggacgagtttgtggctaacatatggaatgctgaagaattccaggctaccaccggaggttgcaagggtgccatggaggaagccaaggtggtagacagtggaagcggaagcggtgatgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggtacacatgttgctccgaaccttttagtttctatgtatcgttaagacattttgcatggagattgaaatttttatgaataatgctacaggcttatacggtggagctcgaagctgaactgaactatctcaagcaggagaacgctcgtctcaaagaggcagaggtattaaagcaagaaacattatccactcagctttcattgtcattcctaaacagtctcgttccttccttttctgtaacattgaactgataaatatacaatgtctatattatcttccttttacagaagacggttctactgacaaagaagcaaatggtattgtcctctcccatgtggcaatccccattccgcatagtgctcatcgttttgtgaaattattaaatacatatttgttattcatttatttgtgtgtgtatatatgctcatggaaatatgtcgtgttcctgtgatttttcagctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagtatactagtttgtatctgtaagtttgttctcatgtcatatgcgctggaaaaagaaaagctacagtataggcaaaccttggtagtatcgattacggcccaaatttctggccgaataaactggaaaccgaaacaagctgatgatgatttgggctttgcgatggcgaaaagttcggcttctatgatccgatggaaaagttgacgcgaggttacacggtttgctagtttgtgggaattccccgatcctcggttaatctcgccgtgttgccgtcgcttgagcaggagcagggatgcaagcgggacaggcaagcgggtttttttcccgcttatcccacttctagtctatcttttttttaaattttgtactactataaaaaaaataaactagcaagcaggtttttatgcaggtagcgggattacctacttacatccctaagcacgaggttgccagcatcgggcttagcgtctccactcgtgttcgtgttggttcctacctctccaagtctctacaagtctaatactctcaatctcaatgaccaccataacaatagcgtgcatgacgacgggagaataaaaaaatatattgataactagagggtgtggctggacatgcaaagacgaagcggagggacggtggtggtctcattgagaaagagcggtggtggcggtccgtggagcggcaggtagtgattactggtggtccgaagagtttgctatcgacacaatctctaatcaagtttattgtatttttttctctaagtagtgctaatatgtgagccaccaattattataaaaaaatatttcctcagtgtttcttttcccatggcctctgactatgacattatttaaacaagttttatactgagacactttctagtagattttggacagatgtgacacttttatattttggacggatgagacactttctaatagattttagacggataggacatttcagtaggagaaagtgtcatatttgtttaaaattagaacagtggaattactaagccaggtttaaagtaagaaaaaaagataaaggcggagatactcgagtatcttccctttccttgcgtgtaaaagaaagtctcccgtctcttctctcccgctccttgcgccatctcgcggctgaaccggggaggggcgccgatctctatccgacgagcagaccaagggaggggaggggatcctggtgagcatctgcatcctctttctgattcatctctctcaccgggagtacttttgtgtaatttgcttgcgttaaccctagcttatcttctagatctggaagaagctctcctcttaatttcagagccttaaccttaatacaaataacagtttgttgtttgttccaccaaaagtttgggggttcaactgaacccccatgtcccaagttggatccgcccctgggtgtaggtgtaatattgcgatagagatctcatgattgattgctatctcgttctcgtacttactgcttcttagtttcttgatgtgatcaaatagctgccagtcctttccatgtaaataactgcagatttcttgtttattacacgttttgaactaattgtgggcttcacattgtcgaattttaaggagttaatttgaccttgggtggaactgagtttaatatacaaaattattctttccgattcaagttttgcttatattgtactccatccctcgatgatgctagggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggtgagcttgctattctctgagattttgcttagctcttatgtggtaacaatagtgtgtttccatacatgtctttttttcttcaaaatagtaatattaacgatcatgtttatgcatttctagaaccacttttaccgtctcaacttgatgaagatttttgtattttcacacaataactacatcgtatcattttgattgtttagtcacaaacataagtgctttgatgttttgattatgcatgcttttcaattatcacgtcatgcagttattttagcatttctgatttatatcacatacaaatcgacatgaagttaagttccctcgcatagactaaggcaaaatttatggcataaaacaatatccattatgattgccatgatattcatgtatgctcatatgtgcaattcagatttcaacgttaacatataaatgacgggaaatgtaatgatggtatcatactttatataacaccaagtttcatgtaacaacaggtgttgtaagtgtaggccacagaatcacaccattcatcactgaccttttgttattttgtaacaggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagtattagctcaaactaacttaaaaaatggatttaatatgatttttaaaacaactttgctatagaagagttttgcaaacaccatttagcaatttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttctttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcggcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggaggtatttcactcaaattttctttcttccttccagtacaataatgtggctgaaaaatgatttggaaatttagaacagtttatttgatcttttttttcttttcagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggttagtcacctaaaagctggaattgaatagcattcctgaaagaaaacgacatgtcgaattgtatagtaattctgtatcttgtctgtcttagctagaaattttacacggtatggttctgccattatcttttgaacaatgaggcatcttcagataatctaactgtatattctaatgtcatgttgttttctctcctatattctactttggacacattgaaatctagcttcctgtaggttctttctagaataacactaggatggtcttttctgataaccttttggacttttcgatagtgtaactgtatataccaatcaattgtatgatacttattattttctttctttgcacacttaaagggtggtaacaaaaataaaagagcagcaaatcgatgataaaaacaatattcggtggtcatgtttatttcgagtcatttttatatcatgcaaaagtatgattagcaaatcattatgcataccttttttctcatgcaagtatatctaacacaacctgatctattcaccatgcatcgtagaggacttgtttttgcagaatgatcactacaatcctgaacctgcaattaataatttgctgcctactttgccaatatctaatacaaccaataaaccgcaatcaacatatctgaaaaggggccaggaggaataagaagggtcatgaacaaaccaaaatggaggtctcagtctccttttatcccttgaggccttgagaaagagacagagaagggataacccatgagaaaggcaaagaccattttcttccagacttctgatggaacagcaagctcctatccatggagctgaagtttaggtggctgtgtccttttcctgaacactattcatggattggaacccttgcaacttttgcaaggcatggaacatcataaatgggactcccaattattttttgctatgcttgtgggcctctgttgaggtaccagcaaacaaaagagaataaacaagagatatagccggcacagggggtagaggcacaaagaacaaccgtatgtattcgtccattgactttataaagaaagagacaggtttgtacatgtagagtactgtatgtaatgccagtacaagtgtacaacaacctttgcctcctatggcttggcccctaccaacaactcctttttgaaaagcatccaataattggtagtaccagtaatccggtatcgttagcttgttctcagttaataacaaggtaattatgcatgctggaaagtgctaatgatgcttatctgaaagtgttaagctggagtagtagtatagtacttctttctgacaaaagttggcctgtcagggagaaggttggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18402 - DNA, 424 bp, Oryza sativa
tcccatgccatccatgaagtcctttaccccagtccctccattcttctgacttgctgcacgaaactcttctcgggctttctcaggatttatctgcattaaaactcgaatatgccacactcaagcactatctatattgatctagagtaagtcaatcagaaggttgatctaaattaaatcattctgattccaaacaaatcctagaatttcacaggtagaggttttcagcttattactgtagaagctaaatgattatattgcatagctcaaagtttctcaaagcaaaaaggatgttctctacgatgttcatatgctaacacttcattacaatctaaatgattatgttgcatagcccaaagcttctcaaagcaaatggatgccctaagattttcatatactaataccgctcacctcaagcgcaaacaat

SEQ ID NO: 18403 - DNA, 856 bp, Oryza sativa
  unsure (1)..(856): unsure at all n locations
gcttaacgtggnaaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgaagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaactgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtagaatagtggctaggaggatttgaaaggcattatggaattaagatttcccaggtnnnnnnnnnnnnnnnnnnnnnnnnnnnnnnnnnnnnagcagttgttcatccctnnnnggagcccat

SEQ ID NO: 18404 - DNA, 759 bp, Oryza sativa
  unsure (1)..(759): unsure at all n locations
tggcggcgcnnntttgattgactgacanccgctcggnacccgagggtattgttaaaagatcctcgattcctaatgaaatccatgtagtagtggcttgatggaagcccagcgtttttatttgatccagtatatgggatgtatatcccattccgaaatgatctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18405 - DNA, 739 bp, Oryza sativa
  unsure (1)..(739): unsure at all n locations
cgttgtctccaatggtnttcgtctnnnnnnnnnnnnnnnnnnnnnnnnnnnnnnnnnnnnaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgaggttttttaagtggatcaacaaatactttttgan

SEQ ID NO: 18406 - DNA, 28512 bp, Oryza sativa
  unsure (1)..(28512): unsure at all n locations
cgtggtctcaattggnatgcttnnnnnnnnnnnnnnnnnnnnnnnnnnnnnnnnnnnntggattatgttttctgagacagaaaatgaacgcattaggactgcatcgaatctaagagtttataagagaaaaaaattctgtgggataaactttatgtctcgtgcagaatacaatacgatttcatctttcgtttcatcagaaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgcttactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgaccccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttaaaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntcttttcacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgggacttcctcagtcttagtcattagtgtaccccttgtatttgcttctcctgatggttggtcaaacaataaaaacgttgtattttccggtacatcattatggattggactggtctttctggtagctattctaaattctctcatttcttaaatggggttagtatttagtagcccgatacaaaataaaaaagggcccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatccgcttaagaaaaattgcaaagttttgaactcgaaggtttttccaagggatgcctgttaaaaattgtttcaacctctcaccaaaacagacaagaagtatatcactgaaaattaatacccagccatatgggtatatgaagggcgcgaattcgtttataccccacccaattagaggaaataaaacataaatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaaatccaagtcttaaatgaaaggatccggttggaatcataaagtgtggtagaaaaaactacatatagttttttctaccacactttagagtctttctattatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacacgtagacttgttgaagtagttcaacatattattgtgcgtagaagagattgtggtactatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaaaaagtcggctgggtggattggttcgagtgaagagaaaaaaaagccatccggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaagaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaagggagaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaagtaaaatacgcggtactttattgcttagtctagcttttatggaagctttaacaatttatggactagttgtggcactggcgcttttatttgcgaacccttttgttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgattggggtacgagccgatcgaattcaaggacgcag

SEQ ID NO: 18407 - DNA, 16684 bp, Oryza sativa
  unsure (1)..(16684): unsure at all n locations
tggggnnagggctggntttganatacantatnnnnnnnnnnnnnnnnnnnnnnnnnnnnnnnnnnnnnnnnntgactgctttaccaatagttgagactcaatctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtaggatccgcggctcaaattaaagccatgaaacaagtagctggcaaatcaaaattggaattagctcaattcgcggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaagaatangnnnnnggtagtggnantcgaacccngcaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaactggatcttgttgcacccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcagaaggggtcccaacccctgtggatagggtaatacatctaagaaattattccatcgaacgtactctcccctggatgctggaatagcgacatgaactaaatgtcctgtccaagccaaagaacttaccccgaaaagtcctgacaaatgatgattgagacgagattccgcgtttttgaaccacgaaaggcttggtttccatttgggttgtagatgtaaccaaccccctattaaggatagggtagaaagaaataatagaaaaagagctcctgtataaagatcttcattggtccgtaatccaattgtataccaccactgataaaccccagaataggcgatattcactggaccggcggcgcctcctcgagtaaaggctttcacagcggggtgaccaaaatgaggatccccaatcgcatgagcaataggtcttacgtgtaaaggatcctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgtccttgtataatgctcaaggctctaggctgagtagcaggagcaacttttaatttgttatgagcccaaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctccaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaattctgcgtatttggaccaattcaaggtgaaaaaaggggttgctccttcggcaaaactaggataaagttgagccaaaaggtcgcgattcaagataaattcatgaggaagtggtatctccttaggatcaaccccagcgtcaagaaattggttaatcggtaaagatacatggatttggtgccccgcccaagaaagagacccaagtcctaataaccctgctaagtgatgattcaacatggattctacgtcttggaaccaggctaatttgggagcggctttgtgataatggaaccacccagcaaaaagcattaacgatgcaaaaatcaatgcaccgattgcggtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcgcaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagatgaaaaggaatttttctatctaatagaacaatggaactctcgcgcggttgtggttgtacctgtactgcaggaataggaaaactcgctattcactcagttttttttccataataagattatggaggagagatggccgagcggttcaaggcgtagcattggaactgctatgtagacttttgtttaccgagggttcgaatccctctctttccgtttttcttaattcagcaacgttaatgattacaatgtatcaaatcaaatgacaatttattccagcaataatacaatacctttatttaatagaaattctctataccaaattactatggtatgtaaaatacacatagaggaaagaacaaaaaacaaaaaggaatcctagggttaatccatttctgttaggtgaatgggaaaatacgaattaagagccttaggtcgatttagttcggggaaaggggaaggggaagaaaattctatgaacctttccgtttttccttaagttcaagtttgacgagagtaatattctacaactaacaactcatttattttgagaccgacccacttcctatccaggattttttttactagtcctttatattgcaatgtgtcaatcgtcaaatgctttggcaatttccccgggtcggatgaagcaatagaattttgaaccagacgttttgatctttggttatccttcgtagtaataatatctcggggtttgcaacgaaaacttggtatatcgactatacgaccattaactaaaatatgtctatggttaactaattgccgggcctcgggaatggttgaagccatacctaatcgaaaaaggatattatccaaacgcatttcaagtaattgtagtaaaacctgacctgttgaactttttgcttttccagcgatatgtacatatctaagtaattgtcgttctgtcagaccataatgaaaacgcaatttctgtttttcttgaagacgaatacgatattgttcttttttcccagaatggaatttctttttcagattacttccggatttaggtgtttttctagtgagtcctggtaaagctcccagacggcgtatttttttaaaacgaggtcctcgataacgggacatgaagactcctttttttattgaaatttcattttacacaattaatttcattgtatttacattacagaatacatcgaaattaaaactgaattaaagtaaaggataaacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcggagaaaaagaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaaatgtcagatcttaattattaatcttagctattaactagttcgaaattggaagttctacttagaaaaaaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatattatatacgaaaacataataaagagaacatgcgaatttcttgtattttcagtccatcattatagacattttttgagatattttgtttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctctcaactagagacgaaccgctagactacatagagtaatgaattcaacgattcaaaaaaaactaacagatggaggaaattgcacaaggaatcctggtctcaaagaaaaagaaaatggggatatggcgaaatcggtagacgctacggacttgattgtattgagccttggtatggaaacctgctaagtggcaacttccaaattcagagaaaccctggaattaaaaaaggggcaatcctgagccaaatccatgttttgagaaaacaagcggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaacgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagcggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaactctagtatttatcctgtttttttattaataggtttaagattcaatggaatacatttcttttttattatagtatcggcaaggaatgtcgattattaactcgatatttaaatattattaaataggctttctttgtacaatgcataggactgccccctccccatttccaaattttggatattgacatagatacaaatactctactaggatgatgcacaagaaaaggtcannnnnnnnnnnnnnnnnnnnnnnnnnnnnnnnnnnnnnnnnnnnaccagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttactagttgttctaagtaatgcacgcggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagtttcagaagatatgtctaaagtagatggtgattgatagagcaattcttgctcataagttccagtattagtactgcgccgaacataaagcttgtggctggtagtaaaacatcgatttttcttttgagatagagttcgatcctcaactatttctcgcgatatcttcttacgaagttttgttagggcatctataacagcctctggtttaggtgggcaacccggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaaggggccataaactagagagtcttgaccaattcgaaagatcttttagtgtagttgaaataacggaattggaacttgtttggtcaagtaggggaaactcaatcaaactcataactgtcttaatggaatcttttccttcttttttttttttgtgatctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgaccccctttctttttgatttcctttctatttaggtatggtggagacataattcttatagaaacaaaactctctcgcttcactttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttatctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgactgttctcctattctctcgaatccatgaagtaagacattgattttgcaagaagatccactatgttcattgcataataagctcccttgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttgccactattagtagataaaatgatttctttcactcc

SEQ ID NO: 18408 - DNA, 15570 bp, Oryza sativa
  unsure (1)..(15570): unsure at all n locations
tggggncaggctgggcttganatgcnnattgtannnnnnnnnnnnnnnnnnnnnnnnnnnnnnnnnnnnnnnnnnnnnnaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaataattgttgtacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagcccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccggggggttcaccgcaaatactagtttggctcattattgccgcgacaacggcctacttcttcacattcaccgagcaatgcatgcagttattgatagacagaaaaatcatggtatgcatttccgtgtattagctaaagcattgcgtatgtctgggggagatcatatccacgctggtacagtagtaggtaagttagaaggggaacgcgaaatgactttaggttttgttgatttattgcgcgatgattttattgaaaaagatcgtgctcgcggtatctttttcactcaggactgggtatccatgccaggtgttataccggtggcttcagggggtattcatgtttggcatatgccagctctgaccgaaatctttggagatgattctgtattgcaatttggtggaggaactttaggacatccttggggtaatgcacctggtgcagcagctaatcgggtggctttagaagcctgtgtacaagctcgtaacgaagggcgcgatcttgctcgtgaaggtaatgaaattatccgatcagcttgcaaatggagtcctgaactagccgcagcttgtgaaatatggaaagcgatcaaattcgagttcgagccggtagataaactagatagctagactaagtggataaaattagatagaaaaaaggtctaaataaaaaagaagagaaatagaaagatcaaaaatcagttacgaaaatgcagtaattcttcttttttcttctaattgattgcaattaaactcggctcaatctgaaaaaagattgagccgagtttaaatagattttgatacgatcatgagacttgacaaatcgggattcctctattctatatatttagaagatataaaggtataatacaataaataaatacaaatagagtattatcatatgataatggaatcaaatacgcagtatttacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggactgctatagaatctggacccatcgtagagacgttcaaaaggctcctgatgataagaatcatactttcgcggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcggaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggcgcattcgactaagtcgtactttgaatccaatttcaagttcgattagaaggatagaaaggccgcgaggatcggaaaagaaaaatcaaatctttttaattgcttctccttttttgctattttcttattatttatataatccattcgattctttttttttagaatactttttttttagaatactaaagtattctaaaaaaaaagtattctataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatacggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaatcatttagcttattctctcaatttcaatcgaccgctgttagtatatctaatatgaattggcgatcagaacacatatggatagaacttctaaaaggttctcgaaaaagaggtaattttttctgggcctgtattctttttctaggttcactaggattcttagcggttggggcttccagttatcttggtaagaatattatatctgtacttccatctcaacaaattcttttttttccacagggggtcgtgatgtctttctacggaatcgcaggcctattcattagcgcttacttgtggtgcactattttgtggaatgtaggcagtggttatgaccgattcgatagaaaagagggagtagtgtgcatttttcgttggggattccctggaataaaacgtcgcgtcttccttcgattccttatgcgggatatccaatcaattagaattcaggttaaagaaggtctttttcctcgtcgtatcctttatatggaaatccggggccagggggccattcccttgactcgtactgatgagaagttttttactccacgagaaattgaacaaaaagctgccgaattggcttatttcttgcgcataccaatggaagtattttgagtaccaattgaattttttgaaatgaattgaatgaagaagaattggaagaagaaaagttttctcaacacgagggaaaaggtcccttcgaaattgcattattgtaaggggattttgagtatttatctaaaggaaggaacaaatgaggataagagaaaattgcttctaatttgtccaagtgggatatatggcgtaatattcttccattttcatccgaaaggacttttttctatttctctattccactccatctagatctaagaaagaactcaatgcaatgaaattctactagtatagaaaaaagaggaatagatacaaggtctcaaaccttgttatagaatttttccttcaaagaaaaagaaatatcatatagagtcagcgaataaagcggattcattaacaactcaatttacagatcaaaaatgaaaaaaaagaaagcattgccttctttcctatatcttgtatttatcgtacttttgccttggggagtctctttctcttttaacaaatgtctggaactttggattaagaattggtggaataccaggcaatcccaaactctcttaactgctattcaagagaaaagagttctagaaagattcatggaattagaagacctttttatcttggacgaaatgataaaagagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagttactgatttttttgttggatttcactccacccgcggttgggaactactaattcgttgggtctataacgatcttggatgggttcctaacgagctaattttcactatttttgtttgtagttttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaactgttgcagtagaatgacaacagattcgtgtatagggaactagattagcttagctacctatctaatttattgtagaaattccgggatctgtgattggacatggaaaatagaaatactttttcttgggtaaaggaacagatgactcgatcgatttctgtatcgatcatgatatacgtaataactcggacatctatttcaaatgcatatcccatttttgcgcagcaaggttatgaaaacccacgagaagcaactggacgaattgtatgtgccaattgccatttagcgaataagcctgtggatattgaagttccccaagcagtgcttcccgatactgtatttgaagcagttcttcgaattccttatgatatgcaactgaaacaagttcttgctaatgggaaaaagggagggttgaatgtgggtgctgttcttattttgcccgagggattcgaattagcgccgcccgaccgtatttctcctgagttgaaagaaaagataggaaatctctcttttcagagttatcgtcccaataaaaaaaatattcttgtgataggccctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggtatagtaatgctatgaataacccagtatcgaatactggtaataatatcagcaaaagaacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatcaatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaannnnnnnnnnnnnnnnnnnnnnnnnnnnnnnnnnnnnnnnnnttgaacatctatnnnnnngnccccat

SEQ ID NO: 18409 - DNA, 23825 bp, Oryza sativa
  unsure (1)..(23825): unsure at all n locations
cgttattgagnatcnnnnnnnnnnnnnnnnnnnnnnnnnnnnnnnnnnnnnnnnnnnnnnncacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttctggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttatacgttccttttagtttcgactttagggataatttttttcgctatcttcttccgagaaccacctaaggttccgactaaaaaagtgaaataatttaattgaagtaagaagtctccccatctgggagacttcttacttcaattagtccccgtgttcttcgaatggatctcttaattgttgagagggttgcccaaacgcggtatataaggcatacccagtaaagcttacaagtaaaccagatatggagatggcgactaaagttgctgtttccatttttatagaatttcaagattacaatggatctacgaaaagatcgtgtatttacaactacaacggaatagtatacaaagtcaacacaaatcattaaatggaatttatggctacacaaaccgttgaagatagttctagacctggaccaagacaaactcgcgtaggtaatttattgaaacccttgaattcggaatatgggaaagtagctccgggttgggggactactccttttatgggggtcgcaatggctttattcgcggtattcctatctattattttagaaatttataattcttccgttttactggacggaattttaatgaattaggtttctactaacgaaaactacgaagtcatagtttttccatccaaaagagcctttctactttaagctctacatttctagacattctggtagttcgaccgtggaattttttggtttcggtatctctggaatatgagtgtgtgacttgttagaatttgctcctattgataatacatagaaagcacctgttatctctatcaagatgattctaattcgtcggatattatttattctagtatctggaacacgaaatagatagagtggatcaagaaaaaaaaatgaaactatgattcatattaactattcagacctcgcaaccagactgaaaaaaattcaagtagttcttaataaaaataaaaaaagaaaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaaaatactataattcacatttcgaacaggcatggatacagcatctataggataacttccatcttgagtgttctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcggaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaatttttacttttactccctttatatctgtttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtcccgaagactaactaagaccaattgagtcacgttttcatgttctaattgaacactttccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaatcagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatggnnnnnnnnnnnnnnnnnnnnnnnnnnnnnnnnnnnnnnnnnnnnnnnnnnnnnnnnnnnnnngaaggggatcctctagagtcgncctgcaggcagcagggattgtactcaaannnnccccaa

SEQ ID NO: 18410 - DNA, 1933 bp, Oryza sativa
  unsure (1)..(1933): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccatgtttgaagtcattacccttaaccgtaaggagggggatgcctaaggctaggcttgcnnnnnnnnnnnnnnnnnnnnnnnnnnnnnnnnnnnnnnnnnnnnnnnnnnnnnnnnnnnnttcagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnannnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctannnnnnnnnnnnnnnnnnnnnnnnnnnnnnnnnnnnatagatttgtcatccaatnnnnnagccccact

SEQ ID NO: 18411 - DNA, 737 bp, Oryza sativa
  unsure (1)..(737): unsure at all n locations
cgatgcgatgttatgaataacattcgccagancgccgcggncgactctagaggatccccgttaatgatgtttgagcatgtactttttttgagtgtctatttatttttctttgttatctatggattgatcacaagccggaacatggttagagctctaatatgccttgaacttatactgaattcaattaatctaaatctcgtaacattttctgatctatttgatatccgccaattaaaaggagacattttcgcaatttttgttatagcccttgctgctgctgaagcagctattggattatccattctttcttccatccatcgtaataggaaatcaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18412 - DNA, 896 bp, Oryza sativa
  unsure (1)..(896): unsure at all n locations
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttcatagaaaggaatgaatggctcggctagatagaataaccgagccagaacagaaaaaaacagtagaacaggtataaataagaaaatcttagttaagaggggtcatgtaaagaacaggctccaaatcacgatcgattcccttttcaaatcctgctgcagcagcccgggctcttcctgcatgccacaaatggcccacaaaaaagaagaatcctagaacaaaatgggaagtcgctaaccaacttctaggagaaacataattaactgcattgatctcggtagctacgccacccacagaatttaaagagcctaaaggagcatgggtcatatattctgccgaacgtcgttcttgccaaggttgtatgtcttttttcaacctactcaagtccaaaccgttggggccccttagaggttctaaccatggagcacgaaggtcccaaaaagggtaccgagctggatatcaattcaatgcccacg

SEQ ID NO: 18413 - DNA, 777 bp, Oryza sativa
cgcgtttgaatccatctctgtacctcttccctctacacctagctgctcttgaagttccatctcttaatggataaggcttttctgctaacatatagcaatttttgaagaaaggaaagctagaaatacccaatatcttgctgaaacaagaaattgggtatttcttttttttttattttgaatctttctattctgaattcagttaacgacgagatttaatatcctttcttgcactttcataactcgggaaatgcccagttggtaccaattcccccaatttgcgacctaccataagatttggtatttaaataggtatatgttcctttccattatgaatcgcgattgtatggccaaccattgcgggtagaatgctagatgccccggaccacgttactattgttctttctcctccttatattgaccttttctatttttgcaataaatgatgagctacaaaaagattcgtttttttcgtgtcacagctgattacttctttttttccattttaaagagtggcattcgatgtccaatatctcgatcgaagtatggaggtcagaaaaaataggataatgatgaatggaaaaaaagagaaaatcctttagctggataaggggcggatgtagccaaagtggatcaaggcagtggattgtgaaatcaccatgcgcgggtttaataccggcgttcggccattccattattgcaatttcaaaaatgcaattttccatattcctaagtacgtatttacttaccggggaccaagaattaaacttttactatttt

SEQ ID NO: 18414 - DNA, 1950 bp, Oryza sativa
  unsure (1)..(1950): unsure at all n locations
aacgccttcctttttctgcccatcggagttatttcccaaggacttgccatggtaagggggagaaggggaaaaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggtcagatctagtatggatcgtacatggacgatagttggagtcggcggctctcctaggcttccctcatctgggatccctggggaagaggatcaagttggcccttgcgaatagcttgatgcactatctcccttcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaagtccagtagccgaaagcatcactagcttacgctctgaccccagtagcatggggcacgtggaaatccgtgtgaatcagcaaggaccacctttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagcttccagcagggggaggggaaagtgacttttaccgcttccttgttaaaaatgacccgcgactaataggcaggggtttggtaag

SEQ ID NO: 18415 - DNA, 17909 bp, Oryza sativa
  unsure (1)..(17909): unsure at all n locations
gtgtgncttgttatatagactcttaatcttgcatgcctgcaggtcgactcttaggatccccctgaagatgaacggggctaagcgatctgccgaagctgtgggatgtcaaaatgcatcggttggggagcgttccgccttaaaaggaagcgggcgcgaaagcgggggtcgacgaagcggaatctagaatgtcngcttgagtaacgaaaacattggtgagaatccaatgccccgaaaacccaaggtttcctccgcaaggttcgtccacggnnnnnnnnnnnnnnnnnnnnnnnnnnnnnnnnnnnnnnnnnnnnnnnnnnnnnnnnnnnnnnnnnnnnnnaccccttgttggtaccgagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgccccctcgcaaaagggggtcgcagtgaccaggcccgggcgactgtttaccaaaaacacaggtctccgcaaagtcgtaagaccatgtatgggggctgacgcctgcccagtgccgaaaggtcaaggagtttggtgaactgatgacagggaagccggcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcctcgagtgcaaaggcaaaagggagcttgactgcaagactcacccgtcgagcagagacgaaagtcggccttagtgatccgacggtgccgagtggaagggccgtcgctcaacggataaaagttactctagggataacaggctgatcttccccaagagtccacatcgacgggaaggtttggcacctcgatgtcggctcttcgcacctggagctgtaggtggttccaagggttgggctgttcgcccattaatgcggtacgtgagctgggttcaaaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgcggagaggataactgctgaaagcatataagtagtaagcccaccccaagatgagtgctttctcctcggacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnggnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtaattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatggatcgataaatgtttagatttctgtgattattttttacgaggagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgctttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgacgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctataaatgtcttgatcatatttgccgtaatgttcgtaaatggctcagaatggtctaaagataagaatttttggactattggagatgggttcacttcactcgtttgtataactattcctttttcactaatgactactatcccagatacgtcatggtatggaattctttggactacaagatcaaaccaaatagtagaacagggtctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctcttaaccgaagaagcctgtgctcaaaataatcgagcacgggcttttctggtcaaaacgtatcttgtctttatcactttatcatgagttcttttccttggctaacaatacttgttgttttgccgatatttgcgggttcattaattttcttttcacctcataggggaaacaaaatcgttaggtggtacactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaaagtttattttgtatactgcaggtggttccatttttttcttaatcggagttctaggtatgggcttatacggttccaacgaaccaagattagatttggaaagattaattaatcaatcataccctgcaacattggaaatactattttattttggcttccttattgcttatgctgtcaaattgccgattatacccctacatacgtggttaccagatacccatggggaagcgcattacagtacatgtatgcttttagcgggaatcctattaaagatgggagcatacggattgattcggatcaatatggaattgttacctcatgctcattatctattttccccttggttagtaataataggagcgatgcaaataatctatgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaccggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaagaaatctaaattctttcgaaatctaatcattagaagagcggcggataataaggatccgcacaaaagagtcgcatagcttagtaacatcatactgacatgcatcattaaccactgagattgtagagcaggtactagtattgtggattgatgcatttcagttaaaagacccgacgtggcaaagccttgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattttgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaatacaaaaaaatattaaagtaaaatgattcaatcttttttttgtattttaataaaagtccttctttaggtaataactaggtaacgaagttatttcattaactttttgactttaaccaacaaaacctattcttattttttgattgtttcaatgagaaaatttttgaaaaattaagaattctagtatttttttattccttcagaaatagataagaattagtttggtgaatcggaaacttttttcaattttatagaaaaattgaagtaaaattttcaagtaaaaattgcaatttcttttcttatggaacatacatatcaatatgcatgggtaatccctcttctcccacttccagttattatgtcaatggggtttggactttttcttgttccaacagcaacaaaaaatcttcgtcgcatatgggcttttcctagtgttttacttttaagtatagctatggtattctcagttcacctgtctattcaacaaataaatggaagttctatctatcaatatctatggtcttggaccgtcaataatgatttttccttagaatttggatacttaatcgacccgcttacttctattatgttaatactaattactactgtaggaatcctggttcttatttatagtgatgattatatgtctcacgatgagggatatttgagattttttgtttatataagttttttcaatacttccatgttgggattggttactagttccaatttgatacaaatttattttttttgggagcttgtgggaatgtgttcctatttattgataggcttttggtttacacggccaattgcagcgagtgcttgtcaaaaagcttttgtaactaatcgtgtaggggattttggtctgttattaggaattctaggttttttttggataacaggtagtttagagtttcgggatttgtttaaaatagctaataactggattcctaataatgagattaactccttgcttactattttgtgtgcttttttattattccttggtgcggttgcgaaatcggcacaattccctcttcacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattcttttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcataattccatgaaaatggattattccatgaattcctcaaaacgaggctcatcaaaatgcaaaatctaagactgctataagactactaataaaataagaaaaaaaattcgaacgatgatattaccgctccctaatatccaactgactgattaatttcttataacgtactatatttttctttgccaaataagccagcaaacgttgacgttttcccaaaagtcttaggagacctctttccgatgaaaaatcttttttgtgtaattccggtggagtgcgcagtgcattcaaaggggcgcac

SEQ ID NO: 18416 - DNA, 758 bp, Oryza sativa
  unsure (1)..(758): unsure at all n locations
tgtgcgngnnnnnnttttgtagatggacaannnnnnnnnnnnnnnnnnnnnnnnnnnnnnnnnnnnnnnnnntttcagtttcctacgtatactggtggatttgatcttcgatcaacctatgtaagatgatttgttgaattggatggttttctgaactcccttgcgggtgagttatatatgcacaaattttgcatggctttaaattcccagttaattagtgattatgtggatatgtagaatcaattattgatatattcttcccagttaatttctccctccaattatgactgcctgccgcgaattgatacatgcgtaaatttcattctattgattttgccatcaaaacgaaaaaattaattatgtaccatccaaatttacaatcctttcgaaatttactgcctaatataaaatgtcactccacaatattgcaaaggaaaaaatgtcacccattagattgcaaaggataaaatgccactcagtatactttaccactttgagcagttttgagaccaaaatgccctcaccgtggagagagagaaagggagagagaaacgacggcggccgtgctcgtcgccggtgggcagcgagcgcgcgggggtgggcagcaaagagggaagaaggagggccccgctgaagggggaaagacagcgccggctccatcggggaggggccatcgaggggaggacagcgccggctccatagggcgagggcgctgatgtggggaaagaggacggcggccgcaattggcaccaccccct

SEQ ID NO: 18417 - DNA, 2456 bp, Oryza sativa
  unsure (1)..(2456): unsure at all n locations
agtgggggnnnnnntttgaagttgcagcannnnnnnnnnnnnnnnnnnnnnnnnnnnnnnnnnnnnnnnnnttatgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaaggacgcatacccagacggaaactcagttcccactcacgacccatataacaagctacaccaagtaagaagtgtagaacaattagctcataaggaccaccattgtataaccactcatcaacagatgcagcttcccaaattgggtaaaagtgcaatccgatcgccgcagaagtaggaataatggcaccagagataatattgtttccgtaaagtaaagaaccagaaacaggctcacgaataccatcaatatctactggaggggcagcgatgaaggcgataataaatacagaagttgcggtcaataaggtagggatcatcaaaacaccgaaccatccgatgtaaagacggttttcggtgctagttatccagttgcagaagcgaccccacaggcttgtactttcgcgtctctctaaaattgcagtcatggtaagatcttggtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaatttttgtaatgaagtgagtgaaaaatcaaaactcagattgctcctttctaagttccatatgggttggccgggactcgaacccggaactagtcggatggagtagattattattccttgttacaatagagaaaaaacctctccccaaatcgtgcttgcatttttcattgcacacgactttccctatgtagaaataggctatttctattccgaagaggaagtctactaatttttttagtagtaagttgattcacttactatttattatagtacagagaacatttcagaatggaaactgtgaaagttttaccttgatcatttatcaatcatttctagtttattagttttgtttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttctttttgaagatccactgtgataatgaaaaagatttctacatatccgaccaaaccgatcaagaatatcccaatccgataaatcggtccaaattggtttactaataggatgccccgatccagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccattan

SEQ ID NO: 18418 - DNA, 3997 bp, Oryza sativa
  unsure (1)..(3997): unsure at all n locations
ttggggntccnnaaaagataacactnnnnnnnnnnnnnnnnnnnnnnnnnnnnnnnnnnncaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagttgactaattttgattgacagacttgaaagaaaaaaatcctttgaaattttttgagtcgtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggacgaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggaaggattcgnnnnnccgagtaacgggaccaaaacccgnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcggaattcttccactctcatttgagagtgcgaatacaaggagggttttttgtgtttgggaaagtccgaagaaaaaaggattttgaattctccttttcctttttcccttaaaaaaataacctcaatcaaaatccaattatctactctacaagaacgaaacgcttgttatgcctaatatacttagtttaacctggatttgttttaattctggtatttatccgactagttttttcttcgccaaattgcccgaagcttatgccatttncaatcccatcgtggattttatgcctgtcatcn

SEQ ID NO: 18419 - DNA, 865 bp, Oryza sativa
  unsure (1)..(865): unsure at all n locations
ctacgtcctgttagactatatatttcttgctnacatanacatcncctctttcgtactacgtttccggccttcttacattaattttcgttgcctgacttctcttctatctctcccccnnncccccacgtgatttgtagatctnctnnnnnnnnnnnnnnnnnnnnnnnnnnnnnnnnnnnntttgtatttgccctttagttaaaattttcaatttcattaagaaaaactaaatagaaaaatggaaaatgaaaatggatagaattcctacttttttcttcaaatccaaaaactttctccttttttatacataggtcgtcgattcggcattggataaaaaagggcagggtgccccttctagtaaatagttcaaaccattttatcgatatgagtgttctatatcagataaattctacattagctatttcctgtttaaagcatttggtactaatactaatatagttgtagaaagagtacccccttttgcctagacttcaagcagtttagctttaaccgtgttaatggtctcatattattggtctatagagaatcaaagttgatttgatttaccaataggtcgcgaaatgctatggttctttcatatgatttctgcatttattcagaagtaattcgtcgagatcgtgcacccttttcttatttattcgaaaaatactaaaaaatattctaaagtgcagccggatagatccaatctattcttgaaatagacaacttgcacacactcccttttcaaaataaatcaatacaccaaccactacaggtagatttattagatttgttgctaaaatattggtattaagcccggaactcccagcggatggcccgtgagcttaaaaaaccaaagaatggg

SEQ ID NO: 18420 - DNA, 742 bp, Oryza sativa
  unsure (1)..(742): unsure at all n locations
gcgtcttagttatcttccnnnnnnnnnnnnnnnnnnnnnnnnnnnnnnnnnnnncttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccagggaatatcaatgaaccccattcttgcaattgctcaagaataccctcttttagctgctaggtctatttcttagntcaagatccctcttactaaa

SEQ ID NO: 18421 - DNA, 750 bp, Oryza sativa
  unsure (1)..(750): unsure at all n locations
gtggcattgatggcatgaanaacnnnnnnnnnnnnnnnnnnnnnnnnnnnnnnnnnnnnnnnnnaaaaatcctacaaaagcataatggaaaagtaggaaggactccttgctttggatctagttatactcttcgagtatatggacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatn

SEQ ID NO: 18422 - DNA, 13774 bp, Oryza sativa
  unsure (1)..(13774): unsure at all n locations
cgtgcccttganataganttactcattctcgcatgcccgcacgtcgactttagaggatcccctgtctggcccaacatatttgagacatctccccatgtcatcaatgctgtcatggttgcgattgaggggatgagagttgctcttggtccagctgtgatcttgaattactgccttcaaggccttttccatccagcaaggaaagtacgtgaagtatattggaaaatctacaactcattatatataggtgcacaagatgcacttgttgctgcttatcctgcactagatgatgatggggataacatctacagccgtccagagctggcgatgtttgtctgatcaatgtaagtgttgtttctttcctattattttacttaaatttcgcggcaaatattattgaaacttctgctgtgatattgtatcatgggttcacatttgttcattcaggtgatttctttttctaaagagcaaccattgcattactcgtatgtatgattccttttggtttactgctgtccttgcaagtgttttatcagttagcactgttccttgacaaatgggtatccttagcctgggctactgtatgttattaggccttaggcagtttgacctgctggagtaattgtaacttgaaacaactcagaaaaatagagctgcagctttttataaatcactttacattgatatgttagaattgtatggtcttgttggttacttggtttcagtgaacatctatcacgagctgcctatattgaatggactaggttgcaccaacagctgatttgttctgtttgctcattttcagtggcgccaacgctttggttattgttatcatatgaaccatagtgtgcaggcactagttcgtatttcctttcatgtttctttctgcaaatttgctttatgttctgcctttttcttccctctatgcaaagaacacatctgatgtgagaacgcattggcaggcaggatgtacatttccatgtaccgtcatccaatatatgcgtgtgaagcttgaactaggtggtatttgagttggctgatattcatatggtgtttacttgtgatggaagcattttcattgaagttgcatttcttttttctgtatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgcatgtcacactttgttgccgttgcatgatcccctccgctctgaagagaaaatgatcaaacatagtattactgctgtcccaaattcccaataactgtattattagcaaaaaactgttataagctacggtcgagattgtgatcttgtcttattattagcgtctgtattagtaatgttattactatgcctggaacgtcacttatgtatgtttggaacgtggtattagtattactaccctgctctgagtctcagatggatcaatggatggatggttttatcttggtgtctgttttcttcccggattgttagttgttactctagaaaatattttaaattgtattgtacctgtatctaccccatccaacctgagaatatgttgtggtttgtggtccatcagacaagctcctcatcagtcactagttacctatctgagaacaagaattgtggatgtcgaacttatatttgatactacctctgtcccattttaagtttttaggtgcaaccataatttttcgtgtctaattttgatcgtccgtcttatttgaattttttttaaaaaaaaagttcaaaaatataagccatgcataaagtactacttatgttttatcatctaataatgataaaaatactaatcataaaaaaaatcaaataagatggatgatcaaagatagatatggaaactcatgactgaacttataatgggacgaatggagtagcatagaacatgaattttgcttgaacattgcggcacttgtgaattttgcctggagcggtggtacaaaatactcaggaatcattccatattcccatccaactcaacgcccagacgacgacgtcgacgcaaacgcccacatatacgagagcgagtcacaaaaccaaaaagaagaagaagaagaaaaaaaaaaacagcagtagcagcggcggccactgtttctctccgcgtcgcgcacacgcttgacgccacgcaagaggaccaggtcaggtccggtgcgcgtgcgtgcacggtgcaccacacccacacccgtgtcggacgcggcggctcaaccgctttgacccaccacccgcgtctggtttatgcgggccccacctgtcagtcagaaccaccaaggcccgtccggttcgcgccgcgctcccttcgttcgtgcgcttcctcggtcgccggcgatgccgatggcgccggcggtggtctcgggcaagaggctcgtcgtgttcctcttcgtcgcccgcgtcgcgctcgcggcgccggcccagctcgccgccccgctcgcagtccttgccgcggccgccctcgccgtcgagctcgccgtggatgcctccgcctccgcctccgcctccgcgtcctcatccccgctccgccggttcaggaccaggtgcgacgttatatcctcccccgttcttatccgtattttcttccgccgcatctccacggagctgggctgctagttcgcgcgatttggttagcttgggggattgcgtgatctttgataccagtgttcgagtttcgaaccccccacgaattaagtcttagaggagctccctgtgatgccagggaacctgcaaggtgcagtgtttttgcaaaattcgttggcgcagccgtagaatctgaggcgaatttatccatttgttggttcaatgctggctgcctccctgtgaggatcatgcaattggggaaacgacatcagtcggattcagcataccgcaggaatgtgattttacttgtacttgaggcttagtggattttattttggttcagtagtgtgtaaaatggggtcagatattggtggttccaacaatccaagggacaaatatcactcttgaataattgggtttcagcatttcttagttaacccatttcacaaatgggaaattcagaggtgcttttatcataaagccagtcaaaatattgctcccattttgatggccaaaatactgttccattgcattttcagctgaaacgttgctcccactgtcatttatatgggttctgtgatgtgcaatcctagttgcttactgtaagattttgtcacgtcttgtgttgtgaggacttcaccttcttgtggtggcttgatgctcttgtgcatgtttctgtaaaagattgttcagtgcttgatgatgatatatgtatatgctccaggccgggtgcttcatcaggcatacttcttggtgccactactctgcctagtgtcatgctttcacggttaattcaactttatagggtcttactagccgatcctaatggacgtgaaggtatccatttttctattttgtcaaatttatcagttccattactaaatggaaatttccccaagtcttcatcaacatttcaaatcttgtttgacactaagattttcggtgacgcatctggtttactaactacatatgtggttcattgtcagaatatgcataccttgaaatgcagtactgggcagtatctgttagctgcctcagcatgttagcattttttgtttggcatctacggcagtctcccagcaatggaaattctatagcttcgaaatacggcttgttgctcatcattttatatcccctggcatacttgtttcaccttttactgaagactgatggaggtacatgcatattttatctgcatgcaaagatagtctcaccctttctttccaaaatctggtggaagttcatcagaagcaaggaattacaaactaatctaggttgtcttaacaggtctgctggtgatgagtaatttggtgtatttgctgtgtcatggagtggctgctgtgatcttaatccagcatattctagagaagttcccttcatgttcatcttttggtttgtacctgaagtctaagatgtagatcttcttttttttttgtttatatcagactgcatatgtttagactttagagctatccatacgattgctagttatcctaccagtttccatgcaggcatggtgcattatgtctacactgttcattttttaaaatttaaattcagctaatttgtgtggttcctattggccgatgcaatgtatatgtctccttttcatcatgacttgaagctattgctttttttaacttatctttacattttctgtgaacttaggggaggccattttggtctcaagtggtcttgtttctttactgtggtgatatgctggctcatactctttcaaaggtgtgatttattcctcgaactatgttttaccagcaaaatggtagcaaatctgatacttattttgttgcctgcacatttgcaaccgtgctgctggcagatggagttctccgtatcatcagaagcatttattcgcgcacctggaactcgaaacgagataggcacagttattcaggtagaagctattgcgttgtctggcttcagtttcttagtgcataatacccttcccttttttttcttttctgcagggggttttgcttggtctttttcttctccccttgttatacaaaagctcccttcaagttttggcttactgtagaaaactggagagtcaaagaacacaaacagttgaggaatgcacacagaagagaattgactgtggtgtattttatgtttcattgttgatagcactattgttgttagtgccatcatggacgcgtcttattcaaggttttgaagtgcatccatttgtttggtgagcatataagtttgcatttcattggaagggcataaaagcatgcactttgttagtcaaatattgaatttttttttcctgtgttgcttctaaaccttgtgcatttttgtacatattgaattttggttcacttaatggtttattatttcacagggtttttaactatattttcaccgattcacgtgaacggcttgctttatgcgcaaactggatatttgtgatatatgtatcaattagaaggttctacagtatatcaaaacaaagcaaaacggagaggattcttttgcgcaagtattaccatctcgttgctgtcctaattttctctcctgcagtaatatttcaggtaatatatgttttcgttattcgatccctatcagattgtttgaaacacactcccaataaattttttctctttgcagcctgatttcttggacttggcatttggtgcagcatttgctgttttcttaatattggagatggttcgagtaagcattttctttatttgtatccctttctttctcccgtttctctgttttttggcagtttgtatgccaacatgtgctaatttctccaacgaaatgtttcaccctgacctcaggtttgggaaatataccctcttgggcatattgtgcatcagttcatgagtgctttcactgatcaccgcgattcggagattctaattgttaggtaggtctggatgaatggtcgttgttttccagattttaactcatttacatgctcaatacttggataggcctaatactatatttgttttgttcagtcatttctcactcttgctgggatgtgcacttcctaaatggatgtcatcaggattcaatgaccgacctcttacaccatttgctggaattctcagcttgggtattggtgataccatggtaggttctatgtccagtgtgtgatcagttaatattttcttatgttagctgcgttcagtatgatgaattctcttgttttacctaggcatcaatgataggttataagtatggtgtcctaagatggagcaagacaggaagtgagtttgatttccattattatttattccatggttgataattgatctcttatgcacatacttttgaaatgttagagaaaacaattaagggcacagcagcaggcataacttctgtattagcagcctgctcaatcctgctgtcactcttagcttcaagtggatacatactttcacaggttttactttcccccctggcattaaaccatttgaagcttttattctacaatacactaagcaagcataaatcctgaccatctcttttatattaacacagcattggatatcacttttggtagctgtgacattgagcggtttattggaagcatatacagcccaactcgacaacgctttcataccccttgtcttctatagcctcctatgtctataggagcaaccagttgtacatcaaactataccttgaggccctattcttaccatgacttatctagtgactagtgcagtacagtataggtatagcccttcgaaatttttttttaaaatcctcttattggtcgcattctctgtattcctggaccgagaaattgtgtccattactaaaaggttgagtttaggtttaggaaataaagatgaaaatatgaaaggttgtttagtgaatccttcagtagagagcatctttggtatgatagacttctgagcctatctggaggcaacaaggcatcaatgtatcatggaaggtatgttgtctttcagaactagaacttcttctgcaggtggtgatacctgtttcaccccacaactccacaagcagttgggcaagaatagcaagctgagagtaaagccatatgctgcaaggagcctgaaatacggagacttggttcagaattaatgtatatatatatgctaccttatttccatggacatgcgaagggtaattagttgtagtagctaatctcctgtaagttttgcgtcatcactgtacggagtaaaagataactactcagattgcaaccgcgcattgatgtaaattttgttcttgacctgagaaaaaatgaaatcgaagtaagcaaagctgcaaattaatgttctcctattatgagattggcaggtttgcgatgtttgagttgtttatgtgatctgtttatctatcaggatacctccacctgccgacttgccgtgtcaagttcagtcagatgattcttgcctaattgtctaattgaacaaaagtttagtcagaagttcaattagacaatggatgtgcagattctcacatcagtagtctttaatatggtattctaagtagttcttttttttttcaaatcaagctgatgaaaataatccgtgtcctcaatatggtattctaagtagttcattttttggacttcgatcgtcctataacttctatgataatcaaatgtcacaacgcataggccaaaatgaattcaattatcttaacatgaacttctatgatccaagcctgtcacaccttaaaaatcctaaatatataaattgttgtttaattggaattattagaatttattttaaaaagccttgaaaagaagatctagttttaattaataaattccaatataaaatggggccagataaaatttcattaaatactttgcttaactctataattcctagatttttctggaatttatttgagctaaggaagtatttttaataaatggaattgcatttcatgaataatttaaattgaaaaaggtttttaaaagtctcttttggctttgggccgaaagtcggcccaaaaccctctctctctcctcctcggcccaagccggcccagtccgcagccgagccgcccgctcgcgcgcgcgcgctcgctgccgctgacaggtggggcccacctgtcagtcttcgtcttcctcgcgccgctgccgccgcccgaaccctagcgccgcgccgccgtcgtctcctttcaaatccaaccgcccctttctgtttccggtgaaattaatagaggggaaatgatcctcgggatcccctctaccttttcccttttggaaacatcgtctaaatcgttttggaactcgcggattcgagttcgattcggatcaatctctctcctctgaaccctagactttccttcgcgtcgccggtcgccgtgggccttcgccgcagcctccttgcccctataaaaggacccccaagtccaccgctacctgctgccaccctcgccttcgtctctcgccgtcggtagcgccctagccccgtgagacctcgcgccgccgtcgtcgccgccgtcgctccagtcgtcgccgtcgctcggggaggtcgccatcgtggtcgccgtcgcgtcgccgtcctcgtccgccccttcgccgtcgctgtcaaccgccggagcaccgtcgccgtcgtcaagccgaagagtgccgccgccttctcctcgtcgccgatgtcgtccggtcatcgtccgccgtcgctttggtcaccggtgagttcgccgtgccgtccgctacccgtaggagccctccgttcgcgctgtcgtgccgtcgttcgccggcgagcatgcacgcccgagccgccgccggtggtgacgtcaccgccgacgtcgtcgtcgtcgtctctcgtggtccgaccgtggaccggtcgatctcggccgtccgttttggatggaaagatctcggccattcgtttccgtaagccgccgccgtgcacccggtccaccgaaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcctttttgtttagattccgacgtttccggagagtctgttttcgcaggagaagaatttgaagagttccaaggccagcaaggcaagtcacacagatcctaaacacaatcctttgagcatgttgatcctatatttaaattctctatttatttcaattgtgcatttattttcgaatgtcactgggtagtgtgaatctattcctttgttatggcctgtttgcattgattactttattccttgataccttgggttattataacttgactagttgggctatatatattggttcagctagatattagataagattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaaataaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagatctgtacagccgggtatggttgttcaggatggttgggcctgagcagcatgggtgtgctgtttagtgttgattaaaattggtgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatctttccgctgcttagatctttattgattgagaggaactatctacctctgtaatgacattttattcgcttattaattagagtaataattgtactctattatcaatttgttattgtgtgcctcggctgattcctgtacgagggttcacacacatgtaagcatttggaattttggatagaaattccgggcgtgacaagttggtatcagagccccttgaccctaggttatgccaaatggttacccatagaagccctctaaaaatattggaaaagtagaactgttctcctccccttctcttttaattaaaccaaactaatagcacatgcacttcataatctcttttagtggttctcattcaaaatttattccagtgttattagtactgtacatctattactgtactaatggctcatttaccagcaaaagttttacaatattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcacgatcgtcacgaaaagaagtgccgagtcaaagtcaccttgaacagtaatagtgaagatatctcctcagtgatgttcgaagctggaggaggaaactacatccatgcatgtcaggaggtggcaaggatcgccataggagagctccgcgatcgctacagtgatcagttggccgacaccttatcgctaccatcctcgccaaccacagggaagtgaccatggcagctaccttgagactgagggaattgagaatgatgctaccacaaggcatttggttgagatgctgtgggctatggatgaaacccgtgcgaagactgtgttagcggctcaagatcgtgaagaccagaatcgtggtaagatttgcaagctagaggacaaagtggatcgtttggagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatggagacgagccgaacgagccttcaatcaactccgatgcccggaagacctagaatgccttgtcaaaccgttgtcttagatcgttgtgttagtttgcttgttttaagtttggttgtgtgtttctcgcatgtgatttacatcagtggtgggatgtaagtgcatgcgtttgtttgttttcgagtgttaggtagttggtgagtttagtggtgtgagagtcttcagttttgtaataatgaaactcacttaagatcaataaaagttaaattaattctctgtcctaagtagttttccccggtttctcttcttgtgctcctgcccatgccagatggtgctcactcgcagcgacgggaatggccccaacatcaacaataacaacaacaatggagagaatcccacacttgcccaagtcctggctcaacaggcacagcttatgaacatgatgatgcagcaactccagaaccagcagaaccagggaaataactatgcacctccccagaacaagttagcagaatttcttcgtgtgaggccgcccactttctctagcaccactaatcctgttgaagctggtgattggctgcatgccatagaaaagaagttggatttgcttcagtgcactgatcaagagaaggtctcgtttgcatcacaccagctgcatggccctgcctctgaatggtgggatcacttccgccttaacaggactaccgctgaacctatcacttggcttgaattccccgctgctttccggaagacgcatataccatcgggagtggtgtctctcaagaagaaggaattcaggtcgctcacctagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaatcgtgtcacgcccaggaattcacgaaccagaatttttaagctgaatgtgtattaaacccctgtccaggaccagccagggtacacaaacgacaattgttgacatacagattcacgtcttacaaaaatataaaagattacaaatgcagcggaaaaggtaaagcgagctaagcctgaagacttgactcctgcagcgggcgattccattccacaggcaacccttgacggcagcgacgaaaccaacctcttcaagacatctccaactgagaagaacttcaactctggtgagggggaaaagagagcaagactgagtactacccactgtactcagcaagtcataccggaagagggggggtatgatgcagggtatatccaagggaggctaaaggttcttttgcataaagccggcatttcaaagcagtagttgaaagcagtaaaacagtagtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttagtcgccatgggcacgactagcaaaaccatgcacccacagcccaccatgtagtgtattttaattaaccaacaccattgcggtggcactaatccaaagctattgccaataatcaaagtctatgctttaatgtgatccccttttgtgcagggtacgaggtgtacatcatnnnaacacg

SEQ ID NO: 18423 - DNA, 780 bp, Oryza sativa
  unsure (1)..(780): unsure at all n locations
tgtggggccttggatttgcanatgnnnnnnnnnnnnnnnnnnnnnnnnnnnnnnnnnnnnnnnnnnnnnnntctcccccccccccnannnnntncggtgagttagtcaaaaaatttatatgggttctgtgatgtgcaatcctagttgcttactgtaagattttatcacgtcttgtgttgtgaggacttcaccttcttgtggtggcttgatgctcttgtgcatgtttctgtaaaagattgttaagtgcttgatgatgatatatgtatatgctccaggccgggtgcttcatcaggcatacttcttggtgccactactctgcctagtgtcatgctttcacggttaattcaactttatagggtcttactagcagatcctaatgcacgtgaaggtatccatttttctattttgtcaaatttatcagatccactgctaaatggaaatttccctaaatcttcatcaacatttcaaatcttgtttgacactaagatttcggggcgcatctggttactaactacattggggtcattgcagaatatgctaccttgaaatgcattacgggcagtatctggtaacttgcctgggaaggtataatttttggttgggatttaacggggcttccaacaagggaaatctattgcttcaaaaaccggttggtggtcatcattttttatcccctgaataattggtcccactttttatggaaacggttggagggcaagccttttttatttggtggaaacatatatttaccctttttttcaaaaatcggtggaagtcata

SEQ ID NO: 18424 - DNA, 1471 bp, Oryza sativa
  unsure (1)..(1471): unsure at all n locations
ttactaatcccgattaaaatatattattctgatgnatgtagctgctaccttattcaaccatttttccccttttgcagatagagtctatcatggatgactttattcnattggaaccccaatccaatttatttgaagcagagactatgatggaaggttagcattcttctagatggtctaattagaaatcttcagcccatatatcctactgtttctgacctataaagctgagcagcaaactgcgcgccaataaaagcagcacatcttatctttctttaatggagctattaagcaatgcattgtcatttgacagtgtagtcaggaacagtcattctgcatgaagtgatgactaatgaccctatcatttgatatgatgataacatctgctgcaatggttattttctaatactccaggcatgttatctttataggtacccttgatggattcacatttgattctgacgaggagggtgacaagcttcctgaaccgcatgcttctcaaaacgatcaaaataatgaagatggggatcaacctaaggcaaaaaccaaaagaaaagctgagaaaccggcagtatgttctctcctacccttttaatgatcctataagcttcttttcagtttcttttctattaccattatgccatctcagaatttaaaactgatgatggcacatgttagcactgttgcaggaactaagttaataaggaacgtacccaaaatcacatctggagcaccttgagcttctgcagcagcaacatgattgacacgggcctttgatgctggtgcggtagagttgctctgggcagggacaatcttcacgcgtcggggcttcggacacttgtcagcgtaatgtcctgggtctccatagttgaagcacaccccgggcttgatgccttgctccttcttggcaggttgttgctgtgtcgaagctgcaacagggcgtggagcttgattgcggatgttgttgcccgcgttgttgttgaagaactgacgctgcggacgaacaacagacgaagaacctccctgtggcatggactggggtcctaaagtaagacgcggcctctgactattcccctgttgtgccttgaagtgagcaatccggcgtttcttccgctccatgcgatttgtcacgccctgaagttcccctcccttgctctaaattcataaaataaatcgttcgaagaaattgtttaatttaacctagagatgaatccctaattaataaatgcaaataataatcggaatcggcatgtggaattttcttggattctacatgtcaaaatatgctaacaggatttttagtggaattttcagagccttggaaataattttaatcaattaaaataagcaaagtgcaatattaaatccctggaaaaatcctttttcctttttatcttttcttttccctccttttttnnnnnnnnnnnnnnnnnnnnnnnnnnnnnnnnnnnnnnnnnnnnnnnnnnttngccgc

SEQ ID NO: 18425 - DNA, 878 bp, Oryza sativa
  unsure (1)..(878): unsure at all n locations
cgcggnttttgttgttatataannnnnnnnnnnnnnnnnnnnnnnnnnnnnnnnnnnnnnnnnnctgttaaaatatcaaatatagctaaaattcaggtaatttggacataaatcagggataagtcactgcaaaataaaatgtcaaagacactaattaaaaggttccaacgatacaacctcagtcacaatcgacatattgattcaaaaaaaacattcctaatcataaacaaaactgtatagtttagaactcaatacagtgctatgactatcataaagttagttctgtcccatgattctacaagttactcagtatattggtcgcaggaatattagttaacaataattgacaaagctgtttagttcaatctcaattatttggcacctcaaaatataaactaggcacgctttgacattcccaataaaagcacggacagaaacattgtctggactctggagttcaaacatatgcttggacagaagtaagaatcaagaatgaaaaaacaaaaacttttcaaatataagtggagtaggaagtgacagttcatgacacaaatgcaagttacagctaactaacactattatcactttagaataatggcacaagcatatcataccactttagaaggcaaaatatgaatgtcaaaaacatgtaaaattgcccttaccttacgtattcatgaccccatgaaccgatatcaccttcagagcccaacaaacggtacttaaggctttcctgaaacaagtaataggcaaaaaaacattaggaaaagtactgaagtttcaaacaaagaaatatcttgttcagattagatacanaaagcttttattgtggcaggaacatactctttctncttcagcggacattgtcaaagctaacn

SEQ ID NO: 18426 - DNA, 757 bp, Oryza sativa
  unsure (1)..(757): unsure at all n locations
tggcacctttagaatctaatctcnnnnnnnnnnnnnnnnnnnnnnnnnnnnnnnnctagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatggagacgagccgaacgagccttcaatcaactccgatgcccggaagacctagaatgccttgtcaaaccgttgtcttagatcgttgtgttagtttgcttgttttaagtttggttgtgtgtttctcgcatgtgatttacatcagtggtgggatgtaagtgcatgcgtttgtttgttttcgagtgttaggtagttggtgagtttagtggtgtgagagtcttcagttttgtaataatgaaactcacttaagatcaataaaagttaaattaattctctgtcctaagtagttttccccggtttctcttcttgtgctcctgcccatgccagatggtgctcactcgcagcgacgggaatggccccaacatcaacaataacaacaacaatggagagaatcccacacttggccaagtcctggctcaacaggcacagcttatgaacatgatgatgcagcaacttcagaaccagcagaaccagg

SEQ ID NO: 18427 - DNA, 938 bp, Oryza sativa
  unsure (1)..(938): unsure at all n locations
cgtccccgagcacggctnttgttcggcatctcngacatggatggcacattctcggagcgtggaatctgtcctcgcgttccaagcagccgcagccgccggtggcgagcctccaggtgaaggggttctcggtggagagccacagcgacgaccggaggagaagggagttgnaggtgtacgcatcgcaggtcgtccacctgggcggcggcaagctgtgcgtcgccaagatgttcagtgttgatcgcagagaaaggggtaaaataaatttcgctatgctcactggcgtggaggtggtacgctgccgtggcggaaagctccgcatcgtcaagcacaagtcgcgccgttataacttcggcgaagactacacccctgattatctactctaactagtagagtactcctacttagtactgtcctaataaaaacccttatttgattaatcctactcttatgcaggatacatattcatcggttagttttaaaactctgcattgcatagctctgtaaactctgttagtagagatgaatgatttcaaggaagcaattctattgttaaggacctgaaaaaaaaacatttataacctgaaatacttatcatctgatcagatagcagtctaagtgccaaaaactaatactagtgacaacaaatggcagctgccataacagataagcctgaaagcaatatgtcagcttccttgatgatgcatatgtggccatgcggggtagctcgtctctctataattttcattcctttaacaggctgcataaatgcatgtagtattgacgatgagaaaaacacaatgcttaaatcatcattgggcaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18428 - DNA, 1217 bp, Oryza sativa
  unsure (1)..(1217): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagtgttaatcgcagagaaaggggtaaaataaatttcgctatgctcactggcgtgaaggtggtacgctgccgtggcggaaagctccgcatcgtcaagcacaagtcgtgccgttataacttcggcgaagactacacccctgattatctactctaactagtagagtactcctacttagtactgtcctaataaaaacccttatttgattaatcctactcttatgcaggatacatattcatcggttagttttaaaactctgcattgcatagctctgtaaactctgttagtagagatgaatgatttcaaggaagcaattctattgttaaggacctgaaaaaaaaacatttataacctgaaatacttatcatctgatcagatagcagtctaagtgccaaaaactaatactagtgacaacaaatggcagctgccataacagataagcctgaaagcaatatgtcagcttccttgatgatgcatatgtggccatgcgggttagctcgtctctctataattttcattcctttaacaggctgcataaatgcatgtagtattgacgatgagaaaaacacaatgcttaaatcatcattgggcaaaaannnnnnnnnnnnnnnnnnnnnnnnnnnnnnnnnnnnnnnnnnnnatcgaaatttacaaagggccag

SEQ ID NO: 18429 - DNA, 3521 bp, Oryza sativa
  unsure (1)..(3521): unsure at all n locations
atggcncttgganatttatataannnnnnnnnnnnnnnnnnnnnnnnnnnnnnnnnnnnnnnnnncttcgccaacaccagggtcaaccttgccaacgatatgtgagttagcttcttcctctctacggagatttctggtgatttttgtttaggcggaacagcgactacacgctgatgcggttgctggcacaggcggacgccatcaacttcatcttcttcaccaagatggacattggtgggttgttgtgctgccttcaattatgcagggttgggttggactctatgagggtttcgagggcgtgtgcatttgttgaccatggctgcgggtggtcctcacaccaacagcggccggtgactccatgaagtatcttgtctggatggacggtgagtgaatggctttcttttttaactttgtgactggccctaattgccacctatttctatacattcacctgttcatccagcgattccagaatgtggcagtggcagtgcggcttgccttgatttggtttgttgtgctccacgattatcagttcagaatgtcagataagtgaaggttggttggttaggtagcaggaagttccctgatcaatctgttatttgtcaaaatgtgacaagcatacttatctctttgttttgtaatgtggtgctatctagctgggatgtcggtagcggtcgttgaagtggctgcggcgacgattgcttcttccttggatgggagccaccgttcgccgaccttgctgccgccgacgcccgcatatccttccatgtctgtgtgccagaggtaaacggcagtttctttctgttcttccaccgtttgtgctgatgaatgttgtgcattccctccttgtttgagctcggccatggaggagtcaccggtatctctgggctggcggtgctagaacagtacacacggtcgtgttgccggtggagctggacggccttttcagggtgggttcctgcaggacagggcaaagacgatggttttgttgaggaatttctgtgacgttatgagccattatgttgatctgcttctgttttccttccaggatttgtgggatgcaagcagcagcagaaacagcgaccgagcacgtccgattccagctacgttcagcgtcatgtatgggaaggtggggatcagtgccgacacacacccccagttctacctccgattatttcttcagcgatagtcttaattaatagctcttgtgggcagtcattgacaggcatggtgtgtacttaactgcttattgaaatggtcaggtttactttccattcgtaccggttcatgcattgttctgctccaaatattttcctttattcgaggggattggcggatgttcgcacaggcatggggcgatccggtttcatctattttgttgccaggtactcgttgtagcgttagctaccgctactgctcgtgcctgctggcagtggccctgtttagatgggactaaaacttctaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctaagggtggtgcactactttgctatatagagagcggcaattactataaataatgctattcgttcatttatggataactattgagacaaaatcattgagtagcaagcaaaagtgcttaccgaaatataagacgaaaagaaaccgcgaaatggaacatcaaaaaatacatagaagacgattaatctatgcaaaattcatcctcgggctcaaagctgttaatctcaacatcatcgatagttaatagcccacaataaatctagaacaaaagtcagaaacattttaattttgaactaaaaatttatatccgatgaagacatcttaattttccatccatcttaaagtgtcacagtgtgcttacaattttactaatgatggtctgatggactaatggatgaaggacaacaggagtcccttcaagcagagatgtttaatggaaacttcctttcagttcttcaaactttgaaccctagcttatataaatctggataattgaaaaagtagaatcaagttacaaatcaaactaattggattaaaaagaagagtgaactagaagagaagagaggagtataaattgaaaatctgaaactaatcaagagaattagagagagataattagatcattagatgaatacctctcttcagtttgcctgtgcactgctcggttgccctactgttctgcgccctttgcctctgtagtcctagtccaggcgttcagctggcagctactgctgctttactaccggcggccggctagggcgaccagcggcaggacggcgactcgacgagcccgcgggccagcgatgcagactgcagcctgctggtgcgacggatgacgaagacgaacagacgacgcggtatcggtggactcgcggtgggggaaaagaaaaaaaaaaaaaaggagacgaggcgcggctgtgatactcgaggcgtcggcgcatcgctcctgggcgtggggggcgtctcctggcgttgcaaatgggccgttgcttgctcgctcatgggtcagggtggtgcacactcttgggctgagggggttcctatgaggtgaaaaggaaaaagtgcaccgaaggtccctcaacttgtcatcgacttacaaaatcgtcctccaaccgcaaaaccagatatccgacgtcccttaactaatcaaaaccggtcacaatagatctttcggtagttttgataccggttttgtcttatgtggcggcggagtcagcgtgggctgaccccacctgtcatgatgccacgggagccccctctcttttcccctctcctccctccctcctactgccctttctttctctcactcttgtttaggccagcccgtcgtcggctggtaggaggtcttggggactacgtggtggctcccctctctatatttttcattcctttaacaggctgcataaatgcatgtagtgttgtcgatgagaaaaacacattgctttaatccatcattggtcaaaaaaactgttaacatgctctccaccctctttacaaaaatcatattggtactacaatgaaaaatctcttttagtgaattattttttcttctctttattgattatgcaccttcaaacatttagtcactgttgttcatgcctttaacttgaaaaaagttatactgaaatgtgttggcatcaattcttgatcaatgtatcttttcttacagcccgtttgtcaggatctttaaaaaggtcttttctatataactttgggaactctattgatttaccaaggcttttgaaggggggttttct

SEQ ID NO: 18430 - DNA, 17009 bp, Oryza sativa
  unsure (1)..(17009): unsure at all n locations
gagtcacgtcgcgacatcaaaagaatatcctgtcgaattagacaagttcatatcaaagcatgtgatataaactgatcacgagatagtgacatgatgttgagtcctctcgtgacggcgacaacatggttacaagacgtcgtcttgtctcgttacgggatgaggtactgaagagactgaacatagcatcaagtcagaacgtgccatcgtatcatgttgcgacgtaacttaagaagacgcgcatcataacgcgtttcgtgtcacgtgtcacgttgtagtatctgacgtcaaacgaagtatggcacaagacatcattaggtaacagcgtgataggtcacatgaacaagacatacgtatggcatcggatatccgttacacatgtggcgcacgagttatatgtgtaagaatgagcgaaacacaaatggtatgagaaatacacgttacatatatcatgtggacatatatctgccacattgacgacagccaattgtaagtcacacccgtacacgaatcatgtatcgtatggcgcatgtcggacacattgggcctcaggctaggcccgacacataaacaacagggagtaaaaatagacatattatatgccatggtcgaaagaatagggacgtaaaatacgctcattttagctatatatatgtcaacccaaagaggagggacagaaaatagacttattttcactatatatatgccacagcccaaagaagagggactgaaaatagacttattttcgctatatatatttcacggcccaaagaggagggatggaatatagacttatataaaaaggcacgatggaccacccgcgccttcgggccggcccggcacggcccgacggctggtgggccgtgcctgggcgggaggcgtagcccatgggccggcacggcccggcacgaagtgccaatcaagccgtgccggcccgatgtctggtgggccgtgcctgggccgggccgtgccgggcgggccaaaaggccatctatacacgtggcatgctgacaggtggggcccacatgggtcccacgctgactcagctgtcacgtaggacaaaaccggtatcaaaaccaccgaatgatctattgtgaccagttttgattagttaagggacgtcggatatctgattttgcggttggaggacgattttgtaactcgatgacaagttaagggactttgagtgtactttttccaggtgaaaatgaggggtaactactaaaaggaataagtttataggaggtccctcaacttaacagcgagattttttaagatcctttaaccacaaaatcagaaatgtgtatccttaaacttacacaaaccgtacacataagttcctatggcagtatatatgggtgtttttgctgacttggcatcctagtcagcaaaataaattaaaaaagtacatggggcccacttgtcagctacacatattttttcttctcctcctctttttctctcttctttctttccttcttccgttcttcgggccggcggcgggccggatccgcgagcgcggcagtgggtgttagctgctaatcacccgatcgaacactttgtgcgcacactgcacacgtccggcacggcaacagacaaaaaaaaactgaagaacacaggaagaaattcagaacagagaagcagagtatttcagagtttcagagaatcacgagagagaaggaatttgtgggacaattttctgggttctttcattcaactgaattgaaaaacttacaaatggaaattttagctacggctacttatactctaataacagaaaaaacgaatccaagcctacaatcgcgccatcccacgatccggaactcctggatccaatgtcgtgcaaaactcacgcccacaacgcacgcctgacgcggtcgtctactcctgcagctcgccacatctctcgtgcatgcataacaaactcaaaactgaattattcatccagccgttgcaactgccatcgcctggatcaccttggggccatagctgaaataacagtcaacaaactcccccttaattctgctacggcccaaaatcacgaacacctagcaggtgtcgtgctgtcgccaatctcgctgctggcaacccttttgttaacgcatccgcccgctgctcctcagtccggacgaattcaatctgaatcttcccactttcaacacactcacgaataaaatgataccgggtatcgatgtgcttacttctcccatgaaacacagggttcttcatgagtgcaattgctgatttgttatcaacatacagcttcaccggcctggcttttgcaccaatcatctcaatcaacaatcccctcagccacaaagcgtgacacgctgctgcagtggctgccatgaactcagcctcacaggacgaaagtgccactgttttctgcttttgtgaactccatgagaccaaactgccgttgaagtaaaacgccatgccgctagtactccgacgatcatcactgtcgccggccagatcacaatctgtgaaaccagtaatctccactgcaccattgcctccagaaaacatgagtccacagttgattgtccccttgagatatctgagaatttgcttcaccgccttgaaatgcatcactgtcggtcgttccatgaatctgctcaccacgcctactgtgtaggacaaatccggccgagtatgcaacaagtaacgaagacaacctatcactcgcctgtactccgtgggatcaactgtgcttccttgagcatctttgtgcaactgtgaacgatgttcaataggaattgaggtagaattgcaatctagcatcctaaactgggtcagaatcttccttgcataagcaacctgcttgatggcgatcccgtcagtgccttgcaacacttcaattcccaagtaataggtgagcagtccaagatcactcatctcaaactcccccatcatctgttgtttgaatgcagtgatctcgcttgggctttctcctgtcacgatcagatcatcaacatatactccaacaattatcccggcactccctgtacctctagtgtagactgcttgttcttgtgcacaccggctgaaaccaagctccttcatgctccgatcaagctgtgtattccacgcccatggcgcctgtctcagcccgtagagagctttgctcagtttgtacacaagatgttcctttcccttctcaacaaaaccttctggctgagagacatatacttcttcctcaagatcaccattaaggaatgccgacttgacgtcaaggtgatgcacctgccaccttcgatcagctgcaactgcaagtatagctcgcaccatgtccaaccttgcaaccggcgcaaacacttcatcaaaatccacaccttgccgctggaagtaccccttcgccaccagccgcgccttgtgtttgatcacttcaccggcagtgtttttctttagcttgaacacccacttgagccctattgccttgtgaccggctggcagcatgcacagcgaccacgtcttgttcttctcaatagcctccagttccttgttcattgcgttcacccacgccggctcgccggctgcttcacgataggatgtcggctcctccatctttgcgagcagcgcttctgtgtcatcatcatcctccaccaggtccacccgaggtgcttcaatcatgatctccgccaagcttttgtaccacaccggcccgtcgtcactgtcggccgtgcgcggtgacgcctgcaccttggcagagtgcgttgaggatgagccgagtgtaggcgtgctaggcaaggttggtgagaacctcgccgggcttgccggaggtgttccccgctgttctgccacttctggctccttgccggctcgccttcctgccggcggcgcccggtaccacggtaccgagcctgcctgctctgccggcgccggctgctttgcgccgacgggttcttctacctcgaactcagtggaagtcacttctcctgcagcaacactccactgccaaggtgtgttttcatcaaaaacaacgtcacgacttacaatgatttgccgacgacgcggatcaaacagccgatgggccttgctcccttcttcaacgcccaggtacacgaccggattgctccggtcgtccagcttcttcaagtgcggtgcagtcaccttcgcgtgcgccgtacacccgaacacccgcaggggcccaggtgaggtttcttccccgtccatgcctcgaacggagtgcgatttcccatcgccttggtcggcagccgatttaggaggaatacggcgtgacgaactgcctcgccccacatcctgccgggcacggacatccccttgaggagagaccgcgccattgccatcaccatcctattgcgacgctccacgacgccattctgctgcggtgaatacggtgccgtcaggtggcgctcgatgccggctgcatcgcagacgcgcgcgaactcgccggacaagaactcgccgccgcggtctgtccggagtgtcttgatcgttcgtcctgccgtgttctccgccaacggcttgaacttctcgaaggccgcgagcgcttggtccttcgacttgatcacaaacacccacatccaacgagaaaaatcatcaacgataaacataaagtatcgattaccggcgaacgtcgatggagtgatcggcccacacagatccatgtggagcagctcgagcggcgcctctgctcgatagtttgccattcctgggaacggctgccggacttgtttcgccaccagacatgcttgacacagctggtttgggtggtggactgcgggcactcctgccgccatctccttgtccaccaatagcttcaatgcatggaaattcacgtgtccgagtcaggcatgccacagccacgccgggtcatcgagactagccaacaggcacaccggtgacgccagctgtagctcgatgcggtacagccgatttgaggatcgccgcaccttcatcaccaatcgccaaggatttttgtcgaacacctcgaggtcatctccatccatcacgacacggtggccagtttcagttagctgccccaaactcaccatgttgcagcggaggctggggatgtagtagacatcgtcaagcaaccactggtcaccgttcttgcatgagaaaaggatggatcccttccccattatctgcactgacgaggcgtcgccgaacctgacctgccccgtcacggtcttgtccagttcccggaatttccgacgatctcctgacatatgattgctggcaccattgtccaggtaccacagatcaccagcagctgctcccttctctgccagcatcaggcgaggccacacacgctcctcgtgcacgaccagcccgcagagcgcatgctggcgcggcgcgttctgcaccgcctctgtcacagcgagcaacaaagctgggccagcatcctccgtttgcgcaagatgagcttcaaccttcttcttcttgggatgtggacactgcgtggagtagtggccaaactcctcacagttgaaacattttatgtggctcttgtcgcggccaccgccgccaccaccagagccgccaccgctgctctgcgtcccgccgcgtccgcgacccctgccacgaccacgcccggcctggccgcggttcgccccctcaccagagggcttgttcttctatggtgacgaggtttctcccccgcctttcttgaagcgcgcctcccactcggcctgagtgaggagaacttgcctgtccgcggtcactccgccggtggtcgccttcttcttccgcatccgctcttcatacgccttgaggcgacctaccacttcttcgaacggcatggtgtcgacgtcgtaaaattgctcgatccctgcgacgaggctgatgaacttctccgggacagtgtcgaacagcttcttcaccatggcggcgtcattcaacgtcgcgccgagagcagagtaccggacccccatcgtggtgatccggccggcgtactggtccagcgtctccccggcctccatcaccatgttggtgaactctcccttgagtgtctgcaggcgcgcatcgcgcacccgatccgccccgacgaatctcgtcttgaggcaatcccaaacctcctttgccgagcatttctttgcaacctgcatcaagagatcctccggcagcgactggagaagatgagactttgccttcttgtccttcctcgggtcgacggccgccccggccgccggctcgattgcttcccatacgccttgatcctccatcatagcctgcacacgtattacccaactagtgtagttggttgacgtgagctgtgggtaaaggaaagcacttcctgagctcccccctcgccgggtctgccgtcgccggaaccaacgccatagtgccagatccgccctcaacctgagaagctctgataccacttgttagctgctaatcacccaatcgaacactttgtgcgcacactgcacacgtccggcacggcaacagacaaaaaaaaactgaagaacacaggaagaaattcagaacagagaagcagagtatttcagagtttcagagaatcacgagagagaaggaatttgtgggacaattttctgggttctttcattcaactgaattgataaacttacaaatggaaattttagctactgctacttatactctaataaaagaaaaaacgaatccaagcctacaatcgcgccatcccacgatccggaactcctggatacaatgccgtgcaaaactcacgcccacaacgcacgcctgacgcggtcgtctactcctgcagctcgccacatctctcgtgcatgcataacaaactcaaaactgaattattcatccagccgttgcaactgccatcacctggatcaccttggggccatagctgaaataacaatcaacagtgggcgagcgcggcagcagagcggcggcgggctgcggacggcgcgccaacctcctccgaccaccttcgaacgcatcggcgcgcgcggtgacgaaatcccccaaactggcaaggcagccattcctcgtggtcgcgaccgaggggcccaatcgcggcgaggggaatgggttggtggccggaatcgagctaggtacccgctgctaccgaggtggtgctcgtgcgcctcgcctccgccgtgcggaggtaccctctgggctgcgggagagctgccgccgcgtccaaacctagtaaagcgcaatcagcatcgcgcaacggcgaggcggagtcaatcggtggtgattagaaggtggaggtgaatgctggctcagtggctccaatgcatggttggatgaattgcaaaggagatgcaggtggtgcgcgggaggaagttggtgggcggccttgggacctgactgggctcacgttaccaccattcctgtcgtgggcgcagcatgggaggaggtcgcagcggcagaagttgctgtgaaacatgtgtgaagccttgtgcttacttttgctaaactgggtacatgagcttggtggatgatgatcagatcgacaatgaaagacttgtgcaaatttgatcattacagcggccggcgacgctggccttggccgtggcggggtcagccagccgacccaacccagctctattcgaagctatcggttaagtagtagttcgatgtcttcttgctaagcacggccgccgttcgacgcgggcaccatcctctctcctacaccgacatggtctggagcccgacgaacccatcggcgtacacacatgaagctccggggcatcgccatcaactaagaagcgcgcggtccacctccctcccgccgcagccagccgcgttggtgccgtcacgcgatgagcggcgagcggaggaaggggcagcaatggcggaggtccaccgttgcactcgcccgccatccgctccgcgccgcagcccgccgcacgctcgccagtcgtccgcagcctgccgccactctgctgccgcgctcgccgattccgcccaccaccggcccgaagaagggaagagagaagagagaaaagaggagaaggagaagaaaaaaaatatgtgtagctaacagatgggtcccacgtactttttttaattttttttgctgactaggataccatatcagtgaaaccacccatatatactgctataggaccttgtgtgcacagtttgtgtaagtttaagggtacacatttctggttttgtagttaagggaccttaaaaaatctcgctgttaagttgagggacctccggtgaacttattacctactaaaactgaaaattgggccgggtgcctatgaacccccctaggcccattgggctccgcccctgcctgctggtgtatgcatgtggtttatcgaattaaatttgaatatatattcttttttagtaatatgcatttatatacgttggagtcaaatatttgcgcaaatatactttccccgtggactggggaagcgggaacgagatggcaacgcagattggcagtgcgggaatgcggtcgcgcagaacgggtgtgcgggaccgactcggtcgcgtggaatggatgtgcgggaccgagtcggtcccgcggcgtggctgcgctgagtggtggtggtagcgggaccagtcagctggccaggcgatcgcgcggaccggaggtgtgggaccgagacggtcccgcagccccaatccgcggaaccgatagcgctcctgcgggcccgcctccccaattagtgccgctcgattgcgcagagtggaggcgcgggaccgagcggtcatgcagcgccagtctgcggcaccgtgatgccggtcccacacccttctcccgtaaactgaactccctcgttaacaattttaagtgcaactataaatttcaatgtctaacctagatggtttattttatttaattttcgttataagtagtatttttattattactagatgataaaacatgaatagtaaattatgtgtgattaataatttattttttaaaaaaataagacagacgatcaaaattaggtatggaaaacaatgcactgctactccgtgcctccattctgcgggatcgcaccgaaagtttttttgtccaccgaaagttatttgtcttctctatgtcacatgctcgccacaaacaaagagagagtgatgctagatttttttcgcgtgctgtccgccgaaagtttgttgtcgtctggttagagaggttacttgttgagtgcctataaaaggaacgttgcgaaacgaaagatgcggactcaagtatagcgtatcacttgtgtaagcttcagtaggttagtgcactttgcgaattcgcaggccctatcctgtggtatgaactgagtacgcgataatttatggtgcatattaggggcttaccataagataatgccatgaattcgcaaagtgttcaaacccactgaagtgtaaatatttgtaagtgttcgtgatggtaaggcaggtaagtatttcaaatttatttatttagaaatgtagctgagatattagaaagtttgaacacaaaaaattacaaattagttcgaatgagcccaatataaaatcgttctattcctaagcctcatcatcgaaatttcgggacgtgccagtttcctttttctttccctttcttctagcaccagttggaggtctgcgccctgacaaagataatctttcaggtgaatatcgctcgcggacagacctacggacgacttcaacaccgcggagatcaacatcgtcgtagtcttgggctggctgagttattggtggtggttcatcatgttgcaatggtcctatgtcgtgttgtgctgttgacgagcccccaccgtagctacatggttctccgtatgactgtatgctgccggcatatcccatcatttgttcagggttgtacattcctacaaaacattgaatgcaaagttgtagcgtgcacacatactgaaaataaattattttctagtaaattataagttgtacctgttgtttgtggttgcatgataggtggttgattgaacaaccaatctccatggcctaacatttcgagaaagcttggtccttgtggttgtgtgttttcattcatggacatttgatacatccccctgcaggtggagagctaaattaatatcacaatataaagatagtgaaaaaatgaaacacattatttacgaaccaatgttgaatgttggagctccttggcactaatcattcatacccgttgaaaacatgggcatgttaacttgaggtacacctgcgaaaataagaaaatatgtgcgtggctcagtaaattacaaaatgatgaacattaaaatgtgtgtttattgaactaccggaaaacgatacttggaactgagagcttccagcttctgtatgcatggggggaaccatttggctggatcctgtgaaccacgcaaaccctccctgccattgaccagtggtatttgcatggggaatagaagggatcacagctgtactacctgcaataatctctgtaggtgaacattgaattcaaaaatatcaccaattttgttaacaaaacaaaacgcagaaccatcacataattttagtaaattcgaaaaatgagtccatataaatagtgtgtctagtactttgaagtccatagattaaattagcattgggtacagcaattaattctataagttaggccacttgtacttgttgatgcgaaaaacacacagtggcctggaagatctgcttaactttagtgcaggtccaaaaatctttcctttaggttcgtgagcgtgccagttgatttgatcctgcaatcaacaagaaataaatacaaagaaaccgcgattaaatccataaatgatagccgatcggccagtcgccgatgacatatcatttatctctgagccgatgtcatatttgaatcgatcggcagtcataaataaacaagaaagaactaaatctactcgatcggctgtagatattaacggtatataatacttctgtcgatatatacttaaatcaagtgattgggatagatcggtcgccatgccgagacagtataaatcacttagatcgaaatatacattaacaaggagattataagcattcatagcatagccgataagatagatctagcatgtatcggctaatactccgataccactctatattaagatattaaggcaagcaaaatataccaaacaagaagcttaatatacctaaatgtgatgagatcttaacataagatttaacatatcaatcaagcatatgggatataaagtagttaaatcaggtaagattggctgaaaccctgatgaaaccctaatcggcagccaaaagcaggctagagattgagattctaatcacgacttatatggtcaaactcaactgatgcagctataagtatgaaaagaataacaatatctagacaatcatgccgttggatatttcatagggtggtggataccctatataatctaagtcaacgttgatatttaacttaatcggctgccctccagtgatagacgttagccgactgagggttaaatagcaatattgccagagattatataggatatatgataaatcgacaacttgcataaacaagattagaatgtcataaagatgtaagcactaatcccgagaacgcaagccgccatgacaagtttacctctagttgaagatcgaaacgatgcagctcaactcgaaagtaagaaatcgtcgagatgaaacgaaagtaaaaagggtggcgatgcgccgagattgtatagaacgtgtgttatttgattacatgggttcgggtcatatttatacccgagatacaagatatgtccttgtcggacatgactcttatctctaataaactctaagataccataagtctttacggcagacttttgcccaaacttatctctaaggaaattacataaaatatcctaattaatagatacaattgccatttttaggactcaatccatgtgtggcaatccatatgaagcacattagctcaacccgacgatgtgtatcgagtcacattgtcgaaatcggctcaatcggctaccttgtccgactcaaactctactgacctggtcgcagccgattcggacttcagccgattcttgctctatttccggaacgatctatctcttggattccgcttcgattttatcttaatctccgatactttgaattaccaaatttgatcattaacacatgacccccaagtccggaatatttggtaatgtttcggatttgccatatctgatccccaagaaaatcacatattgccgtttttccgaccgttatcgctccgctttaaatactaaccgtcacccccgagaaacttcacaccgttacttccgttttcaccgccgaagcgattctatcttctctctctccggcgatcccctcggcgaagaaaggcgatctccacagcgattctagctccggcaaacttccgctcgcaacgatgtcgtcctccgctggtccatccgccgctccatcggctgagtacgctgaggtaaattgtaagattttcctttggctagcattcagagacaggctaaacaccaaagccaatatggtcagcaaaaaatggaatgaagatccccactgctccctttgcctgacactagaatcagctgatcacatactcctaagatgcaaaaatgccaataatctatgggaaaaactaaacttattgcagctagacaacaactcagaatcaagcacggctttccttcaagcaatcatagacagcaatcggtcttcaaaaggaatagaaccaatttggttcgctgcttgcacctacacgctatggaaatcccgcaacaacagagtgtttgaaggtcagtttgacaacctacagcacatcacacagcaagtctcagacacccttgatctttggagcatgagaaccaatgaatcaaacatgcagaaaattcaatcctggtgtaccaggctctcctagtataagaacccttgtttatatctttgtaaatcccaccccccgttctcttttctttttatttttgtttcttctcttcttccttttcgtttttttcctttctgttctaggttaactataacctctaacttgtaacctgaaaacctcatttctattaatgaaatgatctattaatgaaatgattataaggtggagcgcgctctaccttcttccgtaaaaaaaaatcgccgtccttctcatcgcatcgtatgccgaaccaactaacgcatcccacggcaacaagcaaacagtataaatccaactattcctatccgacgtttttgctgcctcaaactttactcaggctgtgttcggtacccttagttaccaacatctctctctcgtgttccgcgcgcatgcttttcaaactgttaaacggtgtgttttttttcaaaaagtttctatacgaaagttgtttgaaaaaaatcatattaatcttgtcagggttatggataccatatatctaataatagttgactaaatctcgacaggacccgtcacataccatgtcttatacggaatctgacctcggatatggatgaagttccggataagaaaagacaaccagagttctacatggaaacgacaaggactactcggattgtattcatattggtttccttagttctacttggacaaggtgacacctatgagtataaatacaagaccccctaggaggagaggggatatagagacaatcaacatacacggacaacatagacgccataaaaccacaagcctacatacgccaagacaagccgccggatatcgacttcagcgataagcacggctagtcccctacggtgtcttcggatactgtcaggagagacgaaagcgctatctctgatctcgccgggcacggattcgaggagaaaggctactctgttgtcgactacgagtcagatcttcagaccgccatgtcgacaacagttagataggctactccaaacattgtactggtgtggttatgatgaataagatcaataaccggctttggccaacaggatgtagggctattacttgtcagataaggggcccgaacttgtataaaaatccccgtctccatctcttttatctcagtctcgcgtatatcctagtaccaacgatccccgtaccatgcaaataccggaatcgcgacatcaaacgtcgacaatggcgcgctaggtagggggagtttggtacttcaaggtttcgacgagatgggttcaaaagatggattctctgacaacaagctattcgacgacttcgctgtgggaagatccaacccgaccgaagtatgtctcccgacgagatcggaaccatcgtcatcaacaactcgatctctcgagatcgaccaaacctcaagatacgcggcgtaccaaaagacgtcagatcatatgatgtcaaacaagtacgcggtaagagtaattggtagattggttttttaaattaatctactaatttcgtagatacatccggcatgtatctacaaaggtacgcaatattttatatgcaatttatcatacctattcagatcatacagaattgtcagatctataatttattatgtttacctagagcatgtcttttatacaatatctattgcacgagtatttccgacgttaaaccgactacggtctaacgctgggggcttgctctgttctcttctgtatgaatcatgcttgtttacggtttacgtaatgcctgatatttacatctgctcgtagcatcctgataatactagaagatccatgtagttctttgagtacctactcgatattctctgctatatatcttgccttctagaaagtatttttcaggaacaattgagcacttgagtaggatgtggtcgagtacactgcattatcaagaacgttcttgacaaatgcagagtcgtcgcgcccaaccaaccaacgaagaccgacgacctatctcatacaccggccatggctggactactcgagaaaaggttgttaacggataattgctcacgaacaatgtcggcttgatcacccgacatgatcgcggacagacatccggatatgctacgagttgggtatgtaagtcatgctggccacatgagatacacatgtaataaaccaactctagcgcctccattggtgttcgagagataattctactcgctggttctcgaatcagtaaaatcgtagcaatctctcacaccgcgacttccattggtgttcgagagataattctactcgctcgctggttcttgaaccagtagactgtagcaatctctcacaccgcaacttccattggtgctcgagagataattctactcgctgattctctaaccagtacagcaccgcaagtatgtactatgtttagagttacatgagtggagataagacaatgacaggtttcactgtgtggcaagttggcaataaccatgcttgttgttttactgtatttttttcctcccataataaagtaaagtaggattcctgttcaccgacccggcaaaaaaataattactgctacatgagtcatgagtggaaacaatgacagatttctactagcacaggcagtcagagactgtaagcatgcgcagattggtaatggccaaaattccatcaaccctttgtttcagctcaagatgacaaaactaatttgaagcaaacattcctgattccatgtagcaaacattcccttgtgaatcgaatcgatgatcctcttgataggacataaagatttactggagcttgctgaaaaaccctactgcttgtactgaagtgcaagctactgcttccaataaaatgacagattggagatttacccactatactactctgttgataattttgacagatcaccggcatagcatttacccaaaacaagtacaatgcagaaggggggggggatcggttgtattataatacaactggaaatatataacaagggcaaaaatattgtgctcccaagtttatcgtgtgaatatttatctgaaaaatttctagctactaactagatacaagaggtttcatagttgtgagcattatacaatacggaatacaaattccaagcacacctccggggggacaaaagtagtctatacattctgtcgaaaccgtaatccaggagtactagatatacttacacgagtagttatgtagtaacagcaagcgacagtaaagtaataaccccacccctcactgcagaggactggatatgagaagtaatgtactagtaacagcaagctacagtactagcccaaccctcactcaacgagatcatctgaagcgtttgagagaaatgtactccagagaaaacatatgaattgtgagcagcagaaaaactattaccagacagttaagactgagtttgtcacattcgtcgattaccagaaatgggtgtttcacttgccaccaggagatatgaccggttcacttggtgaaaagctcatctagacgcaagcagaaaagggcaagcagtccttcgtcccacattgctctcattaagccaggaagcgacatgggtagatattggtaaagcagcatgtcaacatcatttgcagaataccatttgaatcgttcagtcctttttgtgagatgatgaatcttgtggcatgagtagttccgacggtatctgcactgctcagagtttctgtctccataggatgtaaactgactgtggagcatccaccaaaggtacgggtgttgctctagacgtaccttccagtgaccacttgaatcattcatcccatagggtagcatcttgaacacttcgaacacagattgaagtgatgccctcatcaatgtttcatagcatgccatgaaaaactgtgagtgcagtttcagtgcaagcaaagcagggtggtttctcatcagataagcctcctcaaggatgggattttctaacatctgcagtaagtcctgaaaatcctcaattaagatatcccacgaacttggtgttcccagcgatgcattaactatctccttgaaaatctgtcctgtttgaatataaatcattctcattccttcacatgaggcattccttgtgccgcaaactaggggatctctaaagtcgactgcaggcagcgagcatcgaatatacattntcaaancccattgnggnngnngnnngggatgatatagagagcggttgaggaggacgnnagaaggaggtagatgtagaaagagaagatctcgcatanaacaaggagcagagcgaatga

SEQ ID NO: 18431 - DNA, 1345 bp, Oryza sativa
  unsure (1)..(1345): unsure at all n locations
cgccggcgtttaaaaatgcaagaaagcagggatccccaaagcagaagcaccacgctaaatgctctagcagtggtatttctcacaaactcatcaatgttatcaatatcgggtctcatggcggcaatcatggtagcaagaccagcagctttgctaagatttgagataatctcccggccctcaacacgagcatagtagtcctcatcaatcagaagtggctcaatgaccacaagaatcttatgcacaaacggacggactagctcatccagcttatacagtaccctgtcaatgaccttcaccagaagatgccgctcctggtcctcaagtgttggctgcatgagcaagggtagaatcttgttgaacaatgggccagcaccaaattcccttgctttgtctgtcagttgtcgaagtgctgtcttccgctgtgggggtgtgccattcttcaccttgagcaggagcttcatgatcttcctctccttctgctcttctggagatagctgctcctcctcctcctcattcagcaatgttccaaagtactggtaatcctctggcttcatgaggggcaacccaccaggcaactccttgggcacatcaaactgctgcccacgattctcctcaggaatagcatacaatggtgtgcccaatggtgttggtgtagcgagcagctttcttgctggtgtgcgtatgggttggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccattcctccaagagttggtgtctcattccaacgattccttctcaccgacggtgtcgcattcccgacacgaccaggggtggcattccagcgcccaatcccaggagttgcatcaggagcattcaatcggaggaagttttccctttcttgattcagcagcagcagaagcatcacattcttggacttgatccatctattgcngggcttccgcgcttgcaatggcttgttgttgggcaccggcttttttt

SEQ ID NO: 18432 - DNA, 2139 bp, Oryza sativa
  unsure (1)..(2139): unsure at all n locations
ttgggnntttgaaatctattctcgatgcctgtcggtcgactctagaggatcccctggacgatgcgagaatgggggaggaagagtaaaaattcgtgacacgttgtcacgttcatgtcaatctggcacgttacgaatagagtctcgggtccacgttacacgtttgatacatgggacccaccaaggaataataattaactaatttaccaaagtaactaagaatttaccacggggtccacatgtcatagacatgtaatgacccacatgtcatagatagccaaatcttcaaagtggcaaaaaaattaaatacccaaaacccccctccgttaaacccgaagaaaaaaaaccgcaccaccagcgtggcgccgatcggagccaccggataaatgtggaaggtcgccgccgacgcggcagaggggtggggcggctggatctgcgcgtcaatcctgctgccgaagacggcgtccgtcgtcgccaacctcgtgcgtcatcttcgaggtccaaagtcggcgacgccgccgacactcgcggcacctagaatgctcaacctcgttgtcgacgcggtgacggcgcagttggcttcgcgctccgccgacggcgtgccccactctcaccgcgaggccagtttcccctcctcctcagctgtcgtggaggacgtcgcctaaaaccctcaccttcaacgcgttggcggtgtggcgtcactggctgtcgacggaaaccctcgcctccgatgccgtagaggtggaggatcgagcgccactaacaaatccatggattccaccaacgaaggcaatggcctctatcgcggcgcctcctctgccagcgtcgcggactacacccgcaggcccggctaaggggcctcgggctgctacttggtcggcatcgacaactttctcacgtggctactcgacaaatcaattcatgaaggtccaccaacgatgacaagagtcacaagatagattctcaagtcctttttaggccctgtttagttcacaccaaacttcccccaaactccaaactttccatcacatcacatcacattacatccaaaactttcctactcacataaactcctaacttttttttttccaaactaccaaacttctccccaaacttcggaactaaacacagccttagtcaaatactagtacaatcttaggcctagctccattaggcaatttatcttatgttttcggtggcatgtcaaacaagcggagcgattagcaaatgactaatcgagtgttaattactattcctatcaatttaagaattaaattcatttaactatttgataaagatatttttatatagaaaatttttagacgaaatacactatttaatagtatggaaagcgtgatcacattaaacgagtgatttcttttagccaaaactccgttaagaactcaatgttgggctagattcgaaagtgagtttggattggaccactttttcattaaggcgttaaccatgagcacgtttacaaactatttaaacaatgtgtttttaagtacaagtttctaaaaaaaaatcaaacacatttttaagttctaaatcttaattaattgtgtgttaatgactacttttgttttgttttacgtgaattggaaatctcaatcaaatagtagtagagcacttcagaacttagcctaatattttttttggagtgcttcctatttttgaagtttaattttatacgagagatttaacagcccacctcgcaaaccccaaacccccccccccnccnccccccttacagaataccaaaaaaaaaaaaaaaacgatcaccccacaaaccccccgttccattttaagaatccccaaaccaaaatcatcagttcatcacccccaaatgctaaaggccgccaggttgcctagggttttccccgcccgggtttcggcgccggggggggtttttttcatcgtcgcccctgttcaggttatcgccgttataccactttagttttccccgtgggttgtttccgcgctaatacgttttattttacaggagttttttcggccttggttagggtggtcgttttcgtcctcgggggttcgtgcgctccttcttaatttgatttttcacttagggggcccatttcccttcttggagcgtttctcccttacttccgctggatcgtttcc

SEQ ID NO: 18433 - DNA, 1920 bp, Oryza sativa
cgggaagaggaagaagaactttagagaaggagttaggggtaaacataatattgtagagcgagaacgagtaaagagacggattacttggaagtcaaaaaggagtagaaggcgacatgtgattggtaaacggaggcaacgaataggagataaagaaagaaagaaggataaaagcagaaaacgggaagggagagaacgtcgaataggcagagaagaatcgtcacccaccagcgcaaggcgattcgtcgagaagaggcaaaacaggaacgccataagaaaaagaaaaacaccgcctcgactcgacgtccttcttcggatcttgctcgcccgccgcgccttcatcctccgcgaccagctcgtcgctgccctcgtcaggagctcgcctatgaagttctcgtggagctcgccgggccagacggggtgtggcctgagcttgcagcacatctcccatcagatatacttacacgcttgtggggacgctgacgacgccgaagcggtacgagcgtcgcaacatcgtgcatctcgatagcgtacgcgctgcagccggcgatgcccgcgcatgtggacgtccgcttcgtgttctgctccgtgacggatgtttgacgatattttgtcattttacgttaagcaaacaagattactatttataaaagaagctagctcgctggtttttatgagatgcatgggccatgcaaactctcgctggcggcggcgctggacgcaatggtgggacgaggtgggggaggtggctggggctcgtgacggctgtgtgggtgcagtgcatctacggcaagaactacaccatcttcaactaatcccactccatcaagacgctcatgggcctcacccaacagctgctcaaaacagcctctccgtcgccaaggaagcgtcgggccgtcgctgaggccggccagctctgcgccctccccgacaccgtcgcccagttcttccgccaccgccgccttccagtttcttccccgttggccgccggccgcgccaagctccttccccgccgccgccgtcagttctttcccgtaagccgccggccacgccaagcgtcgtcgccgcgtcacgttctcgtcagcctccgcgcccaacggccgtggcacccgcccgcgcgggaccgctttttcgccggcggtgacgcagcgttaccgacgccattcgcgaccgggcttcgcctagccccgacgggcttcttcccagccgccgacgggcttgccaaaagaagagtgagagagagataggaggaagggtgaagatatagttggccatgtgggccgcccggcacggcacggcccatgcccggccgggcctgttgtttatgcttgtcgggccggcaaggtccgacggacgcatcgggccgtgccgtgccagcccacttgccgcgctcacggcccaagcacggcccaacacgcctcgggccgggccgggccggccccaatgcacgatgggtccccgtgctttttctcaaaaaaaggctaaatgtgctccctcctattgggctgataacatattgtcagctaccaaaagtgtattttacctccctcttctttgggctggggtatataaatagctaaaatacgtctatttaaggcccctattctttacacagttacatttatatgactattttcagcccctatactttatgtaccgggccttgcctgccggcccattttggcgggcctgacccaccggtccgtgccagtcctaatatgcctgggggtaaggcctggctctgttctacatatcggcatgtcaccacgattactctccattcggccattttttatatgtgacccacttttatctgtgtatgtggatgaccttcctgatatgtttctttagctatgtctctcatctctctactaacagttcttttttcttttgtcctatgcactattgccctcttcctccccc

SEQ ID NO: 18434 - DNA, 11903 bp, Oryza sativa
  unsure (1)..(11903): unsure at all n locations
aataaaatttgttaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgaagcacctaatttaacagagaataatacgaggcattaagcaagtgtccttgaaaaaaacacacggtcacagctacaggcacagtagatcagtgaatttcaccatcaattgactttctgttttgtgttacagcaaatacgcgatcatagaattaagatgtaatgctgataatatgttttttgagataataaacattccaagttacctcaactgccgcaggaggaatcctgaaaagttttctccgaggttgggctttcttattggatttgacatctgatcgaccctctacggaattagtcccaacaccagttgaaccagttcttcttttctttctcttgttaagaccccaatcttcatcttcactctgttcgtcattgccaataggctctccaaacatttgctgtgaatggagagaagtggtcataatagcgttgatccatcttagtgatgaaaaggaacttactaatacagtattcacagttaataacagacacatctatttaaactccgctattcatagaatacaatttcctgttgataaagcacacctcattaagttgtgtatagtcaacatctcttcttggcctttggtgggtaagaatctcagccaaaccatcttcaccaaaatcgattcctagatttgaactttcacgacagaatccttcagcatcattgaaatctgctgatatgaagtctggaatatcatcatttggagaataaagtggactccctgaacaattggaatcggcagatttattctcttcaccactgctgctggcctcattttcttcagggtcatagtcctcatcacctgaatactcagatagccaatcttggcccagtccatcatcagagttgaaatgttcagctgcttccttgaaaatatcctatagaaagcaagcagaatcaaggcttattcaacacaattaaaccacttgagtaaaaggtgatcaaaacatgaacgtaaagaactaaaaggtgatcaaaacttgaacgtaaagaacaaaaaaacttacactggagggacacttcactgtaaaacttgtccccagatgggcattaatggcgtctaaaattttcatcttggaagaacagtgtttgcaaagccgcccatggcgggtagttggaagaactgagagataccacaaaacaaagttagatacatcacaaactgtaaagtagccattgcagcaacatatcaggtggagcaactgcagcaggtgacatggatgcataatcatcagaatagaaggtacactatgatgtttggtacagcacaccacattacattattctgaagcaataacttaaaacatacattattttataggaactcatgccatactttcatttctttaaaaaggcatataaatgtttattcatgctaaagaatcatcacatgctaaaaagtagaagacaagttatgcatggagtgacagcagagtctagactctacacactagagatgtcctacatttattttgaagtgttggaccacaacataacatagtagagtgctaagttcagtttatttttgaggaaattggaaagttcagattatggttgagttcgtacactgcactggtcactacataaagtagaaatatatattaaaaaattgacactaaacaaaactacattcatttaccaaaaaggtggaacctcatattttgaaagaagttaagagaaatgattacccacttttatcaaaaggaggctccaaacatttctgatgacacgccagtttgcagcccccctcacagaatataatgttattgtcaggaaatgactcgtgggatttgcaccttgaacatattgtctagaaaagagaacattgtatcaatatataatcctatggaagtagggagtttgatattcacttgatgacatacatacatgttcaggattgacagactcgtgacacccatctggtggaatcacagagtcatccttgctcccactggaactacacaaatcaagttggtgaatgacgtcacggatagcgattttgtatttcatgatctgtttcttagcacgctgtagctccttctctggctttattttctctcgactgttaggaaaggcacaccctttagtaagtatagtataaatagcatactgttacttcattctatgcaacatcaggatatatatatatatatatatagagagagagaattagatataaaacaacacaagtgaagcttactgagagcatcagtatagaccgttatagaacagttctttgatagctaattgacaactgacagtaacaaattaacaattagaaggcaaactagatgtgtatatcatgattgagaggtcctccacagtaaagcacttctatcccaagacactacttcaactacgcaagtcaaaatgattacttccaacagatacatataccagtattatttctgacccatgaggagttggtcacagccaatgagctagggatggattctgatcctcctattattaagatgctattggtggttaaaacataagttctcatctggtttgcatacagtaaatgtgaatgattttctcttcatgagtagttctaaacctcattctaagcccttgctcattattgccctaaacaaaatggaactttgttactgagaaggtttaatctggtttgcttttgagttttccgtcaaaaactacaatcatgcaagcatgaattaaataatttcaggtttctttttccccttttggcatgtaagattagttggatttgaatatttctatagtcaaaactcagaagcttacaacagtaagagagaagcagtgcatacctgtgcccattccaaccatctccagagtatgcatctagcaaattctgctcctgttttattttgataagtaaatatcttgctcttttttccatgcgactgacctcatcactctcatcatttttccttttctgtttatgcttcctccttgttggccctgttgcagactttccggtagccgcatctgaaccccgccgccgcttcagaggactgctatggtgtttgttctctatacatttcgccaggttagcgctacttcttgttgttcgtttgggaggagaatccggcttgcgtggagtattctggcgggttgctctttttgatacagagatcaattccgaagaggattctgtcctctgttgcagtgctcttctagaagtatagcacagtggtttcttttctggggtattcattgctggtgatggatagtattacaacaggttgagacctaccataaagaacacattacagtattaatctgagagctgaatggacatgatgataacaagtacagtaagcagcattacatagtacgtagcagacaagaaaatgtactagccgctgcatgtaaaaaaagacagatgcttgtaatctaaacaaagtagtagtacatctattggctgcctgccctaaccagcagggcaaataccgaaaagcatagaacaaataatgagaaattctagatctctaaccagagcagcaaattccagcacacacattacacacccgaagatctcaccgagcacagacctagcgcggagcattggggctcagttgaaaccccctctcccaaaaatgtcgcggaaatgaactgcgcaccccaaccttggatgctaaatcctacacgaaggattcaaccactaactagcacactaaacagcaaatgaatccctcactaaaccaaccgaatcgagaggaagacgcagcaatcttcggtctcccactacccaagccacagcggagttaaaacaaacgaacgaacacacgatccacccccatccaagcaaccgaccgaagctagggtttgccgcttaccgagcaggaggaggaaacggaaccccgggcccgggcggatctcccgcctcccccaacggcagcccagcaccagcaccagcagagtgcgggggaggggaggggacgcaccgcgccgcctctcgccgccgccgcggggaagggtaggaggagagggggagaggaggcggcggcgaatttgggggggagaagaggagaggagaggagaggagagaagggaagggaagcgaaggggaggggagttgagttgggggaaaccttggaattcccttgtgttgcggctgcatttacacagtggtcgactactagggaggaggactgacttgcttcgctgctgcagtgggaaagcccgaccgaggccaggaaacgcggacgccgctcttcttttttttttgttttttttttcactctctctcgtctctccctctctatatttctgaagggtatttatttataatttgattttactttccaaaacagtactccctctatccttaaatataatggatggacagcttcctgtccagattcgttggactagaatatgttacatccaagcaaaataccttatatttagagacagagggagtatatcgtctatgaagggaccatttctttcattattattcagaaatatatgtagggggttcgtaagatgtgcacactcacctctacgaagactaggctgatatattttgagattgatgaagtcaccacgggtacttcgttgttcacagatatgttgtttatcgccgaaagaataattagtcgtaaatgcgagcaaaatgctaagttttgaactaatccggatgagtaggtttcagcgcaagaaatcaattagacccactttactattttattttattttgccaaccgtgtttatgttgactatacctgaataccgttgttaatgagctaaatggatatttggtgttcaaaaatgccaatatataatttaaatttattcaattattccaaaaataatttacaaagtgactattttaatttttttccctgcaacgtctattttacttttaaaaatgggattttttaagtgaagcccgatccaggaaaagcggacgccgctttttttttccctctttatccctatttccaaaataaaaaatgtcgatttataaaaatattatggagtgaccaattgaccatcttccatttttgttttttatgttgactaccccgatctacttctgggtctccagcaatcatgtttgagagtctgagacaaaacaatgagccttaaccgtaaggctgtgtttagatccaaatgctgtgtttagatccaaagtttggatccaaacttcagtccttttctatcacatcaacctgtcatacacatacaacttttcaatcacatcatctccaatttcaaccaaaatccaaactttgcgctgaactaaacacagccaaagtttggatccaaacttcagtccttttccatcacatcaacgtgtcatacatacacaacttttcagtcgcatcatctccaacttcaaccaaaatccaaactttgcgctaaactaaacacagcctaagattggatgcaacttcttgccaaaacagaacagcaaaatgtataatactagtacggagtaacaacagtggtcagaatgttcttgctgccagtgagcttcaatttgcacatgtgaaatagctcgaatcactttaaagatgaatggcaagtgtttgatatccagactttttcaaatttggctatttgatagttatacaacatacaaatgaggatagacagagagttcatagacataaaaatggattttgcaatcatgtgtatcccttctaatttcattctacgcctaaaagaagtacattatgctacactgataacccagatcatacaacatttggaatttctcaagtctgatccatttggagttggattctctagtctttactggtagcgtcccggtttcgcaacaggtctatttcttcgccttctttgttctcttcgtagtttgggttttccttgtacccttcttagtggcctttcctgcaaccttcgccttcttctgtcccttcccctacatttcacaagaataagcaaactttgtcatgaggaactataatatgtcgcaaagtttatagcatggttccttaatttcatgatacaaaacaggcaaagtgcttcagtacataagtaaaacctccggaaaagctatccacaattgggtttcaaacttatatagggtaatgtaatgcgctttcaggagttcaagaatcaggtattcatacagtttgtactaacatgtgccatcatcagttttaaattctgagatggcataatggtaatagaaaagaaactgaaaagaagcttataggatcattaaaagggtaggagagaacatactgccggtttctcagcttttcttttggtttttgccttaggttgatccccatcttcattattttgatcgttttgagaagcatgcggttcaggaagcttgtcaccctcctcgtcagaatcaaatgtgaatccatcaagggtacctataaagataacatgcctggagtattagaaaataaccattgcagcagatgttatcatcatatcaaatgatagggtcattagtcatcacttcatgcagaatgactgttcctgactacactgtcaaatgacaatgcattgcttaatagctccattaaagaaagataagatgtgctgcttttattggcgcgcagtttgctgctcagctttataggtcagaaacagtaggatatatgggctgaagatttctaattagaccatctagaagaatgctaaccttccatcatagtctctgcttcaaataaattggattggggttccaattgaataaagtcatccatgatagactctatctgcaaaaggggaaaaatggttgaataaggtaagcagctacatccatcagaataatatattttaatcggatttagtagcaaaaatagcacgctacatactagaaagtagaactgcctaaactaaaaattatggagaagtcaaatactcataagagatttatgttatcatcgacaaccttcgcttctgtttgtcctacactgacctgagaaaaagagacagtccatcaaggatttaagatcaatactaacaaataaggcaaatgcacaactgtactttaagtttgaatgtaacttacaacgcaaaatgtcctggatggaacaattgttgatttgtatattgttcctgtgtaagtatataagtaaaaataataataatatgggtaaagtattttgaatagtgcatgtagtaagataacacggacattaatttcaaatcccttgttggtaaaaataccctgcctagtcagaaaccaaagtgcataatacataaatgatactaaagaaatcgacttgctggtaccttttaggtccaataacaattcctgatttccgttaggactgtttgaaattattatcctcccaacagctccaacgtctccacttaagtctatcgagtcaccatcgcattcaatcaatgcctagaaataaacagaacaaggattataggattataatttataaacttagggaaactatcattgattgggtcagtcatgattcccagtcttccaggtagatgatacttgcagaggtcaagatgttgattttactgcattttagcacatataacacattttggtggattatcaaggatctatggctctttaatatatatagcctatactccttctaactcctggtgcactaaaaagggccccaaccatttctcatttatggctctgtcactgcggtatttctattaattgtacaatttctttccaccaatgttaagttgaccgatatttttccatgaagaaaatatgggaaagggggggggtgatagcagagttgctcattgcattccggacttatgatttgacacactgacccttttatgagaacaatggtttctaattgataatgccagttagaattatcatacctttgaacgctgaattttatcaggaatgattaatggcaacctctgggagacctggaacgcataagagcttacagtccataagatatctcagacatattgacgtaactagttaaaggaataacaagacacgccatcatgctctacaaaaattacggtaatcaaggaaagaactaatcggttggagcttgataaatatttacaaaatgatgtttattttcatattttcctataccttcttaaaaggatttacccaactttcattagttcaatataatgcaataacaaaaatgacacatgttgggatattcccagtaagatgtgggctctaattttgttttctttgctccttgtttgggtcaatgctctcaatgttctggaaccgtagtgtggaggaaaaaatagattaaaaatagaaggaagttgaggcatcttacagagtgctctgtaagtttatcctgcatttcttcttcagcaactccctcttcttgatgttccaaggtatctatgcatgaccatgactataattatcaatcattgaaactaagaattcataaactgacttttcactaaaaggcaaccaaagcttttcattagtcttaccatctatttgatctggaccagcttttggtccagtaacctttgaagcattagaaccagatgggggtttaaccaacttcttctttggagtctgtacaaaaaatttaggcatagaattaacaaaagagtggacctggtgtttgcaactaagtaatatgtacaatgaagtcagtattaaatataacagtagcattatctgacgatcaataacaaataatgtagaacagttgtaagataagattcaagtagtattgttgacatcaggtgtagacccccgtttttataacaggaatcactcgtgtaaactgtaccatttccctggatcaagtagtctggtacacacgatttcataactggaataccaatgctcatacacgagagtctagtacgaattattacaacataagcccgcaggcattgtcttaaatcatcagaccgagcggtctggaatacaaccaaaagcagagtttagataaggcagcggaattttaggcagcggcatgccattgccacaggcaacgaccgtactaagacctactggacgccatcatcttcgtctccctcctggtagtaggcataaggatcttccgtggcttcatctcccgcttctgattaattttataattgcaagggtgagtaccaaccgtactcagcaagccaccacagcaatgatgcacatgacaggggaattcaaaggatggctatggttcttttgcacaaagcaagttttgtaattcttttcgcaagcctaagacctagcatagactgatcaagttttaataccagtattcatattaaacaatgacggttctgtccaccatccattgtgatcccaaggatagcttcccgccattgagtcgttatggttttctgaggatgtccatatttccacctctcaggaaatggctccatcagcataaaaatcatcatgcaatatcccatcccacacaagttaagagtttagagtctagccaagtgtaatacatgtcccggtgctcaataaccgcgagcacggctattcgaatagatttggtttactcacactgcagtggatgtacactttacccgcactccgcgactgctcaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttaggttctcataaggcagtcctactgatggcgacaccactgtagacacccgcctcgcggttctaccaatggctgccccaccgtagagcccctgcctcacacatcaagaaaccactatgcaggggtactgcctccgctcggctatctaatccgctaggtctatacccattcgaaaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaggattcaagggtaaacaataatcaaggcatggcataatcacaagtagggtgttcatcattgcatgcaattttatttataaacaaaaccatttcgcaattgggatcaacatgttcaaagaatagtgatgacttgccttgctcaaagtcttgcgggtcttggccttcgcttggatctgcaactccctcgggctctatagttacgtgcaagaattgatttgaattcggttagaattcaaataaaaatccaaatgaatccaaataaaagtcgcatgcgaaagtcgattcccttttgttaacttcactatccgcggactacggccaacccaatttcgatttaaactattttgcgagtataaatattttgtggtcatgagtttttaacttaacctacccgagtaacatatcaattaataggttagaaatttctatcgcgagctaaacatcggacgaaatcccagaatattatacgacttaatttagtctatgattaaatataatacacggctaacatcctagtgattaaatccgaattgctaccgttaatcgattatttatagagattacccagaaataatccacaataatttacgagaattcatacatttgtttaattattaattacatctaaattaataccgcgaattgatttcttatggagagtactagaaattatctataatctatatgaattcatccaattatattttcattaatcctatatttaaatgctagtattttaggtatttaattagtaagatttcatctaactatattttcattaatcctacaattaaattctaatatttgtaagtattttaaatttccccctaaatttttcccttttcttttccctctctctctctcttttcttttcttctcttttcttttctttcctttttcctctcctctcttttcttttcctcttttcttttcttttcttccttttctctttttctttccttcctcccggcttcctccttccttcctctccttttcctccctcggcttctctctttctctctcggctcggcgacaaaagaaagagggagggggggcagcggctcaccgacggcggcgacggcggcggcggcggcggcgacgacggcgcacggtgcggcactctggggcggcggcacgggggcacgaacgcggcggcacgacagcacgagggcggcggcgcggtggcacgatggcggcggtgcgacggcgcggcggcgtggaggcggcggcccggtagtgtgggtagaggagaggggtggagatggaggggaagagggggaaatagtgaggcttatataggggaggggaagagctaaggggggaaaaggagaagggagacgcgacggcaacgcggggcgcgaggcgcaaggcgacggcgacccgcggcgatggcgatggcgacttggggtacgagcgccattcatggtcgcag

SEQ ID NO: 18435 - DNA, 20462 bp, Oryza sativa
  unsure (1)..(20462): unsure at all n locations
atggcattgtagactattctgctgccngcngccgctcttatgatccccaccaaaaatgacacatgttgggatattcccagtaagatgtgggctctaattttgttttctttgctccttgtttgggtcaatgctctcaatgttctggaaccgtagtgtggaggaaaaaatagattaaaaatagaaggaagttgaggcatcttacagagtgctctgtaagtttatcctgcatttcttcttcagcaactccctcttcttgatgttccaaggtatctatgcatgaccatgactataattatcaatcattgaaactaagaattcataaactgacttttcactaaaaggcaaccaaagcttttcattagtcttaccatctatttgatctggaccagcttttggtccagtaacctttgaagcattagaaccagatgggggtttaaccaacttcttctttggagtctgtacaaaaaatttaggcatagaattaacaaaagagtggacctggtgtttgcaactaagtaatatgtacaatgaagtcagtattaaatataacagtagcattatgtgacgatcaataacaaataatgtagaacagttgtaagataagattcaagaagtattgttgacatcaggaataaagcatcttgagaaaaaaagggaatctgctgaacctcattcgaacttggatagctcgtaatctatctatagatcttttaaattgttctttttacatgggcatatcacatatcagcagcataactaattagaaaccagatggcgaggtaccacgaacagggattaaacaattaagaacaaaataagaattatagtagttaccgagcgttttggaggcttatcttgatttgattccatggttggtttctcatctttgtcgaaagcatctataggcaaccatgaagagaaaatagatcagaaagtgaataaaaaggagatactagtttggaagtttgtcataacaaaataataaatattactatctccgtcccaaaatatgagttttagggttgaatacaggcattaagaaagatggtggaattaaatagaggaatgttgtgattgattgagaagaggaggtgggaagggatttgaatggtggaaagttgcgattggctaagaagagaatgtatgtggagaagaagttatattttagggcaaattatgaaggctagatgttgttatattttgggatggagggagtagtaaactaatgataccttcttgactagtaggggttttcctcctagtaggtgttgcctttttgcccttatttagtgcagcagcatctccatcccctgcatggtctgaactagccttgttttcccccttttgttcttctccagatggtgtagtccgtgtaggactgttttcaggagaatcatcggagcccgaagaaagcatcaccgtcgatgtagttggtggctacgaaaaattatgcaaaataaaattggtgatattatcaccaataacaagtcacaatcttggaaagccagagaagttgtaccaagaacagaaagtgtaacaagtactagatacagaacatgcttgctgcctcacatcggagcctatcggacatcggaaccaaaatcaagacatgtgttcgttgtgtttaaactaggaatcggcgataccatagcgggaccgtttagcaaaaccattggcatagaccaagtaaacaagttgttaaacacatgtacaaacaacgttttctgaataccgaaaattcgcatcgagttgtgcgaaggattatcaaagagcacgaaattctcacgaacatcacaaagcatatttaacacatagcctagaagcacaacacggaatgccattttgtgaaatgacatagatcaaacttattagcgcgcccactaattcagttcaattctcaacttaaatccacagagaaaaatgggtaaatcgaaaccgctcggcaggatggaccttattcccacggagacctggcaggatttagctagggcacatcacacggccacgggaggcggaggagaagagatggttacctggaacgcgcggagccagtcggggtcttcttcttcctcgcccatgcctgcgcctccctccctcaaaactcctccagagccgactatggaaggcagcccactacgcggaccagccgagcgagcgagcgcgccggcggcgaggcgaggcggcggcggcggagcccgggtcgtcgacctgcgcagctgcgctcgaggagaaagagaggtcacgtgcgtcagagctgttgctacgaggccccgttccagccgggccggcccacgagtgtggtgggccaaacacgcgatgctggattaggatacggcccacgagtaagtaatctatgagtatacctttcctaatcgttcacgcccttgtacgggtggaaacctagccaagatccccatcgtcgccgccgccgccgtcgccgtcgccatcgccgccggcggccgccattggcagcagggaagaggatgatccggcgattcttgtacattgctgaccactgctttacaggcccctccctctcccacaggctacggcgagtcaacccatcacatctcttctaccccgatggccatccactagcaacgaaaccggagcgagcgacggtggaggtggaggacgctcgcctgcctccacccgccatggccttctgctccccgggcaccacggcgacggccatgggcatggagttcatgcgcaggaacgacggcagcatcgtcggcatcgaccacaccggccgcgccgtcctctacgaccccgccgcgcgcgccgtccgcacgctgcccgccctcgcggcgcccaagctcatgcccgtctcggccgccgtcggcgacgacctgtacgtcatggagacgacgcccctccccgacggcgccggctgcttcgaggcgctcgtacgcctcgaggataatcccgccgagtccgactccgacaagtgggaggtaggggacaactacctctggcaacccctgccgccgccgccgccgccgccgtccccgtgcgtgaacgcctacgccgccggcttcgaaggctcctcccgcggcatgatctgcgggtacgcggtggccggcgacggcgacggcggcacgcgcatcctggtatccaccacgaccaacggcacctactccttcgacaccgcgagctccgcgtggagcaaggccggcgactggaagctgcccttccgcggccgcgccgagcacgtccccgagcacggcctctggttcggcatctccgacatggatggcaccattctcggagcgtggaatctgtcctccgcgttccagcagccgcagccgccggtggcgagcctccaggtgaaggggttctcggtggagagccacagcgacgaccggaggaggagggagttgaaggtgtacgcatcgcaggtcgtccacctgggcggcggcaagctgtgcgtcgccaagatgttcagtgttgatcgcagagaaaggggtgaaataaatttcgccatgctcaccggcgtggaggtggtacgcggccgtggcgggaagctccgcgtcgtcaagcacaagtcgcgccgttataacttcggccaagactacacccctgtttatctactctaacgagtagagtactcctacttagtactgtcctaataaaaacccttatttgattaatcctgctcttatgcaggatacatattcatcggttagttttaaaactctgcattgcatagctctgtaaactctgttagtagagatgaatgatttcaaggaagcaattctattgttaaggacctgaaaaaaaaacatttataacctgaaatacttatcatctgatcagatagcagtctaagtgccaaaaactaatactagtgacaacaaatggcagctgccataacagataagcctgaaagcaatatgtcagcttccttgatgatgcatatgtggccatgcgggttagctcgtctctctataattttcattcctttaacaggctgcataaatgcatgtagtattgacgatgagaaaaacacaatgcttaaatcatcattgggcaaaaaaactgttaacatacactccacccccttaacaaaaatcatattggtactaaaatgaaaatagtctctagtgaattatttttttttctctctattgattatggcactccaaaacatttagtcactgttgtcgatgtacttataacttgaagaaagtcatactgaaatttgtctggcataaatccttgatcaatgtagtcttttctttaaggacagttagtcagtgaacttcaagaaaggttatatactagataactttgggaaacactatggatcttagcaaggctctttgaaggtggggtttgttttcttttgctccattgtaacttacaagtttagctgtgcatcctactctaatatacttttcaatgagtatatcacatgcattatttcaatgaatgcctctgcataattctttcctcataattcagttacattgcgttagatccaagtacaacatgccaatattgcctggtactatctcctgtgagtctataatgattccttgtcttttcatctccatctcaagtcctcagtttattgttgaagtcacaaaacattgttaggaataaggttaaatttatatatatatttttttgaggagaggttaaatttttatattaagtatgcatatcaatatgacgtttcagttcatgtttgaacctattggtgtcagcatggtattgtaattagatactacatatccttttcaattggtcatttcgtgatgttggactgtgatatggacaccgtgtataactgaaactattgtatctaaggcacacaagcagaaaaataaatctacatagttggagattgtcatttataaagttctgataggcagtgtgatgttgtgatcatgccaatcattgcacatatgcttcttttcgaccttaatttttctaatctgaagtttcctgatttgttgattaggtttggtaggtctctctaaagaatgtgctgatacaagcagtacgtgcccttccatatcattggatgttgttaacttttacgtgtctgacagctgaattactcaaacaatgttctttcaaatttcatttacacattcacgtttctgtcaaacaacgtagacactataaggctcttcttatccttgggtattgtatcatatttgtgtcattgttcaagtaacagctatgtctgtagttacttactatgatggaaaatgattatgggaagtatagttcatcttgcagtctagtgtatactgttgccagtgcattatctttgtgaatatggatgtgaaaatggcatgtaattatctactgtctgccaagcacttcttgtcagctaactgtgcccatggcatgtggacatttgcattcaaccagatttgctctatgctatattttcagatcaagcgaatgactcaccatgttagaacgaagggagaaaaagtctctaaatttgcatttgatgcgacaatctttgcctctttggtcttgttttcgccacaggtgcagatcatgggagtcaatgttgtttaacgatgcatgctgcatcgacaaacccattatctagttttcctaaagcctgactaagatagaggcaccgggccggagagtgacccgaagaataaaggcagggaaaaaaacttgaggttgaattgatccagtaattgtttggattgatgcacaaatatgaatcttatcaattcttttgcaagggtaatgcaatttggcaaacacatttggtttgttgccaacagaaaatgaaatggtagtgtacattgtttagtctctaattgatctcaaattaaacaatgctcaaagcaattttaccaagaaaaattggcaacaaacctaacttcgtcacaaattttgcaacgctcgtatttggcttacagaaatattttaactaaggctataaaccaaacaaaacaccaaacttaattctgtgtaatcattcttccaaaactgacaatctgataccattagatgtttttactagcagttagtaaaatgaacagtggtagatgtactaacaaaggcaatgtaaccacagagcatggggctttgacatcgaatttgtatgcctgcagtacagatactgcgaattgactactgtgtcaacggaacatcaacccgtactttgtccttgtcaaagaaaacaggaacaggactgttgagtgtgaaccgaacatcaactgtacgttgtccctgtcaaagcaacaggaacagggtggttcatcgagaagctatgcaattgtctcccaagatatacctataccaagcaaagcaaaaggtatttcagttagtaaaatcttgtttcatgtactacaggagatcagagagcacaatgacctactataatgaaaggggaatgaactgctgacctttacctggctagccgttcccctcatttgaataacctgtcaaaatctatcaccttgtgctgacgtagagccaccattccccacatcatagctgggagtgtcctagggaaatactggtgatatatcctgtgcgtttgaacgatcaaatacttagatccaggttcagttctatgacagtacccgtccctcctatacgttgcctgcgaccagttgctgattctatatccatggcttaactgcatgctaagaagcgggtgttgatatccaccacgacctacaatgacctacggcgacggcggcacgcacatcctgatatccaccacgaccaacggcacctactccttcgacaccgcgagctccgcgtggagcaaggccggcgactgggagctgcccttccgcggccgcgccgagcacgtccccgagcacggcctctggttcggcatctccgacatggatggcaccattctcggagcgtggaatctgtcctccgcgttccagcagccgcagccgccggtggcgagcctccaggtgaaggggttctcggtggagagccacagcgacgaccggaggaggagggagttggaggtgtacgcatcgcaggtcgtccacctgggcggcggcaagctgtgcgtcgccaagatgttcagtgttgatcgcagagaaaggggtgaaataaatttcgccatgctcaccggcgtgaaggtggtacgcgaccgtggcggaaagctccgcgtcgtcaagcacaagtcgcgccgttataacttcggccaagactacacccctgattatccactctaacgagtagtactagtagactcgagtgcgttcgtttccttgtgttggaaactcgtttcctcagcacagagagtgattcattagcacatactagtaattaattaagtattcccttcttttctaaatgtacgccgttgacttttttaaacatgtttgatcctttattttatttaaaaacttttgtgaaatatataaaactatatatacataaaagtttatttaacaatgaatcaaatgatatgaaaataattaataattacttaaattttttgaataagatgaacggtcaaacatgtttaaaaaagtcaacgacgtcaaacatttagggatggagggagtatttatttatttattgaaaaatatattaatataatttttaaaacaacttttatatagaaaatttttgcaaagcacacatcgtttagtatttatttatttattgaaaaatatattaatataattttttaaaacaacttttatatagaaaatttttgcaaagcacacatcgtttagtagtttaaaaaacgtgcacgcagtcgagaagataaaagaggagtggcaggctataaatttattgtcagatgcaacacggactctagaacataatgtatgtacaacaagtgggtttatatattaatagtgtagtatatatttatatataagtaaaatacaatgtatgtatgacagatgagactatatattaagtgtaatatatatttatagataactattgtatgaatcgatactatattatagttggctatactattatactttgctctcagtgctatcctaataaaaacccttatttcattaatcctgctcttatgcaggatacataaacatacatattcatcggttagttttaaaacatacatattcatcggttaattttttagttttaaaactattcatcggttagttttttagttttaaaactatgcattgcatagctatgtaaactctgttagtagagacgaatgatttcaaggatgcaattctattgttaaggacctgaaaaataaacatttataacctgaaatacttatcatctgatcagatggcggtctaagtgccaaaaactaatactagtgacaacaaaacaaatggcagctgccataacagataagcatgaaaccaatatgtcagcttccttgatgagatcttgtggaaatcaagaataatacttcgacctcaaatttccagtacatactttgctacatacagataaataaactggaggtaaaaggaaacagttcaactcctagatgcccatgtttgggtacaagtgatacgtcacgtcagtcattgcacaaccaaaaaggatttcagaattcaaagagctctgctccaacactcgagactccggtagaagagataaaagacctatccgattaacaccaggaggcgccgaggagggaacccaataggcaaagatcctgtcccatgttgcagcatggttccctagtatgccacgcctgtgagccccagaaatcagcattgtatcaagcctggaaatgtccctcactcctcgttatattccgggttcttcttcagaattacaaagccctccaataccgaagtcagcggaatgtatctgcaaaacgtaaaacaacggatcaggttttaggtttcatggggaaacttgtagaaatggcatattgttaattgagctcttattacttttcggttgctaattcagcccgttcccctgctgcaagcaatacgggtgtcgaatgtgtttggaaaccagtaattgtcttgggccttccagcctgaccaaccacatcaacagcttgcccaacccgtactggaacagataggggctttagatcctcatccaccgttaaaagcattctaggctgtacatacaagaagagaactcaattttagtaccaaatagtagtttgcactagcaacaaaactgtcaattaactaaatggaccatacctgcatcgccaagacgataatgtaaagaatgtagtggtatttccctagaatggtggatttcatatcgaggcaagcatgcaatacagtaacaaggcctccaagggccattctacacccaaacaaaaaattgaaggattaatattgaatgcaataaacagtagatgtaaatagcactagctatactcacggggaaagtagaaaccggtcagaatggtatggagagagagtcaacaaacccttcccaaggtgaacaagtccttgagcaattcttacctgaatacatgcaaaattttgtcaatatatgtacgcattatatacaaccaggtacaacagaatggagcacaggtttaaaaggatcattgtggatttattaacttacacaaaacagatgcgcagcttctttgtaatagtaacttgaaagattgcgaagcataccagctattctagcattgtttgtaccagcaccaatgaaacccaatgaaatgattgcagcctagagaaatttaattcaggtataaaacgtaagccatcaattaggacaaaatatattgggtatgtcgtgggttaaaaagttatgaatacaaaccattgacacatcagcatccgcatcatgactcagtctgctaagcgtgtccataacatttacctgggatgggataatagaattgtaagtagatacaacaacactgagtggggcataaattgctttgctaaattatgcaaccaaatagatgtagaatggaccatcaaacaaacacttaataccgaataagcatgacaatatccttgcaaaatatgagtaatttgacagaacagtaagcgctgaaataaatagctaaagaaggtgcttggaataagatattgaataatggaacatcaaagtttagcactttcaagtaataactccattacttgttccaatgtactaaatgttatggtgtcaattgagaatttgagcacaactcctttttttaacactcttttcaaacataaaacaattgatcacactttcattgaactggagtttagattctgcatcctctctcaaagttttttttacacttaatcatcaaagcattacttcaaatttaacttagatcgtgatccttaacaaaacttatgttggtcaaatgttgcataccttcggattagatatgcagagtatgccaagagcaagaggaactgcccgtctaatattctgctcgccatactgtaaaagacgctcaagtgaccgtacagccatctcagctcctaattcttcagccattgcaataagcgcaattcctaggacagctggcccctggtgggtttcacctttctcaagatgctgtgagcaaatcccaaggagcttttgaacctgcgtaaaattgccaagcatatcaaaacctcgaaatttaaacaagcttgaagccacaagaacctctaagcattaaacatgaagtaccttgagcacatttcctgttccagcatatgctagtgacataagtgttacatcacagtactttcttatcttctcatcaaatgttttagaaacttctgccgtagcctctacactctcctgaaatggaaattgccaaacaatcataaaaggtacatttatctaaaagggctgcataaagccataaacaacagttagaaacaaaggcagctatagtatatgcatacagtacatttaggaatagaaatacaatatataaacaatacggacaacattacaatgcgaaaggtcagacatcatgtgggaaccatgacatggcatttacagcaggtaaggcgcttgacaaaaccaacagaaacaagcacttgcttaaaataaaataaagggaggacacactaggtaaatcctcgaatccacaggtattgaacagtatttcaaatgtataaaagcagggaatactggattttttttaagcaaatgctagtgcacacagcccaaaaaaaatgaatcaaaaggaactaagcttcaaggttgctcaaaaagtacctgctttccaagatacagaagaccaagcgcaacaggaagcaggcgtataatgggttctgccagctcagcctcactgcgctccatcaaggcaaatatgatagattgagcaatctcttcattgcaagaaccaacaaacaccaatcccagagcgatggcggagaatatcaggacctcaagagttgatttctcagagtcccccaacacagttgatagataagatttaagctgaaatttcagatagcaggttatgtggaacatatagaaaatgtttttttttgtaaaagcacagaataacaattcttaaatcccacctcctctttctgagaacccgcatatgcaataccaagacccaagattgccccaatccgaatgtttgtgtcatccttgttaatgtactccatgagaatagcaagtgcctggcagcaaatttagggtattaaagaaagtatttgcaaaattttgggtattaagaaaagatttgcaatattaatcagtaggatggaggttgggaaacttagacagtggagcacatactggatcacaatcattcttcacaccacatgtgacaataccaatacctagcaaagctccagcaacaacatgagcatcattactatgtaagtacttgtcaagctgagcaagtccagaatcagtatcccacaagagaatcattccctgaaaaggtgaaacagtacttttgttattattgttgaccagttaaagaactcagttgtcaatggtttgtagagtttgtcaaatatcaataacaatgtaacttaccaggctagctgctgcgctggctttcccatgttccttgttcttgaataaccagtttccagaagctccgctactggaagaatcagatggagcagtcatcaacttatcctgcacagaagatatggtcttgagattcattctttcctcggaaagaactaaaagtaacatattgtttgtagagctaacctgaccaaatccagcatttacgaatgcatttacaaatgttgcagctaaattttgtcttgcagaatcaagactggagctggcaccacgcccatcaattaaatggacctgtagattgttaaatacaaatattaattattatgaatgaaaaaagcaaccttaataaacattgatagtaaaatatagatgaccttatatatatcctctggagattttgcttccatcacttcgatatctcgagcaagggtgaggtacccctcactcagcttactattattaacgatttcttgcaaaccctccttatcattgccatcggcagctatctcgtcgtcaatctccatggccaaaccctgcagaagagaagcgcttgggtcaaatttaagggattgctacttttagcataagatgcaaaaggtggcaaccaaggtagatagtgcgtgagagatttatacatggcgtgcaatgatgaatgagaactgctttttgagctgaagatcctcagttgcggtgtagacctgcttcacatactgcattgactagaaacgatggagatgtacgtcagttccaattcagtcatacaaagagaagaatagcatggcaagcagctcaccttgttgtcaaggagcagagcaatccgcaaagcacttgtaaggtcttcaaacttcatgtaaatggtataagcaatgtcaagcgccaacatgtcatcaggagcagggaggtatctgtggttttacattcaaagatgcagctattaattcaattcaattgaaatttaacactaaagtacaaaattcagctactccaaggaaatcttgccagattaggaccacaggatctacagcataaaaaagtatacaacacgtggaaaaagagacatataatggaggcaaaaaacaaaacaaaaatgtgtttacatacttcgatgaacttgtaaggtacaagcaagttcttttgtagttcgtagagtcaacatgctcaactagcaaatcaagatcttccaccttcaaaggagatgaaatgtcatgcatcagcatagccatcagtagacagattgtggtaataataaaatctgagttaattagtacactatatgaaaatacctccatcagaagatcaactgcttcaggttcagcattatgctgcattacaaattacaataaagcaccattaatgcattaattatgtcaaacaaataacaacagctacagctactaagtggcatcaatcagagcatcaaattaaataccaaaaccaaaatctctgataagaatcaagtcaaccaaccttcatatggaatgaaacaatttgctgcactagttccataagagcgtcaatcggcatgtcatcatcctgtgaaacaattaattattgaatcaaaggttccaaccactcaaacaaaacatttaaagaaacgttgtcctagttacaggcatcatggaattaaaatggacaaatagtatgcatggcgagagaatcacatagggggcaagaaagaataaacgacggtttcttaacatggtaacctcataacttatttcagctatccaacagtcatcaatgcaagtctctgggcatgttattcaaaagtcaacaagctttaacaaaaaaacaagaaggaacaaatacgtagctattgaaatagctggaatcagaaagggaccatgataggaagtagtgaattaagtcaccaaataacaaaagaaacaatttatcacaacttcagaacaaagtcatgaagggaagataaatacaaggtaacaaaaaaaatgtaaaagtttcagagcttctattaacatgaaagtgagagtggtacctgacgcttttggaattcttgtgcaatttcgcctgccaaatttctgtacaagagacagctatttcattagaacccaaatatgtaatgaaaacaaaaaaaaaacattagtataatatattgagtttgaatacactgttaaaatatcaaatatagctaaaattcaggtaatttggacataaatcagggataagtcactgcaaaataaaatgtcaaagacactaattaaaaggttccaacgatacaacctcagtcacaatcgacatattgattcaaaaaaaacattcctaatcataaacaaaactgtatagtttagaactcaatacagtgctatgactatcataaagttagttctgtcccatgattctacaagttactcagtatattggtcgcaggaatattagttaacaataattgacaaagctgtttagttcaatctcaattatttggcacctcaaaatataaactaggcacgctttgacattcccaataaaagcacggacagaaacattgtctggactctggagttcaaacatatgcttggacagaagtaagaatcaagaatgaaaaaacaaaaacttttcaaatataagtggagtaggaagtgacagttcatgacacaaatgcaagttacagctaactaacactattatcactttagaataatggcacaagcatatcataccactttagaaggcaaaatatgaatgtcaaaaacatgtaaaattgcccttaccttacgtattcatgaccccatgaaccgatatcaccttcagagcccaacaaacggtacttaaggctttcctgaaacaagtaataggcaaaaaaacattaggaaaagtactgaagtttcaaacaaagaaatatcttgttcagattagatacaaaaagcttttattgtggcaggaacatactctttctccttcagcggacattgtcaaagctaacactgataaaatgtcggccatgtacctctaaaaacagtaagaaattactatcagcattcatcgctgtgacaaagagaaagttaggctactgcacaactgggaaatcaacagacaatataccttcaaatcagaagattctggcatggtttcaaagtaagacttgagtgttccatagtgtggccggaggaatttcagtggctttggtacagatgtcattgagcttgtggcggaacgaatctcctgccttttagggaggatgatattttagtgacagaagatggaaatcaaagcaacaaaatttggtcttaaccaagtaaatctaactatggtggatcaaaataaaccctatgaaccactgcatttacaaaatttgcctggagaccagaaatctaaacctagatttcctactgggattcaggaaacgacgcgacgctaccctaccctaaaaaaaagaatcggttaattaatttcagcaagcgaacagcacctcatactctcaagcgcgagcttctgcacgccgggatccgcgtcctgcgcccgaaccacgtagagctcgagctgctccttgagcgccaaatcctcctccgactgcccaccaaaaaaaacagtcaacacaaaaccacggatcgaatccagcaaacgaaaaaccgaggttccgaatctcgatctccctcccatcggccgttgcgcgccggggaacggacgcggggggacactcaccagatcgtcatccttcttctcgtccttcttcttccacttggacttggccggcggctgcggctgcggctgcgcggggtcggacggcgccgcggggcccgcgccgttggggttctcgggcggcgccatggctactacgggcgagagctagggtttcggaggcgcgagcgagaaatccgcgggcgccgccgcccccgctgggtgtgcaaggtgaaagcggtggtgggaggaaaaaagggaaaggggatctccggtttgcttgcgacggaggcgacggggggcttcgtttcgactcgatttgccccctcctccaagaatggatctgtgggccttggatttttttcgcgaacgggtgggccgggcctggtgggccaaaaaagggaaggcttcggctttgatgggctcattctgtggcgagtggcccaaaagggagaaccaatctggttgtctttcgagtgaatttcagtttcggcttgtcagatttttcctcttagtgccttgtttagtttttttttttgtctgtgtttatttttcttatttcactttggacccccattatcctcctcttctcaaaatcacgcgccacgtggccataatttatgagtcagtggagatgtttaggggcagtgttggtgtgaggactgagtgtgaaaaaaaaaactgagatgattaggagaagctagccatccgatgtaattaggataggataggactagccacatattttcaaacctttcatttaatctaggtaaaatatgagcaagttcgagacttcgatgctggttctatagggaaaaagcaaccaacccttgacaaatcgatatgattaagaaatacttgaaacctaggaggctaggactaaggagagcagttaatgaggacatcaggagaacagaaaaggaggtccacaatgaaattcaaacaatatagggtcatatggtccaaggtaaaaatatgggttgacaaaagtgtatggtgaaactttggttagaagaaccaaaagttggacattggctgaactcaggagttgacaattttcagttgaaagctttttagtttgaatatatcactggttacacaaactaaatcattagtattgtctcctagtgctaatacatagaaagctgcacatttctacctcaaggttttagtattataaactgaactcaaaagttcaagttttcaaatcaaaagaactttttgttgaagattttacaaattacaaaaactaaatcagaatactatcttagtagtattaataaaataggaaggttgaaatttctagctgaaacaacaaggagatttatgtgtgcgtaacgcacgatgtgatagcaaacgtgggtgcatcttcttgtattagcgaaaaatgtggggaatacttttcccacaaaaggacaaaaggctactgtttatacttatcaaaacgttgtactccctctgtcccataatataagtgattttgagtttttgcttgcaacgtttgaccactcgtcttattaaaaaaatttgaaattattaattattttatttgtgacttattttattatctacagtactttaagcacaatttttcgttttttatatttgtaaaaataatttgaataagacgagtggtcaaacgttacaagtaaaaactgaaaatcccttatatcgtgggacggagggagtacttctcaagccaggtacacatgatttggaacttgcgacatgtctgcctttgaagaatgtagttagagaactttttacccaggatgatctagtctacggattgataagttttaaaacttcatgtatcgaattcaaacgagagggtgtgagagtgctttggccatgtatatccttgctatgtagagatcgaaagtgttagtacaattgtatcgtttcaatgtaattggggagttcaattaaaaagcttccattgtctaacaaattagccaaaagatgaccttgaatgttctacttttcagggttataaaagcaaaaatgacaattgaaagttcacctttcggtgttatagaaagctttttgatcgaggaggtcagagaacacaaattggaatatatatatatatatatatatatatatatatatatatatatatatatatatatggccagtactttattttgttggcgtcaagggctgtatgatatagtgctcctatcagtgtagtaatttacaggttgtgtttagatctaaagttaagtttggatccaaacttcagtccttttccatcacatcaacatgtcatacacacacagctcttcagtcacattatttccaatttcaataaaaatccaaactttgcgcgctgaactaaacacagcctataggagagttgttctccaggcacatagagttgttctccagtccagtgtccctatcaaagatagtactagctcttttgtgtagcaagtggaggaataagatgccccatgccatcactccagtgactccagtccagagaggaaaaggcgcaaaagacaggatgatgctgatgaggctctgaatcggatagcaagcacaataaaatcataatcaacgcccatcgctttcgctttgtaatagtactcaccaaacgtccattactgatgcacaagctttgctttgctattgtgatcttgctgtggtcttgctttgctattgtgatcttgctgtggttggaccagacagccaaaaaaacacagccaaccagtactgcaataatgtttaccaggttgatccacaacgtgtaactgcacaagatcttctcaccaccaaatgctgataaagcagaattcttgataagttgaacataaactttttctcgaaacaagttagatttcacattaccaataagaacaaaatttgtacggattgcaaacagctgaagaatgtaagagcagattggaataataacacaaggcaagcatagcttaataaagaaagtaaatattccagtagtgtctccctctcccagctagcccaggaagcagcacagcctaacagctacaaaaatttccaaacatagttgcatacggaaaagagaaaaacatggaagccgtccttaaccacaattcaaatagaccccgtccttaccactcctcccaaacgagaaagttggtcatattaaaacaaaaacaaaaacaaacttttatccagaaccttacttcctaagacataatctagagaaggtcagcgacgttggccggcagctcctcgatggtcacattgtagaacctctggatgtcgaacagcatcctctcatcatcgcgggtgacaaagttaatggcaactcccttcctgccaaaccgaccactacgaccaatgcgatggaggtagttctcaggctgggtgggcaggtcgtagttgatgacaagggagacttgctggacatcgataccacgagcaagcagatcagtggtgataagcacacgggaagaaccagatcggaactccctcatgatgatgtccctagtgttctggtccatgtctccatgtgtggcagagacagtgtggtccctgctcctcatcttgtcggtgagccagtccaccttgcggcgggtgttcacaaagatgacactctgggtgatggccagtgtctcatacaagtcacaaagagtgtcgagcttccaatcttccttctccacattgacgtagaattgcttgataccctcaagggtaagctcatctctcttcacaagaatcctcacgggcttgttcatgaacttgcgggtgatctcaagggcctcaggaggcatggtagcagagaacactccgacctggatctttggtggaaggagctggaagatatcatagatctgaaaagggaacaccatatgtaagttcagaccatgcaacactacagcataaagaaatgaaatacaacttccataatagctcatcaaccattagacacacatagtacatgtattaaaaatatgcagtcatattgttgcgttaacagatagccaatgaagcaggtgaaggtcagcaagtaaaaaaaaagagagagagaaactgtaagtcctaaaagagtcctaaaaatgaactaccagctttacaaactagtaatcacctatgatttcttcaagaatagtaacattaagtcataaacataagcatagcgcgcactcagataacaattccataaatatgttgtacttatatcagattttgatgcttgaaacactcttaaaacacaattacacaaacatgaacactacagaagacataatgtaaaagatcagccatacaaactgttggaggtattatagcagaataatgggctggtcagaagcaaacctgatccttgaaaccacgggagagcatctcatcagcttcatccagcacaaacatcttaatgtggtctgggcggagagattgccgacgtagcatgtcaaacacacgtccaggtgtgccaacaacaacatgcacaccactagcaagaatcctttggtcctcacggacagaggttccaccaacacaggcatgcaccttgacacctaagtagtcaccaagagcacgcatgaccttttcaatttgctgggcaagctcacgtgttggtgcaaggaccagggattggcactccaccaatccatagtcaagttgctgcaggatcccagaacagaaggtagcagtttttcctgttccagattgagcctgctgaatcacatcaagccctttgcagaagggaacaatccccctttgctgaatagctgatggcttctcaaaacctacacatcaaagtacagggatttgtaacatcaccaaaatatgtgttgttgaaacaatggaaaagggataagactttttgtataccataagcatagatgcctctgagaaggttctcttggaggcccatgtcatcaaaactctcaaaaacttcatcatatgaagtgaagaattcctcattgtcaccttggtgn

SEQ ID NO: 18436 - DNA, 13230 bp, Oryza sativa
  unsure (1)..(13230): unsure at all n locations
naaacatccattagctgctactaagattacaaatacggtagaatagaacgatggcttacagtagttcctgcatcttgctgtcatagtgcttagcatcaaactgggagccttcgggtgccattcctgccatggctgtattcaagggaaaaaaaagagcaggttacaaaggatgaatggcaataatgtttgaaggacacaaagtagtagtaaactcagttgtaaaagcagtcttgacccgcacaataaatgttagtacatttatagctttctgctgcacacaaggaacatagcacccatagttgaagtctatgcacgacacaacatgatctcttcgaacagggtttatgcacaacacacaacatgaaatcttcgaaccgggaaacacaaactcgcaacagtccagaatttacttaatcgacctaacaggttagagatcaagctcagtatacaatggatactgcatgtggagcttaatctaaggaatcctcctaacacagcatactcaataagcgaacagaccaaactagttggcccaaaaaagaccttcgtttggtccataaagaccttcgacttcctatggttcctccactgtccttggcatacaaaggataataatctaacagtcatcaaagtacaaagcaggacatcgaagtgcttagcaggacaaataatctaacgcagtcattaaaaaaaagtacatatactagcatgttacaaattttagatttgcaaacactaggacacccaaaacatcaattactattgtcaagcaccacataccacttctatagctgctcaaaaggataacaaacatgccaacggagatataacaatctaaacatcattaaagcaatcaaagtcacgcatctcccacccaaacccctctctctcacagactcgccaaaatcacatcgaaccaacccagatccacgcccccaccacccggcgacacccagatcgagccagcgccaagccggaccaacccgaatccagatcgagcacaaacaaaacagaaaaaaaaaagcatcctcagcgggatcccatcccatcccatcgttcattgttacctgaagaggagcggatcgatccggaggagggcttgtgttggttgaaatcaacggtctcgaatccgagatcggcgtctcggactcgattcgattcgtcgggatcgcgtgggcgctgggaggcgctggctttttcgctgcgagcggcgagaggaggaggaggcgatgcgacgattgagggtttgggaggagagagagagaaagagagagagaggttataaaggggacccgacggaggcggagcgcggctcgacctcttctctcttctcttctcctcgtctcgtctcccccttcccgttccgttccgttctacgggccggctgctactgtggagtgtggagtatgagtaagacggggggtagggtttgcttccgttccgttccgttacgagcacgagtggtgggcttgccttgggcctagtgtccgtgtgggcctttcctttttttaaaaaaaaattataagcacagttacaccaccctcatcctaaaatgtagcaattagagagataacgtactaaggtgtgttcgggaggacgcaaaacgaaacttgtattattgcatgattaattaagtattaactatttttttaaaaaatagattaatatgattttttttaaaacaactttcatatagaaagtttttgcatatgtcacaccgtttagcagtttgaaaagcgtacgcgcggaaaacgaaagaggtgggttcggaaaatggggggaagaacacagcctaattttttttacaaaagtcatactaacaaattttttataaccgtttaatttaattagatggatgaaagttacaagagatctagatttacttagagctcatcacatcatagtctataagtattttgtaaggaaattttagtacgtatggacatttcctttctgtgtgtgtttgtgggatggttggttgccaaaggtggttcgaaattctgcgaaattcggctggagtttgattaggtttcgttgtgtttttggtctagacgtacttgaattgaatacttactgttttctgtgaagtttctgtgattgcgacgatgactcccggggtttccttgggtaacaaggtggtgttgtttgacacggtgagaaaaggaaaagaaggaaactatgcaaaattcagtactttttggatggaccggatgtgaacttgagcagagttgcagtatgtcatgttgcgttgcgggcaagtaattaattagtcggcacgacagcaatcgcgcaagaacatggagcatgggtgcgttgcgagttccaacgcggacagctcaacgcaaccgacatggggcttggatcatagaagttcatgttaagataattgaattcattttggcctatgcattctgacattagaataccatattaaggacatggattattttcatcagcttgatttgaaaaaaaaactacttagaataccatattaaagactactgactgaacttttgttcaattagacaattaggcaaggatcatctgactgaacttgacacagcaagtcggcaggtggaggtatcctgatagataaacagatcacacaaacaactcaaacatcgcaaacctgccaatctcacaataagagaacattaatttgcagctttgcttacttcgatttcattttttctcaggtcaagaacaaaatttacatcaatgcgcggttgcaatctgagtagtgatcttttactccgtacagtgatgacgcaaaacttacaggagattagctactacaactaattacacttcgcatgtccatggaaataaggtaccatatacattaattctgaaccaagtctccgtatttcaggctccttgcagcatatggctttactctcagcttgctattcttgcccaactgcttgtggagttgtggggtgaaataggtctcaccacctgcagaagaagttctggttctgaaagacaacataccttccatgatacattgatgcctccagataggctcagaagtctatcataccaaagatgctctctactgaaggattcactaaacaacctttcatattttcatctttatttcctaaacctaaactcaactttttagtaatggacacaatttctcggtccaggaatacagagaatgcgaccaataagaggatttaaaaaaaaaattcgaagggctatacctatactgtactgcactagtcactagatattagtaatggtaagaatagggcctcaaggtagtttgatgtacaattggttgctcctatagacataggaggctatagaagacaaggggtatgaaagcgttgtcgagttgggctgtatatgcttccaataaaccgctcaatgtcacagctaccaaaagtgatatccaatgctgtgttaatataaaagagatggtcaggatttatgcttgcttagtatattgtagaataaaagcttcaaatggtttaatgccagggggggaagtaaaacctgtgaaagtatgtatccacttgaagctaagagtgacagcaggattgagcaggctgctaatacagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacctatcattgatgcctaggtaaaacaagagaattcatcatactgaacgcagctaacataagaaaatattaactgatcacgcactggacatagaacctaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggcctatccaagcactgaacatgtaaatgagttaaaatctggaaaacaacgaccattaatccagacctacctaacaattagaatttccgaatcgcgatgatcagtgaaggcactcatgaactgatgcacaatatgcccaagagggtatatttcccaaacctgaggtcagagtgaaacatttcgtcggagaaattagcacatgtgggcatacaaactgccaaaaaacagaaagaggggggaaaagaaagggacacaaataaagaaaatgcttactcgaaccatctccaatattaagaaaacggcaaatgctgcaccaaatgctaagtccaagaaatcaggctgcaaagagaaacaatttattgagagtgtgtttcaaacaatctgatggggatcgaatatcgaaaacatatattacctgaaatattactgcaggagagaaaattaggacagcaacgagatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtgaatataaaccattaagtgaaccaaaattcaatacgtacaaaaatgcacaaggtttagaagcaacacaggaagaaatttttcaatatttgactaacagagtgcatgcttttatgcccttccaatgaaatgcaaacttatatgctcaccaaacaaatggatgcacttcaaaaccttgaataagacgcgtccatgatggcactaacaacaatagtgctaccaacaatgaaacataaaatacaccacagtcaattctcttctgtgtgcattcctcaactgtttgtgttctttgactctccagttttctacagtaagccaaaacttgaagggagcttttgtataacaaggggagaagaaaaagaccaagcaaaaccccctgcagaaaagaaaaaaaagggaagggtattatgcactaagaaactgaagccagagaacgcaatagcttctacctgaataactgtgcctatctcgcttcgagttccaggtgcgcgaataaatgcttctgatgatacggagaactccatctgccagcagcacggttgcaaatgtgcaggcaacaaaataagtatcagatttgctaccattttgctggtaaaacatagttcgaggaataaatcacacctttgaaagagtatgagccagcatatcaccacagtaaagaacaagaccacttgagaccaaaatggcctcccctaagttcacagaaaatgtaaagataagttaaaaaaagcaatagcttcaagtcatgatgaaaaggagacatatacattgcatcggccaataggaaccacacaaattagctgaatttaaattttaaaaaatgaacagtgtagatataatgcactatgcctgcatggaaaactggtaggataactagcaatcgtatggatagctctaaagtctaaacatatgcagtcagatataaacaaaaaaataaagatctaactacatcttagacttcaggtacaaaccaaaagatgaacatgaagggaacttctctagaatatgctggattaagatcacagcagccactccatgacacagcaaatacaccaaattactcatcaccagcagacctgttaagacaacctagattagtttgtaattccttgcttctgatgaacttccaccagattttggaaagaaagggtgagattatgtttgcatgcagataaaatatgcatgtacctccatcagtcttcagtaaaaggtggaacaagtatgccaggggatataaaatgatgagcaacaagccgtatttcgaagctatagaatttccattgctgggagactgccgtagatgccaaacaaaaaatgataacatgccaaggcagctaacagatactgcccagtactgcatttcaaggtatgcatattctgacaatgaacacatatgtagttagtaaaccagatgcgtcaccgaaaatcttagtgtcaaacaagatttgaaatgttgatgaagatttagggaaatttccatttagcagtggatctgataaatttgacaaaatagaaaaatggataccttcacgtccattaggatctgctagtaagaccctataaagttgaattaaccgtgaaagcatgacactaggcagagtagtggcaccaagaagtatgcctgatgaagcacccggcctggagcatatcaatatatcatcatcaagcacttaacaatttttttaaaaaaacatgcccaagagcatcaagccaccacaagaaggtgaagtcctcacaacacaagacgtgataaaatcttacagtaagcaactaggattgcacatcacagaacccatataaattttttgactaactcaccgggggggggggggggggggggagagattccccacctgaattgtcattgcataaaagaacccatataaatgacagtgggagcaacgttttagctgaaaatgcaatggaacattattttggccatcaaaatgagagcaatattttgactggctgtatgatagaagcacctctgaatttaccatttgtgaaatgggtcaactaagaaatgctgaaacccaattattcaagagtgatatttgtcccttggattcttggaaccaccaaaacctgaccattttacacactactgaaccaaaagaaaattcagtaagcctcaagtacaagtaaaatcgcattcctgcggaatgctgaatccgactgatgtcgtttccccaattgcatgatcctcacagggaggcagccagcactgaaccaacaaatggatcaattcgcctcagattctacggctgcgccaacgaattttgcaaaacactgcacctcgcaggttccctgacatcacagggagctcctcgaacacttaattcgtggagtttgaaactcgaacactggtatcaagatcgcgcaatcccccgagctaaccaaatcgcgcgaactagcagcccagctccgtggagatgcggcggaagaagatacggataagagcgggggggaggatataacgtcgcacctggtcctgaaccggcggagcggggatgaggacgcggaggcggagccatccacggcgagctcgacggcaagggcggccgcggcgaggaccgcgagcggggcggcgagctgggccggcgccgcgagcgcgacgcgggcgacgaagaggaacacgacgagcctctcgcccgagaccaccgccggcgccatcgccatcgccatcgccggcgaccgaggaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccagacatacataagtgacgttccaggcatagtaataacattaataatacagactctaataataagacaagttcacaatctcgatagtagcttataacatttttttgctaataatacagttattgggacagcagtaatactatgttgatcattttctcttcagagcggaggggatcatgcaacggcaacaaagtaaacattcaggacagatatcatctccttgggatctttaatctaagggaactcctcagcaaaccgggtcaaaataccctgaacacaaaaccagtaacaaaaacgtcagtacatcagaacaggtagcaatttatcattacattacacaagtaaaccagggggaaatatatcctaaacattgcacccccttcagaagcaacaagcctgcaaataaagaaaaaagaaatgcaacttcaatgaaaatgcatccatcacaagtaaacaccataaattgaatatcagctaactcaaataccaccgagttcaagcttcacagttcacacgcatatattggatgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatgggtcatatgataacaataaccaaggctttggcaccactgaaaaggagcaaaccgaacaaaatagctgttggtgcaacctagtccattcaatataggcagctcgtgatagatgttcactgaaaccaagtaaccaagaagaccatagaattctaacatatcaatgtaaatgtaaagtgagttataaaaagctgagctctatttttctaagttgtttcaagttaacattattccaacaggtcaaactgcctaaggcctaataacatacagtagcccaggctaaggatgcccatttgttgaggaacagtacaaactgataaaacacttgcaaggacagcagtaaaccaaaaggaatcatacatacgagtaatgcaatggttgctctttagaaaaagaaagcacctgaatgaacaaatatgaacccatgatacaatatcacaacttacttcgtaactaacagcagaagtttcaataatatatgccacaaaatttaagcaaaataataggaaagaaacaacacttacattgatcagacaaacatcgccagctctggacggctgtagatattatccccatcgtcatccagtgcaggataagcagcaacaagcgcatcttgtgcaccaatatatagtgagttgtagattttccaatatacttcacgtactttccttgctggatggaaaaggccttgaaggcagtaattcaagatcacagctggaccaagagcaactctcatcccctcaatcgcctccatgacagcattgatgacatggggagatgtctcaaatatgtttggccagacatagttaagcaaatggacaagagcatcctcacagcccaagccagcaacaccaagagccatgtgcttcacagcagaggcagcagtttgccggtgaacaagatctctgtccattagagcatcttcaagcaagggagtaacagcatatatgtaatccttgcccatctcaccaatatactcaaagaggaaagagagagacttcaggacaccattctgaacattgagttctgggactcggtactcattcatcagggcaggcagaaccgtaaaaggtgagcaggtttcagcaacaatggcaattgcgacagttgtgcagacacggttttgccgttcctgcaccttcaagttattcaacagagtagccaacacatcctgtggcccaatagccttcgcaatataaccaaatgtgttcacagtcgctcttctaatacccttcttgtgagccttcaacatttcaagaagctcaaagcaaatcctcatccactccctagcaggcacaaattctgctccgcgatcagcaatcctaccaactagatcaatgcagttctcctggaccttctcatgcctattcttcaagataggagtcagccgaggaagaagatccttgattggcggtgtcatcttagtcataccaatgacattcacaatagctttcaatgctccaagaatcgaacccaacacctcagggtactcctctcccaaatactcatacagcacaacacccaaatgacccataagctgctcctcctgacattgtttcatcacaatagctatccttgagatcagatcagcagcttgctgcctaacttttgcactcttgttgttcaaccgccacttaatggtaccacaaatctgaggaaggtaaggcttgaccctctgtcccagtgcattgacaacagctccaaaaccattaagcatgacatttgcatcatcacttgtctgctcttggaaagcatacaggatgccatcaataagcagctcctccaaacgagcatcaatatctgaagcacccaaattagccaccaccttctcaattgtttccatcaccattctcctgtaaggctcgctttcatctttcagatcctcaacaatcctcccaacaatatcagcaactccaaccttatttgccatctctacagttgtttccacaagctgcttatagttcctgcggtccagagccattctcctaacccagaagtgacggaaaaactcaggaaggatgtcattccggatataatcagcctctacaccctctgtactgacacactgtttaacaaccttcaggacaatcttcttcatttcttcatctggtgactggaactcccttatcaggatttgcatgacctccttcgtgtagtaactggcatacagcgcatccataagagggatgatgaaaccaatagctttcaagaaggcagcaagaacctttccacggtgagatctgatacccttccacagaggcttcaaaacagtatcaaaactttctataccatatggtgcagcagcctcagcaagtgtagcaagagaaagggcagtgattgtccgcactttctggttctcatcactaagaccatgctcaatgatctcgactagggacttgagatgtggcagaacagcgcagcccataagaatagcaatctgctgaacaatcttgataccagtgtgccgagcttgccaggacttcttactctgacagacagcctttaagaatggcaggagagcaggggtacccaaagcagaagccaccacgctaaatgctctagcagtggtatttctcacatactcatcaatgttatcaatatctggtctcatggcggcaatcatagtagcaagaccagcagctttgctaagatttgagataatctcccggccctcaacacgagcatagtagtcctcatcaatcagaagtggctcaatgaccacaagaatcttatggacaaacggacggactagctcatccagcttatacagtaccctgtcaatgaccttcaccagaagatgccgctcctggtcctcaattgttggctgcatgagcaagggtagaatcttgttgaacaaagggccagcaccaaattcccttgctttgtctgtcagctgtcgaagtgcgtataggctggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggggtctcatcccaacgattccttctcaccgacggtgtcgcatccccgacacgaccaggggtggcatcccagcgcccaatcccaggagttgcatcaggagcatcccaatcggaggaggtcttcgccttcttggatccagcagcagcagaagcatcaccatcctgcgactgatcccatctattgcggcgcttcggcgctgccactggctgctgctcgggcacggccttcttctccttggccttctcctcctcttccttcttcttctgagctatgtcacgcagcagctgctccttctgcttctgcaggtcattctcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaagaggcgaggcggcgggcggcggggttgacggccgcctcggattcgtcctcgggcgcgtcgtcctcggaggcggggatggaggtgtcgtagccggcgaagcggttggggtcggagccgccgccgccgtagagatcagtgtcgaaggtgacggaggagacggccatgggcgcgccggcggcaagggcctcctccatcttcttgcgctcctcctgcgcccgcgcaagctccgcgtcgatgccgtccatggcgccggcgcggcgggggagaagcggttagggtttcgggggtggagagattagacctggatttttcacattttggtccttttaaaaaacttatttcgcaagtagacccctagaaaaacttatcccaaaaatggtcctttttggggcgccagagtggctggcgccgtcgttcaacaggacggcgccagactatttggcgccgtccccctgccgacgtggcggggcgatgctgaggtggctaggggggaaccttttaggaatggacacaaattctcgggtccgggatacagaaagtgcgaccaatatgaggattctaaaaaaaaatttgggaaggctatacctatactggactgcactagtgactacataagtcatggtaagaataaggccttaagggttattctggagtacaaccggttgcctccttataatagggggctttaaaaaacaaagggtaaaaaaacgttttttaaaatggggctggatttgtttccaaaaaccgctgaatgttgcgaaataccaaaaagtgatatctcacaatgtgggttaatatataag

SEQ ID NO: 18437 - DNA, 6070 bp, Oryza sativa
  unsure (1)..(6070): unsure at all n locations
nggaagatatgtgatggcggacgttttaccgcgtccngggggagtatgtggcgcgatatgaggccatatgtaacaaatgaaggtgtttataaaagcgagaaattcagacattgatagacgggtttaagcggagtaaatacactgaatagggcgagtaatgaggcgcttaaagggaaccccggaagtgtaagaggaattataaggcggtggagaccagataataaaaggaaggagaacgggttaataanggacgaggnaggcacattctggcgccccaaaaaggaccatttctgggataagttttttcaggggtctatttgcgaaataagtttttcaaaaggaccaaaatgtgaaaaatccaggagattagacgagggcacgatgcgagaatggggaagaagagcaagtcgtgaggtttgggctctcgtgctagatagactcgctgacgtcatctttcatctgggccgttgattggctcccgcatgattgaggccgtccatctgaaaaacatgaaccgactttgcttccgttaattgatatagtactactcaaataattactctcgaatgcaactaagaccaatccaaaatcgtaaagctaatggatgcagatggacagaagtctagtgcctaatccattttctctaaggaaactgtcatgttcgattattctcacaacccaaaaaggtaaatgttctttccagctgagcttattagaacatcaggtgcacgtatatcaagcagctaaaacggcatcatcttttataaaactccctatataagtttattgaaaacccaaacaatgtttttagaaaaaaaaagagttatacttaattaatcacactctccgattaaacggttcataagactacattcatttcggtgagtgggtggcgcataataaattgtgtattaattattatagtttttaaccttttaaaataaaacactgtttaagagttgagaagcgtgctagaggaaaacggataagtgatacatagtaatttttaactcgatctaaggcgtccgaaagagaaattgcggttgatgttaacctgtgcactattcgaagagcttctaatcactacaatttcaatccccttcaatttccctctcttgggattaagcgaacaaggtctcaatcatcttcaatcccctctaaaccgaacaagaacttaagcggatgttcccttagatatctaaaaaccattcaaatagttatgattttctttaaaaaaaataacattaacatttctttctcaacatatagtttgaatttgaacttatttttttcagtgttagttgtcactgaaccctacattgtcattttcttttcaatcttttctgaaactatttgcattgaatttggaaagagaaaaattgcaggggagccaaccccttgagagtttagaattcacttccaacaactccagcaaatctaacaagtttgcttaaacaaggatgcatgaagaaaagaaaacaaagaactgaataagtcagtgtaatcgaatgatctgaacctcgataagtcagtgtagtctaggcggtgacgactccaccaactcccctcaaaacaccccgtccccaacaaaaagttggaaacacgcccagaattgtttcatcaacaccgcaaaatgcgggtgctcgtcgtgaagggccgcgccgtggtggcggagaccatcggttgctgctgccgcaccgccgccgccgctgccgccgccggcgagacagcgcactttctcttcaccgccgagggcatccatcaccgtagcttctcttccacccctccccctccgccgggtcctcacgtcgtcgggtcgtcgtcgtcgtcgtcgtcgtcgtcactttgggccggcgatcacagcgacaggtacggctccttctcatcacatcaccgttccttccgcaatccgcaccccgtgtttccgagtgttctgaaataacagtgcgcttcaggtggcatggaatcggcggcgaggtgcagaggaaacgcgagtacgagggccacgttggcggcggaggcgccatggcgactccccgattcaaggaggaagacctggggctgcgcgtgatctcgcttggcaaatgcagccgccacctcgttcacgcgcccaggtccgcctggttcatgctccacgcgccgtcgaggcgaagcttctcgacctcggcgtcctcctcgccgtgcacttcgccacccgcgccgcctgagaccagtccgccgaacacttcgacacccgcgccgcctgctccagatgtgccagagaacagttcgccgccggattatgatctctgctcagacaggttcgcgcaccaatccaccattgtttgtttggctgcgtgagattgcattgtgtgtgattactgcaactgtcaatttggatgtgagattgcattattaattattttgtgcgattacttgaattgttagtttagctgtgtgagatttcattattaattattgtgtgctattactgcaattattagtttgtctgtgtgagattgcattgtgtgtgattactgcaactgttagtttgctgtgagattgcattattaactattttgtgcgattacttgaattgttagtttagctgtgtgagatttcattattaattattgtgtgctattactgcacttgttagtttggatgtgtgagattgcattattgatcactgtgtgcaattactacatattgcaggtgctccttaggtgatatgcttgaagcgtcctatgatcctgtagagttcgtgcgcaactttccagcagtaatgttcagcaagccgaagaacgcccctgacactttgtacgatagatgggttttcaaaggctggttccaatctgctataagagacattttgagcaaactagaggatcatcacatagccggtctggagtttgaagatattaatactgagaccatgacaatagcttgcaatattgattcaagcgagttctatcccaggttcaattttcatgggaagaccaggaacattacttttgaaggacagaaaagaaattacactcagcttggcagcacccttgagaaattgatagccatctcagcaagtgctagtaatgtccatgcatatcatcatcaactcttgactgaagacgctaaagacttgctgaacaaaatgaggcatccttcccttgatcgttttgaggcatacatgctcagaaaccacccatctttacttcagatcgaagcgcatgcctctttctaccttacctgctttgatcacctgaagctattgcctcaaaagcctgttgaaaacttcttcaaaggactgccatacgcggtaggagaccagcatggcgattggattgcaattgcacatcaacacccgcttcttagcatgcagttaagccatggatatagaatcagcaactggtcgcaggcaacgtataggagggacgggtactgtcatagaactgaacctggatctaagtattcgatcgttcaaacgcacaggatatatcaccagtatttccctaggacactcccagctatgatgtggggaatggtggctctacgtcagcacaaggtgatagattttgacaggttattcaaatgaggggaacggctagccaggtaaaggtcagcagttcattcccctttcattatagtaggtcattgtgctctctgatctcctgtagtacatgaaacaagattttactttctgaaataccttttgctttgcttggtataggtatatcttgggagacaattgcatagcttctcgatgaaccaccctgttcctgttgctttgacagggacaacgtacagttgatgttcggttcacactcaacagtcctgttcctgttttctttgacaaggacaaagtacgggttgatgttccgttgacacagtagtcaattcgcagtatctgtactgcaggcatacaaattcgatgtcaaagccccatgctctgtggttacattgcctttgttagtacatctaccactgttcattttactaactgctagtaaaaacatctaatggtatcagattgtcagttttggaagaatgattacacagaattaagtttggtgttttgtttggtttatagccttagttaaaatatttctgtaagccaaatacgagcgttgcaaaatttgtgacgaagttaggtttgttgccaatttttcttggtaaaattgctttgagcattgtttaatttgagatcaattagagactaaacaatgtacactaccatttcattttctgttggcaacaaaccaaatgtgtttgccaaattgccagtggcgggcccagctttttaaacttgggtattcgaaatgggaaggggtaaaaaaatgtccatacaccaaaaagccaaaaaataggcttgtatattatgatacactaataattataatttagagcgtatagaataaaattgatcattagttcacacagtgatagaattgatcatcactagaaattgtttaacttatagaaatactaataccaaacatatcaaagtgtcaaaatatggaatacaaaaatgatagagaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgtccagtgtccaatatactcaattactcaaatactcaaataggcaactagtcaactacaatcctacaaactaaatgtctaaatcaagcaagcaagcaactacactaaaatactaaatgtctaaatcaatgaatttttgtgcttgtcccgttgtccggagtttagtcactcactgtgctaatgtgcttatccggaatttgcaggtcaggcagtcgccggcgagcaagatgccgcacggccgcagcggcagcgcgcagccgccggctgcctcgggcctcggcgcggaacggcggacgccgacctgcaggctgcagctgtgcagcgcctgctcctgctcggctgacggcctggagcagcctcctgcctggctgcctcctgggcccctgcaggctgccgcgccggctgccgcacgcggcacgccgtcgcccgacggtcacggtgcgcctgccggtcacgggcttggcgccttggccttggcggctcaccgcctcaccggtcgccgtcgacgccaccgcgccggcgccgcgcccgcgccgttgcacgccgggaccgcgccacaacgccgcacggctcccgccgccggccgccgcacgctgcacgcagcccccgccggccgccacacgtcacgccgccgcacgcctcctctccgtcgccgtgctgtactgctgtgttgtggtctagggtttgcaggtttgggtggccaaggcgccaggcgggtggggaattgggggaaaattgcaaatgggctgagatgtggcccaattagaccacaggtagagaggaaagagggaggggagtggaaaatttaggcccaatagagaagaaatggggaaacaaggcccaatataagcagtttaagttttctttttatttttttaatacctatatgaactatatagtatatatacctattttttttccaaaaatcttgggtatacatttgaatacccatgaatacatagtgggcccgcccctgcaaattgcattacccttgcaaaagaattgataagattcatatttgtgcatcaatccaaacaattactggatcaattcaacctcaagtttttttccctgcctttattcttcgggtcactctccggcccggtgcctctatcttagtcaggctttaggaaaactagataatgggtttgtcgatgcagcatgcatcgctaaacaacattgactcccatgatctgcacctgtggcgaaaacaagaccaaagaggcaaagattgtcgcatcaaatgcaaatttagagactttttctcccttcggtctaacatggtgagtcattcgcttgatctgaaaatatagcatagagcaaatctggttgagtgcaaatgtccacatgccatgggcacagttagctgacaagaat

SEQ ID NO: 18438 - DNA, 742 bp, Oryza sativa
  unsure (1)..(742): unsure at all n locations
ctgtgccctttgtagtacannnnnnnnnnnnnnnnnnnnnnnnnnnnnnnnnnnnnnnnnnnttccagtaaaaatgtacagccagagcccatattttcttcatttttcctcttctttatctgctcatcttgattcattccacagaaattcctctgccaagggaggcttgagttagtgtgacatgaactacactacttgagttacacgaaacgatccaaaatgattatttgaggttgcacgatctactgctggtaaatgctttagttagagagagtcagtcacttgctaaaattgccaacaagttactagttcacttcacaagttcacatgggttccagccaaaatgtacagccagcccatgcatattttcttcctttttcctcttctttatcttctcatcttgattcattcgacagaaacatatcgaggaagacgaatgagcacaagcatttctattgctaaccccgtgcacgttgcagctgcacatctctgccaccagcaccactttgtttggaccggcccagatcaagaacgaatgaggagcaagtgcatatgctcctgcatcgaagctgtggcttgagatggccaaaaccaccaattataccacacattgacttgtgcattacatccagagataaaagtagaaaacagttgcttaccttatccggggttactgaaacagttctcatcaatgcaaaagacacaaaagttccctctccaatcttttctcccatcatgnatn

SEQ ID NO: 18439 - DNA, 1202 bp, Oryza sativa
  unsure (1)..(1202): unsure at all n locations
gggcaggagaaaagcaaggagggtagaagagatgaatgggtaaaaacagagaaggaaggaggtaaagaaagaatagagnggccgtcctccatgccaccggggcgcacgcgaaccaacgtggcaggaggagggcgccagccatgctggcgccgccccaggaagaagggcgccagcatggctggcgccgccgcctctattcctgtttctctgtatggagttttttgatgttttttcacactcagaatcacgatacaaccaaccacaaaaaaaatttaaactcgaactaccacttagctaagtctgaaaatatctagcataccacttagtctactttgcaccttcactaaaattagaccataactcttttagtaaaactctttgatcagcatgttaaacataatgcactctaccactatatgaaattacttaatctaattcaaaatataaccacatgaaatgacatatataagttaaatagtacatagagatgtaatttttttatttttatttcattttttttgatatttttttcacacttacgagaacataggaaccaaccgtataaaaaataaactcaaacggacaaaatatgtgacatgtagaattttccaaaactctaccgaaacggacaaaatatgtcatctattaaaataggcgtaactttctcatacggactcggaatcaggcaaataatatatgcacggacatctacagaaaaagttacatccgattctcccccgctttgtcgggttcgtcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaagaacatatcaaaaaaataaaataaaaataaaaaagttgcacatctctctcctctgtactagttcggagagaggagaggagaggaaaaattctacatgtcacatattacgtccatttgagttcaatttttctatggttggttcttgtgtgtccctaagcgtgaaaaaaaaatatcaaacaaataaaacaaaaataaaaaatttcgggggggggggggggttccctccactttacttcacctccactctaactctctctcctcttataccctcaatctatatttcacttttccgtct

SEQ ID NO: 18440 - DNA, 951 bp, Oryza sativa
  unsure (1)..(951): unsure at all n locations
ccccgcgccttgcttgcgtgncgcatcnnctataccaccaacncnagctcggtaccccatgccactgttagaccttcagtggtggaactactactcgaaatagccaaatactgtgatttgtatctgatggaaactgtacttgatgataagagtgaggtatgaatttcatagtgcatcctttcatttctttgcagttttatcatgtgagattttttatgagaattatcgagggaaatattgatatataccgtattaatagttctggaatttgattttgagtaggagaatgctctattggccctggagagtgctggacttttcaagactggtggcttgatgaaagaaaaggtgaaatgtttgcgttacttttagttattgtactgcgtttgtttttttgttcctctcatgttccctccattccccacgtcatttcaatgctgcattgagtaattattctcattttatttatggatggtagaacatgaatggcctgttttcaccaaattcataggaggatacagatgttagcagttacagtaaacgtttcacatgattgaacttttggtagaggcaactgatactaattgatacatgtgcatggaaatgctattggcgcttgcatatcagttctgcatatggagctgactttgtctggcactcatatcagttctgcatacccagctgagtttcagtccaagttctggctgagaaaagaagtatttctcctgtatattcagaaccctgaannnnnnnnnnnnnnnnnnnnnnnnnnnnnnnnnnnnnnnnnnnnnnnnnnnnnnnnnnnnnnnnacaagtgatctaaatccacgctgggggggtgggtgtgangnantgaattaagagaaaaaagcggtagagggcaagangcagtgaaaggattgtggtggtactaatgggtttactagttgcgtacggtagagcgtggggcgg

SEQ ID NO: 18441 - DNA, 4560 bp, Oryza sativa
  unsure (1)..(4560): unsure at all n locations
ccgcgttttgttaaatagattcactatttggcgaattcgagctcggtaccctgttctccttgtatcatatcatgctaaaataagtgatttgagcttgttcaccttgcttgccctttatatgatagtaatagtgtttacctttttttttttaatcattttggatgctagcctgctcaatcatatttctacaacagctagttcaggggaaaataagtttatgcctcgcctttttgttcagcttttaattgatggtgttgttttactgcttttgtgacataccatatgttttgatctgtccttaaaccactcggtacttgtaaccctgagcaacttagacccatgtagatgtaattttttctttctgacatcatagaacatgccatgagttcctgcagtactttaattgcatttgaattgaactgttcattttcattgtgtcatgttgtggaatgtctattcttcaggatccataccatggacctggtcaggcgatggggttgtctttctcagtaccagaggggatcaaaattccttctagcttagcaaacatatttaaagagctgcaaaaagatctaggttgcaccgtgccttcacatggaaacttggaaagatgggctgtgcaggtaaggcggtttgataaacatccgaataaactgccctgagtccctgacatttgtaacaacatgccgtttctcttatttttatcttaatgttaactcgtgttgcaaaaacaagaggatttgtatgcactaatacctttaacaactagatagtgttgtattttggggtctatatataacactatttggacgccatggagaccataggtctgttactttgagacaggtcttgtgaaggaaaaaatccactagggtctagtttgttcttattaattctatctgatatagaaagtggataagctgttattccattagttcttagcaaagcatgataaactttctatgactgttttttgggagatgttgtctaacatgggaaacacatgttttacagggtgttcttatgctcaacactgtattaactggtatgattattgttcccatttacattgaaaactatttttatttttgttgctttgttagctcttatgtattcataatcttgattaaactgtgatgtaacttgtaggttcttttataatcatgaccacaaaaataataaagtgttgcattacacataggcctgttttgggagcccacgatccatggcccatccacagagatgggctggggattacaggctccccaaaggtttcttccagttgctactgtatcacatttatttgatgttgcttgtcctcttcctctagcttagtgcaaagtaatgcattcctctgttgagaatctttattccatgggaattcactattgtgatcttagttgctctatccttgcacgagtttcttatcagcactgaacaatcctacttcttaattttctatagtgtcaatctataatcagagaaataaaacatctcttttgttgttactatattgctaggataataatgtaaacgctaaacaatttccttactgaaagctccaactagaagtttggttgccaccagctgtgctgttctgcatttccagcaggagataaacaatactaatatcattaccatgttagtttcccattaaaatctactctcagtatctgatctgcctgaatgctgtggtagaattgatttgtttggaagttgtatcttgttgggtatatttttgctgatttcattttcatcttgtcgggccagtgagagaacatcaagccaattcacatgccaagaaaggatgggagcaatttactgatgctgtcattaagacaatatcactgaagaaatctggaatagtctttattctctggggaaactcagctcaagcaaagacaaggtattgcttcgttcacatctgcaaatctgtgacttggaatgttggcgctatcaaaagaatattttgtaaaactggctattataatgtcagctgagagacaagagtacctgcatgctgttttgcagattgattgatgaaacaaaacaccacattttgaaatccgctcatccatcagggctgtctgcaagcagaggtttctttggatgcaggtttgttttcttgtcagataaaatgaactttcttcatttgtttctgtgagttaaaaaataagactagactctacataggagtaaaacatcacagaagggagagctgatatatttctgtaacttaggttaaatttgaatagcatacttcagagagaataaagactatgttacttagtataaaactgaattattatgattgttcagcacttgcatatcaggattgccctatatgcggcgccataatatctatttgatgctagacaacccaccaatggctggtatctttgttactgtagatgatttagtgggtgggttataatgatttatcctaagatcaactttaactcacctgcaccactatacaatggtactgtcggtccatgctgagtggtgctatactgctataaaccctcaatgcttttggccgtcttgtcctgtcttgtttttgccaacttgatattacttttgccttttcactcactagtgttaatggctagatccaaatgagcattagctcaggcacaacatatagaacgtgaattggatattggcatctcagatactgtttatggggccaattcaaatcattctaatgctacttttgcccttgtgattatcgttgaatcagcctgcaataggataaatttttattgatgatcgttgtgctgtgcttatcttaaacaggcacttttctaaaacgaatcagatcttggagaggctgggactatctgccattgattggcaactctagaccatttgaagacatcatgtggtctgtctgcctgacaaccacctcagctttgaaggtacttgttgcaaggaccatcgaattcggccaaaattttgtaggaccttaaattatatatggccgatcaaaatgctaatgtaattacgcagttcttatatggtatctaatgccgcaccgaaacatctaaattgtttcggttgtcgtatgtgcagctactttgcgtagcgcttgggcgccattttggtcgctttgttagatctgaagaattgcttaacaaccgtcctggcctttcaagttttttaaataccataaagccagatcgtccttcctcatctgggatccctttgtcctcttagattttgctcgtaggcctgtcaccaacccttagatcctaagaaattcccgtgctagagacatgtcccctcttttaattcgatgagtgccgcacctacgtacagagtgagtatttaaagcccgtgatgagcaggtgaaagggtacacgtctcgcacgatacctaccgtggctgtagtattttttgtacagcaggtggttgcctgcaaataattagacagatactccatgcttctagagcttgcagaaaaccggcacgtcagtcgccgtgtgtgcagccagagagtgacatgtaatactccagaaccgcagcgtaagcgttacaactccagaatcgcagcgtacgtacgcatcaggcatcgcaacgtgttagtccatccagagtccagatgctttgctgaaacttgacacacaaccatgcacgttgtctcatcagctcaaaccgggggcagtagaaaacgacatggtggcattccatgtattgacatcgcatccgatccttccggctccgtcaagtcttggatagattgtgattgtgagatcgatgcatcctcccgtcgtaatctctcggcctcacatcaaaattttaagtattccattccacggggcaaaatcaccggatctttgcagatctgcaagcgtgacttccatgtttcacccagctccatctcatgtttgataacatgactactaaatcgcacctacgtacgtacagtgggctccattgcaatggaagcatcgcaagtcgccgatcttggaaaagatcggcacgcacttggatggaagtctagcagcaaagcagccggtctcttgcactgttcgcaggtcgttctgaaagcgacgaggtgagctagctcctgcccaatctccttgattgtaccgtgcccatttgattatcattacgccctggggacatgatagcatgtacctgtggacgcaattgacgacctgagacgctgtacatcgtaagctcacctaccggtcccatgcatggccggtgtctgcgggcaaacgtacatgtcaccgtggacccgtattttatgttttcactctctagttccttaccttcttcactgggtgaatgcacgccacatgcatggctgatattctttttaggaaaaattggaaccatgccattatacttctttttaagtagcttatggtaaagttttaaaaaatatatacggagtcctataaaaaccataagattgtattcccaaattatagactcatcagctaaattaccattagctgttnnnnnnnnnnnnnnnnnnnnnnnnnnnnnnnnnnnnnnnnnnnnnnnnnnnnnnnnnnnnnnnnnnnnnnnnatccacctgtggtcagt

SEQ ID NO: 18442 - DNA, 27480 bp, Oryza sativa
  unsure (1)..(27480): unsure at all n locations
ctatctatagtcttgtttggtttttattataggtactangcacttctctcctcttagttcgtatatttcttatgtctctctattttaattctctgttcatttacaacaccnnccncnnnnncccccgcggttgaatgacacgtcnnnnnnnnnnnnnnnnnnnnnnnnnnnnnnnnnnnnnnnnnnnnnnnnnnnnnnnnnnnnnnnnnnnnaaactatttttggctgagctccagctccagaagaggtgaagctggagctaaagctgtgccaaacagtcccttcctttgaaaccattagctgttactgctggtgggtagatctctctcctgtgacactcaggactacagtggtaagtaccgtactagtgttccctattctagtaggggtccggatgagcccaaccccgatcgaccgtgccgatcgatccagccagtggcagcggccagcggcatgggaaggccaagcgtccgcgtcggcgctggccgctatcaagcggtcgggtggcggtccaccgcgcgagatctcccccgcgatcctgcggtcaaatcccccgcgatcgcgttcgtgtcgcgggcgaggcgcgaggcgacgcgatccccccgaccaatcaaccaccagaccgcgcctccatgccatgcaaaacccgcgcgagcgagccgcgagcgctcatggtttccacgcccacgtttccctcgtggatatgccaaatacgagagagctgtccagttcatttctatagagttttggatgaagataaaaattttcatgacacgttttttaaactgataaatagtgtgtttcgtgcgaaaactttttatatgaaagttattctaaaatatcatatgaatatactttttaagtttataataattaaaacttaattaattatacgttaataccaacttattttacataagtagattgatctttatttttatttttaagagaaaagaacaccaccgtagcctggtggaatgtggatggctgcctgccgttttgcatgacctggggctgggattggagtatttggttccacctgacggcaggtagccccaggtctcggttcttctcgcttgtcgcctctgccctctcgattgtatgcgcggtttgcctcgctcgtcgtgatccctttcccgtaatccccgagatttggatgcttctccatgggatgacagccatgccaacgccaacgccaacgcccatggtctggccatgcaacgatgttcagtcatggaggcctcaaccgtagcacgtgcctagttgcaccggacacgtctatggcctactgtggacgacagggtaaacttcatgtacgacatctggggttctcaatttgcatacactgtacacaacctgacagctctgcttgtgtcgtccattctacgcgaatgcgaggtcgtcattcattttcatctactaatgtactcccatctggtaaatgcaatgtgaccatgtgctgcacctgtttttcgtacaggagtgcttccgtttacaaataaatgacgttgtaaaatacgtgccgttaaacctcaaaaacttaaatatacaaatattagaacttcacgcgagcaggagcggatccagtatatggtagcggggtctcgagtctccactattagcgtgaagactctaagagccctgatgaagccctcaccgctattttttttaccatacatagatgagagagatgattgtagctttatctagtttgttttctggattcaccactgcacatgagaaaataccgtggaggtgtttggttcctagctacattttgccacgccatacttttagctgcaaagtatgactggtaatcaaacacaccctgcgtaaagtagttagaaaaagtaatgacaaaataattgggaaactattttaaactctcgaggagatatttcctcgttgtttgcatatcactcaaatggttatattttttttagaaaatcaacaagatagattaacatgtgacagatcattccacaaacatgaaatgtaaaattaacttctacatgttacaatgaaaaaacatttttttcgaggaaaaataaatttaattgcgaatatacattaactagttgtagtttaattttttttaacatgtaaaatttgaatttcaacttgcatatttgcagagtgattatatgctatacatcttcttaatttattttataactacttgagtgacatgaaaaaacgagtgaacgtttctcgagagtttaaaattcactctccgaaacaatatctactagtactatataatatacacatcaatacacatagttagagaggtagcttcaggtggcaatgtatagacctaaacgtacatctgattgggatcgtatgacatgaaatcagaggaacgtggtcactgacaggttaggcccaccgcttatgggccgacctatcaatgaccacgttatcggttagttcacgtcagaggaaccgcttccacgtacaccataattaagtactcctagcttaggggatggaccagttgttaaaaagaggatcccacgagaagcagcggccgtggcagtggcaactggcaagtagcaactgaaccaaagcacacagggtttactagcttagtttaagtacaacgcccccacctccccccgtacaccacgtaccacacacgggatacgatcccgtcgggtccccacacgcgccgcgacgcactctcgcacgcacgctacacgacccacccgggccgtgttgcgtgcgcccgtcgctgtctcgtatctgcatacggcctcggccatcaactctccccgtacgcgcgatcgatgcgtttggttgggtttttcccgtagagaatcggaatcgccagtacgctcgatctccgtctagagaaaaactgatctaggacgagatatgacgaactactatctccgttttattttaattgtagttaggagtttccgtattcaacgttttaccgtttatcttgtttaaaaattttttatgattggtatttttattgttattagatgataaaatataaataatactttatgcatgacttattttttctaatcttttcataaatttcttaaataagacgaacaattaaacattggacacaaaaacgacaactacatttatattggggcggaggtagtattagaccacccgcaatggtaaaataaggtgctctctataaaatatgtacatctcagcaatagattagattaatagtaaaccacctcaatagtatgtctacatgggtatctatagctctctaatccattgcctcgtttttctctatagactatccccagattagtagatagttttactctctctcttcatttaatctcttccaagtaggaaaatatgctgacatgtatctcttgtagagagcttatagataaccattgtgggtgcccttagggaaatttttataatggaggtgagtgccatatctaatttaaaccatgtcatattctcattaattaagaggtaacaagtacaacatgccacctatagttcacaaaccccaacattaatttactctcacatcatcttatatttttcttggagattgtgtggaggttgccccttacatgagaggtggctcattttctctctctcctaacttctctcctccaactcatcacctaatcttagggcatgtttagatccatttggaatggcaaatggcaaatggcaaaagtcttggtggcaaaagttttggcattacaaaagtactagttggtgtttagatgcatgttaaagttttgtcattctagcactaaagtgagagagagaaagagagagggagtggtcccaaagcactttttggcacaatttgctactatgtactagcaaatgccaaataccaaattgccaacttttgctactagtgtttagatccaaaatggcaaaaagtgctataaaatgacaaaacttttactattttagagaatctaaacagtgccttatgtggtaaatttaggggcaacatgcagaggcttatacttgcccttatacatttttccattaacgcatttaagatactgctactgtagccgattggtcatgtgacgttcagttggagcagtggtgactggtgaaattaatggtgcccggccggaagagtttagtgaccgtcttaaccgtgcaatgcaatcaatgcaatgtcgtcaagagaaaaggaaagtttctcatcaagctgattccattcgtgccgtttaagctagtactaattcaacacgaatttagacccaaagaaaagcgatttcactatcaatcaggatttggagtacgtgcaggttagattttgagtgtagagatgcaacgaggagcagacgagagacgacctgtcgtccagggaaaaaaaatgtttgatttatctacacaagtgaaacgtccatgcgtagcaatcaaacggagatggacaaaagaaataaaaatgtttgagtacatcgtttttaaccagtaaacaaatcaaggtcaaagtcagacgtgctcacacacacagctgaagcgatcaagcaaaaaaacatggcatggcatatcgcacagtgttttcgtggacttttcctcgcaagcaaaccaaaaactattccaacgaaccaacacgtccaatccaggctctccaactttgacgttccagaaaatcgcaagaaatcagaacagttcctgtacctgacctaacagttgctaaccaatctgaatgcatctctctctctcagatttttattttcttcagatctcttttcataatctggaattagcactgtacattccaacgacatcagggctgagaggccacatgcaatgcagggtctcttttgaagaatctgcttccaggtaagcaaatctctgagcagatccttccaccgtcttgtcatctcctcaattatcttatctatattatgctccccctttggactttttcatttgtttacacaccgtatacaacaacagctcacctaagacaggccaagaacatttgtggtattatttgtttatacgtatacacgctagtgcgatgatcacaacaagattgcgattatacctgtactgatacaataatacagcacgtacagatcatagagaaaagaacagataagagacccttttttttttcttgatgaattagtcatatacagggtagggcagagcagagcagacaagaaagacaatcacaaggacagaaatatgtgaagaaactatgatgatgatgcatggttaattggcaagacttaaattaatgtcaaaactctgaccgatcttgaaacagttaaaaagaacagattgatgctctggtgccatttcaacattgtgacaagagaaacctcctgaacagaagcttcagaagaatctcttctctctctgtttttttttcatggcgtctttgcagagcacacaggggaacaagcaaatgcctgacacctaatttcaattctaacttgctaaggcagtaaggctaatcatctcctaaagccccaaatgtttagcttcttgtttgaggcagcagcagaagaagaagaactatgtccaagaattgagaaagccaccaaaaaaaatcctaggagttaatcatcctctccatgatccaacatggcgagcgagcgatcatctgatacggctgcagagccgcgacacgtcggaggggcgtacgggcttgagcaggaagtcctcggcgccctcctccaggcaccggctgatccggttcggcacgttctccgacgacatgatcaccaccgggatctccttgagctgagacgattcctgcagcaagaaccacacacgaaacaaattcagtctcaagaaattgggggttccacattcacatggatcatcgcgataattcgatcgaatcgaatttaaattaccttgacgcgcttgaggagctcgtagccggtcatgccgggcatccagtagtcggtgatgatcatgttgacgttggggacgaggccgaggcagaggagctcgagcgccctcgtcgccgactccaccgtggtcaccctgtacttggagctccggaggatcttggcgatgacggcgcggtccacggagctgtcgtccaccgccagcacgtgcatctcgctctgcgcctcgtcgccggccgccgccgccaccacaaccggcaccaccttcctgtccccgccgccgcctccgcctccgcctgccctcggcgacgtcgccaccaccaccttcgccgccgccggagcctgcgccgctgccgccattgatcaactcaaaatccaacccaataatccaatccaagaatcctcgagcgattgagtaagcgagtaggagaagaagaggagaagaggctttgcggttgcaatgagttggaggcgcagccatcgctggcgtatatatacaggcggggtgatatgcgtgtcgtgtgactcgtaattagaaaaagaagaaaaagaaaaaagaaaaaataaatgggagaaatcctgcgagatctccaaagggatccgaggctcggggatcgagtaaaccccccctcaccctcacagcgggtggggcccacacccacacggctcgatccggggacgggatccgcggggtccacacgccagacaccgccaccccgcgatccgcctgggattttcgggcttggttggtttcgtaccaatttgtagccctaccaaattcatggtaggttcaatagtaacaaatgtatatttagtttgctatcaattttttgacacaatagtttaaactcaatagcatttaatttgatagtgtcaaaacttgtcaagatttgattttagcactaccaaaatttttggtaaggtcaaaattggcttcaaaccaaagaagccgttcctgcccctctctctcccccgtcgctttcgcctcctcctctcctctcctctcctctcctctgcgtgcgcagctgtttttcttttcttttctttttttttttggccttttgatctcctctcttcttcttcgcttttgaatgttcgcttttgaatgctgtggttgctgtgctgctgctcgcggtatcagaaggcgaatccgagagttgtttacgtgccggagatttgcatgcatgggtgccgcgtgcgattcttctctgcttttttttctctctcgattgcacaatccgcttttgattggtcttggatttagctatccggtttggctgatttagttcagttcaaataggattcgtcgatatccaaatccgtatcatcgttgatatgttggttcggaagaagttttgttctgatctcttctgcagtgcgggtttgactgatgatacagatcgcttgtttttaggcgtctctgtttgaaacacggttttttactattaaaaaaaatggagacttaacccgaaaggcaatacggagtgtgaaccagacaatgccaacatctgggagaggattttgtccttcggagattagcattcctgaaaggtcagctggctctttgctgggaaagattaaagaaatatactagtactaatcgcttctcctgatggccatatttgatttgattagtttttagtctgacaaaacctcctggcttctgggttagcaacaccctggacccgatctcctctggatgccacacgatcaaatcaatccatccatgtagtgtatcaatcagtcgtggcgtgcatggcaggatccgcgcgaattcaaagcccggtggttcaatccgttgccatcaccgccgatccgatccgatcgctcgctttcgatatcgatacgtatatcaatcgatcgatcgatatcgcggcacgtacgccgtccgatccgacgacgaccgcgacgccgcccgacgaggggacctgcaattaaccaaaggtgtaaacgtgtcagtccatatttgggtggctgtgttcttagattttttcgcgcatacgtattttaaacagttaaactatataaaaatataataaaaaagttgcttttaaaatattatattaattcagctttaaagaagttttatttaatacttataattaataatgtattagtaagttgcttttaaaaaattataaaaaatcattattaaagtaattttatttaatacttaattaatattatattaatatgttgttctgttttatgtgtcaaagggatggttctcaccggacacaaacgaacacagcctcaatgcctcataatacggattatccatttattagcactgaaataagtgggttcgtaaattgatccgtttacgtcctttaatcgacacccaatccgcatggctgcacgaatgccggccgaccgggcggccggccagctgcatcgacggcgagcagcggaacaggggatccattaactcctctgccgcggaaaccaatggggattcgggtgcgtaaattcgagagatcggtgtggagatttgctagctgctgctgtggtcggatggatggatggatgaatgaatgtcacggtgctgctgctcgatttggtcctataccaaaaggacagatcggataattgtgccagtaggagtagtagtagggtgcatctgcgttttctgcgatactctccgtgctgtgctgggcctgttcatgttcagaagatcaatttacggacgcttgagatcggaagcaatgtcctttgtgatcgtcctccttcaatgtgtccttcccctgtctctgtctcgattccaacatcggatttgacttagacaaaacgtgtatctttttatccggagtactccctccatccataattctgggacgtatttcattttttatgaagatcaaagaaaaatcagctcatcctatatgtaataaaaatcaagaaatatatacatccatgcaaacagtaagtattaagatagccacttaagtttcaatcaaccattaaatttatctttatttaagttttggatacatgatgattacaaatatgactatctcgtttaaagaaaatggaatatacttaaaacttttggataaagagatagtatttaacttgatcaacaacaaaactgacacatagcgacataggtggtgtttgaatctactgaagatgaaaattaagtgtttcatgcaaaacgaggtgttaatagcgtgtgattaattaagttttaattattacaaacttgaaaaatggattaatctgacattttagaacaactttcatatagaaagttttcgcacgaaacacactatttagcaatttaaaaaacgtgccactttaatacaaaatttaatccatccttttcattacattagaacagggcctataatagtatttctactacccgtaataacttcttacagaattaaagccccccaaaaaaattaacattttgtttagattctcggcttctctgtattctcacctgttggattcacaataactgtagaatataaagtttcctaaaggttgatatatatgtgtgtcagttttacaggttatgaatacatcctatacttatatttctaactaccaggaataccacatatctgatattatacaaaaggtatattcaaatatgaaaatatactatttaagaatggaaactccttcaagagtaaagtccatcaccggtccctaaacttgtaccgttgtgtcatcccggtccctaaactcgcaaatcgactgtttagatcctcaaacttattcgactgtgtcatcccagtacctaaacttgcatattactcgtttaatttctctaacttgtttagtgagaatagaagatgtcagaccccgatctgaataaggtaaggtcttttctgccaagttctatttgaacatgaagttatttacccgcataaatgcatagtttataaaaaaagttatttacccatataaatgcatagtagtagagaataagcaagttgtgcctacttttagagattttctgactccgcccatgcctattaattgcgatgtgttatatgtacacttgactccattgaccagttgctagaagatctccattgatattctacacgacaaaagtttcaggaaattattagccccgtatcgtggtcccatcagctggggcacatgctccctccctctctcctttttggataatattttcttcacgacagaaaagttcatggcttgatgccattgccgccgattcggcacgtcaggagctgcgaattccgtgtgcttttgcaggaaggccgtatctgtgcgcttgcttgcgtcaaccacgtatccgagcggattctcagcgtcgaaacttctcacctgtcgcgttgaaaagttttggttgaaaccttctcctcctccaactaccttgtgtgtctggatgtaaacctgcattgacctgtgaccccagcagcacacactggtcccctttttcatttctctttcgtttccatcttctcaggtggcctacgcttagtcaaacgttaacggagaattggaattaagggaaaaacaagaaacggtctattgccgatatggccggcagtggtatatatctgactatcttgatcacatgggagctgtatgatcatgctagtatcgttttcatttcgggcctctagaatttccgttcactccatggcctgataggaacagtgaagcaagaaaaaaaaagaagaagaaaaacagcgggcaggctgtggtcggctgctgcacctgcttgccgaagaggtctaatttaaatgggaatgtgacaccacataaggtaacgaataatattacacattaaatgaaacacgtgttatacgattgagtaatttgaaaattttagtttttttatacgatgatcattggtcatggaacggagagggagatagtactaatttcctaggacttcatactttatggtcaatttcactcgtaagcattaaccgacttgtgtaaaagttacagagagtaacatggacatgatttgttaaccatcaaatcatcgattggattatacagatattgctcataatctgaaacgcatcgtgcaaaaagaagagggagttggcaacgtacggtgcacgcagtttacaaaataaaacgacggattgagatatgggaggagaagctccaaatcggttttgcttgatcgtgttggatctgtgcacgccatcgatcagtcggtttggcatgtgacggatacggagaatctgggtgggggtgtatgtacagttcagaatcctcggcaggtcaggaattacaatcgtacgggcaatcgcatctgtctagcctttgcccttctttctcacttgcatttttcttttaaaaaaaagttggtacgaacaatcgcatcattcattccttctcactcgtacgtatgtttttttaacgtaatatttacaaaactaaatgtcctttatcgatctatcagaaaatcataaatttaagaacgtgtatgataaagtacagatttaacatcatatatttttttttataaaactacatatttaagaatgtatatactatagttttaactatttttttaataaaattgtagatttaacgtattgtataaaaacaacagatttaacatcggttttattgataaaggaacatattagaagggttcttaaataacttgttgaatgggtgaggctccgaactcagtttatctagcccaccacctcgtggagctagtcagaagaacctgggaatttcttactgtttttgtctctaggttctacatcatgggaagcatcgtcgcagcttgtgtcgatttggatgtcagtcattcccttgttctggtacgcagatctggtacagctaggctgcagctttgagtatcttgcctcgaaggggaagggaaaggagaagagcagctcgctcgctttctctgaaactgtgatactcctagataacgcaagcagaggcttttctctgaaagtgtgatactcctatagagaacgcaagcagaggcaggcgtgatctgcatgcaaacaatcacgccagccatgcccacgcattcctcttcttttttgtgaatttggatatgcttcccgagaatcacaagagtagtcggcgtcaggaggacacggtggacaggagtagtactcctactccgggatatgttcactgcggcaacctgcagctcaagttgcgagtagtagatgtggatggaccacccgggagagtggtagtaggagtagatgaggagatcgcggcaacatgctctcgtgccggagaatcgcatcgcatcgtatcgaatccttgccgctgctgctgctgctttcggagatagagatagagaagggctcgtttgcccaagtcatcagaacccaagtgggggcgtccggtacgagaaggggagatatcgtcagagaatcggttgtgctgctccacattgggaacagcatttacaaatcatccgtatccataaaaaagctcactactgctcctagtaggagtatttactattggtaccgtgatcggtgtacgttcttcagtcagaaacaacggcatctctctcaactctgatgatcgccgtagtagcactgacgatggacaacgccgacgccggcaaaatccaacgatatcaacccgaaaatcaaccgcatccgagataagttagaccactcaagcttggccgacgggaagcatattgcgaaattgttgtcattagaagttgaaaggtcttatgtgtaaacttatttaccgtcagaattgtacagttcttttccttttctttaagccttcggctgggtggcttgacccctatatcaatataacaccaaaccaatctgtttaggtgtttgaaaaaatcatccaagaagatggcaagcaagaaacggcggtggtggcaccggcgcgccatctgctcgatgccggtcgcgcgcctcgaaactgcgcgcgaggcggtcaaaattactcgccacttgcgtttgctactcatggccggatggtcggcatggctcacgtggctgattatccttttgctgctttgcggaatgcggatttgcttatcgccggagattgatgagactgcatcggtttcggtggcagatccctcgccctagagccgtacgcactgcacggcccagaccaccgatcaagatagtactccctccgttccaaaataaatacaaccatagttttccgtgtccaactttaaccattcgttttatttaaaattcttttgaaaaaaattaaaaaaataagtcatgagtaaagtactattcatattttatcatctcataacaacaaaaatactaattataaaaaaaattaaataagacggacgatcaaagttgagcgcggaaaatcatggctgcaattagtaaatctcattgtcatcctggcctgtcgaatcttgatcggttggtgagaaaaaaaaagagatctagagcaattacaagagtaggctataagttagttgtaaacacatatgacacatatatagagaagagaagagaagaaagagaaagaaagcggactacaaatttgtactcttgtcaactgcagcacgaactctaatacgttgtgtgtgtataaaaggtgcagtgggactatatattaatagtttatagataaatattgtatgaatgagctattaaattgactatagatgatttgaagctagtagttggctatactattaaacttggtcttaaaaggagatagtccctctaaacatttattaaaaataaattattcgtgtattgatgattgaacacaagatttcgagattgaggggttgtttggttcaatacttcaacttgccacaccacattttaggctgccacacctccttagccttgtgtttggttcattgccatagttatggcaagccacactttcttaccatcttacctcatatgtcatagacttaattctttgcctaactttgccacaagtgtggcttataatttgtaggccacaaaagtgtggcttgcataacattgtctaaagtgagttatggtaacgttagttaagaaccaaacagcccttgaaaccacatattctctccgtccctaaatataaggtattttggtaggatgtgacacatgatgtgacacataacacattctagtatgttcatattcgttatattaggatgtgtcacatcctatcaaaataccttataattagggacgaaggagtatcttttatcactgccctgtctagtgcatctagatcggtcggtgagacgactgtatgcacgactccttccttccattcttcatctcttgctttcaccttgtcaaatctcaaatataccaatgaacatgcgtgcagcctgtacatacacagtatgtgggttgttgtctgcaaatcctcaactgttccggcgaggcagtttcgctgtgttgagttgagtgactcgaaagtcaacatgaggggagctaatctgcatgccccaatattctcgagcagatcataggatcgaagagaatcgccacgtcagtgaattttgttgtttactagtgcagctaaatgggatccgtatcaggacgagccaatgatgcaatttccaattccgtagtcgatgtcaacgaggtttgattaaggggagtagtatttgctaactagtactagtatatagtagtattagtcacgcaacatagttgaattcttttaattttgggcggtcaaagtaatatggtttttaaactctgaagatgatgtgcttgcgtctggtgatcttgttactagtttaatgaagccatcggcattgtcaaataccgaagtagtcagctcagaattaagaaatgccgagacattctgttcatggtgagctactattcggaagacccgggcttcagtgtctgggttcagaaaccctccggagctggagagatttcatgagatattcaatgggattttgacagcaacatttgctcaaaagaatagcgaagcaatcttgacggttccagtttgaaatccatattgcattttttgtggtttggtcgtgtcaagcgcatctgctggaaaaatctgaaatgtagcaagtagactagacattagagcatctccaacagtctctccaaatctgactctccaaatgtctatttggccaactctccatctaatttatcaagtcaaactcgttgtttactccaacagcctccccattcaccctctctattctaagtctattacagtgggacccacgcgtcagtgtctcaacctttccttcttctcatctttctccccctttccccaagctctgctggtctgcccccatccgctgccgccatctaccgccggcgccacctaccgtcgccaccatctaccgtcgccgccgccactcgggctccatctccatccactgccgcggtaccgccattcgccgctgccgctcgggttttgctcccatcactcgccgggcgctcgggctccgccccctccatcaccgccgtcgctcgggctctgtccccatccactgccgccatccgccactcgggctccgctcccatccgtcgccgccattcgcggccgccgctcgggctccgtgcccatccgtcgccgctcgacggcgagggacgaccaagactacggtgacgacgacggcgagaggggagaagccagcgccatcaagccgtcgccggcagtagctagttgcgccgattgcaagtagtaggaggtgagagagaagcatcttcaacgtggggcccacaaatagcaaggcatttgggctggccaaatttggccattgaggggaggagtttggccagtcatttggcttagccattctagtagagaggctgttggagtaggatttttttgctaaaatggctaaattttaacttggagagcctattggagagtttgttggagatgctcttagtagttttatactgatttcgctatcaatattattccagcaatcttctaaaaataaataaaaggaaaataaaggtttaaattgaaggcttcaattgactagctcctcccacaaatgtcagtcatatatttacagcctgtcaaggcccattcaactttggaaaaatcaaacatatttcaagtcaattatttttccactatggtgtaaagaaaacagtaaataagcccctacttccagataaacttgagcatgtgttgacaaattgaacactcaccgtttgactccaccacaatagttttgaatcccatgacaattttttttgcaggaaagcatttttttcctcattgggccgggacaacaacttcgaaggcccaaacaagtgctgtgcaattacccagtgggccagaatcaaggcccgaatttctgcatatgtgggctattcagacctgtgcactaattcaaccgtttggttttactcagactagacatagatattagcccataattatgccacttttgggctttaggcccactaatttttgtctaattatagaaggcccaactgcattaatgccaacctaataaacagatacactatattgtgtcctctgaaatctgaaccccagggaatttcggtaccatctctggaaataagctatagaaatattttgaattatatactttaatggcgatatgagctaatgagcagcataaagttataatatacgcgtactaaaatagatggcgaatcaagtcgttcaaaaccaccagaattattgcgatcgagaacaagtgcaatcgagagaatctgatctttgctttcgagtcaacatgaatacggatcccccccacgctttgtgggctgatttctgacgaaatttctcaaaagaggaacacactgcttgatgggaataacaatcgctacaggcctacagcgcaggcgaacacatattcttcccccaattaagtgatgatctggcagtttcctcgtttgagccctgggagttattccgcaagactgtaaggctgatggcatcatcaccacctgcttacgaaaaccatttacttgggatgctaaaacttggagtcactaattatgcatgtaaatatttgtcaagtttagctaaagatttacaaatagatttaaataaatatatttctccttatgtgtttaattaagttattaattaattctgtgcctttttttgtattttttatttgctctttgtttagtgaacattgggcctgttcggctacactcatgcggcggtggtgcaactggccggaacaatgcttgtataagcagtttgtggcaacaataatgttgcagcagagccgaacaggcccattggctgcaataagtggttgcaatttatttgaacaaagatcaggatttgtttctttatagaaaaaggataaaactatatactcgcagctgaaagctctagcctggagagctcctttaaaatataggaattttgtttgataagttatgttctatattttctatgcaatttattgcattacaaacacggtgatcatcctaaagagctaaaattaccacattaattacatatatttttaaagatattagatcatgcaggatctaatgtttttttaagataatgtagattggtagttaggggtgggcagaaaaagaccgaaccgaaaagaccgagaccgagaccgagaaattcggtcctaggtagtgaaagaccgaattttattcggtcaattcagttagtctcctcgggtaaccgaatagaccgaattatcaaaaaatgtctaaatgcaacctacaatccactatgtttaataggattaaaatctaattttcacgtccctacttcttctaggcatgcaacctaataagaatctttactcataagtgcttacgattttttttttatgatttttgtgttgaaaatttccattatttctttgtatatatgaaaatattgttgaatttcggttaggaccgagaccgagaccgaatttgtctgtactaacatttttgcgctgaaattcggtcttcacttttcaaaaaccgaaaagacagaaagaccgaagaccgagaccgaaattttcggttagaccgaatgcccacccctattggtagcaatagttgtatgcaaagtacaattgtactacctccgtcccaaaatataatatttttttgctatgaatttggacacacagttattcagattaatagctaaaaatgcttatgggacatagggagtatatgatttcaatttaactagcccacgcaaaatcgtgcatggaagttccctagtttgaattaaattcctctgttataaaggaccatgatcatctctgacggcaagaattttttttgaattcaaaatatgtggctatttatatttatttcagatcccagagcaatgtactaccacaatgttagaggggggggggggggggggggaaaggagaaaaggacagctagggtggcatacatctccaatgatcacgggggtgaagtgaagtgagagtagcagctcacatctcggggagctggccaatgggaaggccggtatagcgggatgcatgtggtggaggcatggcctcgtttgcgtggagcttactttaggattaggattagcactagcttaggagtagctgctagtatgagtcaaccttaaactcgaaatgattaacgggtgatgataaagccgctccctaatgatgctgccccgcaactgtccagcaactatctggatctctcgctttttctctgcccctctccattactctatttcctcttcctcttggcactttggccttctttaatttattcagggtctaagatatttttgatgtgttttattttctacgactttaaatgtgagtagttgtcctagctcttaacacctttttaaaatgtaattctcctgggaacttctagttatttttcatctttttatcgtctctttgcttttaaccaaataaattgtactttccgttttaaaggatagcaatttctaacgactaaaatctaggaagtgctacagatcataatgtatctcatttaatttcttcaaatacttccctatttcaaccaatcataactatgttctatttaattttacactcatcactaattcttataaaaaataattataaaaatacttatattaattctaggatggatggagtatctctctttcccgacccatttttctgaattgtatcataaatgaaggatacaatcccatctaagttgattttaaattaattcttatgtgccaatgtaaacaaacttatgtttttaattaatcagaggcaacaaattttattttcggtgttagttaatggggttgcttttgtgcaacgtactgctagagctagagtgttaatgcctcctctcacgtcatgcgcggtggcaataatggatggatttggtggagtcgcgtctctttctcttttgtattcctacaacgtcttctgtacttaattctttccttgcgaatatactacgtatgaagcacatttttgggtgcaccagaaaacacctaagttatagcatgtccctgacctgccaatttggtaaacaaaatgtgcaaatagatttggaaatttccaagaaagtaaatgatgattaaatatggtttcaatcatcacccacaaaatttcaaaccagcaaacgacttggtaaccccaataaagtttcatttttcaactaggagtggctcattgatatctaagggctcctttgatttgaaggaaaaatatagtaattttggaggatttcaatactatagaaaaaaattcctatgaatgcctttgaatcaaaggattgaatcctattcgatccttcggaattcctatggaatggacaatattatagagattttggaggaaacttagcaagagctcaaagctctttgaaaatttcctttgaatctctctctcatatccgattcctacgtttttcctacggtttaatcaaatgatcattcctgtgtttttattgtattgtacaattttctattttatacttccattcatgttaaaatcatgtggttttttttattcttacgatgcgcccttaaaacccaccctatatatatttctcgtatcaatattagatttctcctctcgaactctaaattgccatgagatttatgactaattattttttcagtgacagacgacgcaccgaccgacatagagacatccttgatgaccttattaatatatacatataaagatatgttagttcaggctttcgtatatgctctagaaaagtttcacaagtttttagtttcaaatagacctatattatataactagtaactaagtaggccttccaactttcaagatgcgtaccatttgcaaagcgaattttatagcaagagcggtggtcctgtccgtccgttgggggatcacgtagttggcagctcaaaccagttcatcataatatactagtataataattatataaatatgccaaatatttaatactccctccgtcccaaaataagtgtagttttagcacggttcatatctaacgtttgaccgttcgtcttatttaaaaaaattgtaattaatatttttattgctattacatgataaaacatgagtagtactttatgtgtggctattttttaaaatttttttaaaatttttttaaataagacgtatggtcagaacgctaaatacggatatttatggctgtatttattttagaatggaggtagtaggttaatgttgttgctttaggggtaaccaagatgcatgcatgtcttttgccccgtaatcacctagcagcttgctgaaagtttaaggactgctccgtcgtgtcgtgctggccttcatgtagccactcatggagctttcatataatttatttatttagaggagacatataaaaaatgcattttctctccaaatccagcttgggacattctgaactttgacaatatatattatacactctcctggccgtacttatcctgggcaggctctaaccattggctgagactctgagattagaactcttaatctacttaattaattaaatgggatgcatgtgattgagaaaaaggtaattaagtaaatggtacatcaccatcactgtgtggacataagcactaaaagctgacgctaatggtagttaattatcgttccgtttgcaatgatcaagtctactagcatgcgactgcaacgtctcgtcttgttttgctctcttgtgttttgtctgcttgctgttcctgccatacaccgtattctactgtcacttggtacgtacgggtagttattttttaatgaactgtaactgttgttttagggagttgttagggaaaactgtgattattaagccaccggaagaaattaaagatgctaccactagcccctttacaaaggtgagataagctagactactggagggtagcttggggcccgtttggtagtgtaaatattttgggttgtggcctatgaacagaaagaactcgactggtgaacgaaaaataattttattttacagtaagacttttgtacttatatttaaaaaccaaagttaaatgatacaaataacaaaaaaaattattttcaaagttaaattccaaaatttaaaatttgttacggaagtactccatccgtccaaaaaaaaacaatatagatagggatatgtctacctaagacaataaatctggacaaaagattgacaagattcattgttctaggtggagttacatccccacccacacctaggttgttttttaagaacggagggagtacagcttaggtcgggttattttagctcatagcctatcaaccggttatttaatgtgtctatgctttgaaaagtgtgctttctcaaaaaaagaaatctataaccatatgtattgcttagataactttctgaactactccatccatctacttttgatagtcatatttccaaatctaaaaattttatttttgataagcatatttcacttcaacaacctatcgtcttgatgagtttctcggatttaatgcatgactcttcattcttccacacatgattggctacatgggcattgagaaacgtaaatatcaatgaatcgcttgtttacgaggaataactagtagcatgtttatatggatgataagtagaattacttattcttagtctgtgtgccaagatgaaatatgactatcaaaagtagatggagggagtattataaactttatgatgtataattatgtctatatatattcatgcatgagctttcgtgggtatttaggggatgtttagatccaggggtgtatagttttggtgtgtcacatcggttattatacaaagtatcgcatgtggtgttcgagcgctaataaaaaaactaattacagaatccgttaataaaccgcgagacgaatatattaagcctaattaattcatcattagcaaatgtttattgtagcaccacattatcaaatcatggagcaattaggcttaaaagatttctctcgcaaattagtcgtaatttgtataatttgttattttttaaactatatttaatactttatttaggtgttcaaatgttcgatatgatagggtataaaattttagaatgggctctaaacacccccttaagctaaaaacaacattgtctaaaggtggtttccgcagccaaccgaagccacatacgatgaacactgtgaaccacacaagggaaagtattcctcttgtccggccggtatatatatatgtacacatatatgcctttttataactttctagcacagcgatgtgcataccacagaaaggagaaagtactttgagtgacgtatgtggtgccgagtgccctgaccgtctcccagttgatggatcgatctgcacaattgcttatggatatcggtttcatccatccaattccaaacccaggcggaattcaactgaaaacggcggccacccttagtttctctgatgacgcagtagtgaaattacatcacagtttcgagatatcagtcacacacaccctgcaggttttacatattgatcaggattattagtatgaaaaaactacgaagtggcttaggctttaagacatggttagataaattattagctaattaagtcatgtcataatcatgctattgtcatatgcagttactagtactaattaatttccctacactactagatgaaatttgttagtcgctgtcaaaatggaagctgtgtctgctgctgctaagctgagtggaaatttggaggaaaagaaaggaaaaatccagcaggagggtgacaccgcggcgtacgggtagctgtcctgggggtgctggctgccagttgcgtcaacggcagatgcgatcaatgtcgatgcagagatgcaagttgcagcatgttggcgtgtcatgccgaaagaagaaacgggcccgcgtttaattagccaaattgtcacaatgcacccggcttcttcgccgtactatagtgacctcaaacgcatacaagaacaagttccatttcccatcttgctctctccaagttaatagtagtagccttctgtgtagtcaaaatttaaaatctgaaactttgattttaggattttttttttcttatcatagtctatttatcaaccataatttgttagccgctaattatacatgtataagttaatgttttacatatgaattattttcagttgcttcgtttatttatctttacacggctgaggcttatcacccgtagctcaaccaattagtgccgttaaaatttcgcaacaggatgtgaaattatattatttttttaaaaaaaaagattataagataaaggtaagattgtacagtcacactagcttgcctagtgttgagacatttgttagggccttagggcatgtttgcttcgtgccctgaaaaatttgtctaactcaggcacaactctcaggcgtccgattttgtgcgcccgcgactggatcgacctgcctgagcgagagcccccggaccagggcagcaaccaaataagcccttaccccttgcaagtgcttctttgcaacaatatggaatgtgtagcgagcagtgagaggaattttgcattggtacatccctggttcatttgggttgttaagacaacaacaatgaaatttagagttggtcccattttccatactgctccaagttagattggactactgactatactgtactagtagtctttcattgtctgcttgttgacttataagccacaactaattttagaattgattttgggacttttcaccatggtctattttcagccttaacttttaaatcactagttatgcgatataaaagtgttacccatgaacatttttcggttgcttcagttatttttctattgcttattagttgtagctcaagcgatcggggccatgagtaaaaatacttaatagcaggatatgaaatcaaactattattttttaaaaaggagagaaaagataaaggaaaaattatgcaatcacattaccctagtgttgagacatttgttatggacttgcaccttgcaaaagtgtttctatgtaacaatatggaatgtgtactgagtagtgagaggaattttgttttggtaaatcccttgttcactaacaacccaaatttgtaaatgtcattattattcataatactacttgccacgcgctactgaaattttataaagttaggatcatactactaaaattttgtaaaattagaaccatatcactgatatggttctaattttatgctatttttactaccatggtattttaatatttatgtaaccgatgcaccctaaaataatggttattttcatcagaaaccaattaaagataccattgcaatcacccgaaaatatgcatagaatccaggcgagaaaaaagaataacacaaaggttgagaaaagattggatgctccactttggtggattgtgggatgtgggatttcagatttggtccttttccacaaggtttgggacacgcagcagtaggccagatacgaggcactcttcttcttgtctcagcttctccttgatttcttttcccctctttttttttcttttctttctttggtccgttcaaaagtacagtggtgggccccggcgtgcctgtggtgttccccacaggggaattttgtgtcgccctcactgcttgtctttcttttgctttgccccacaaactttctcattgtttttctttttttcttttctatttttctatttttttgcttcatgagtacgctagctacatggcatggcatcctctcgtcatcaatacggccatacaagcaagccctcttggctcgtgatgatcacggccacgcgtacacagagtagtaaatttgttgcttaggtggtgtttggatcgacttaactttagtccctctatttagacactaatttagagtattaaatatagactacttacaaaactaattacataaatgaaagctaattcgcgtgataaattttttaagcctaattaatccataattagagaatgtttactgtagcatcacataggctaatcatggattaattaggctcaatagattcgtctcgcgaattagtcaaagattataaatgggttttattaatagtctacgtttaatatttataattaattttcaaacatccgatgtgatagggacttaaaagttttagtcccatctaaacagggtcttaattaacttgtgcattgttaaaacaatttgggatgcatatcgcgtacgataataatgagatgagaacaacaggaactatcagtcaatcgcaaggttttttcctggttgaccaaggcaaaaattaagactttgtattctatcgcggtcaatgggttttttgtttaagatgattccaaaacgtgtcgggctagggtggtgagaggtgtgtggatatatacaaacgacatgcgaaaattccacttgcaccggtgcaaccaaaatgcagctacatggaatcaatctttggtagaaaaaaattaaaaaaaaaacatgcccaaagtaataaaaagcacacataaattaagcacctaattgaccattactatcctataggtaggctaaaaacaaatctatgtccaatcattacatgacaagtaataatgtatgacaaacataaaagatactcctacaaacaaccacaaacacgctagcatgctttataacgaagatgtttgtataatgaccacaccaacaaagactgcacagataaaatagttctcccatactaggttagttgaccaagaacgttactaagcaacatatataatataaatactgaaattcaacatcatatttcgacgatatctaccatccaaatcggtactatcctagtaagcaacaacgacaaacccagttcgtgtctacccatcattcgaatacgttcatctgtatcgggtgggttcatcactacctttttccctaagatacatgataaagctagttctggatgaaggagctttttccaaaaagcaccacgcaggaaaggcgttcttcaggagatggaaaatggatattgccgtggaaagaattcacgagaagcaggactttgcccggttgggttggaagttggccaggagactcaacgagaacaccggcggcatccaaccaaggcctggtttagttcccaacttttttttcaaacttctaattttttcatcacatcaaaacttttctacacatataaactttcaactttttcgtcatatcgttccaattttaatcaaacttttaattttagcgtgaactaaacacacccaatcggtgcgtggaattttgtggtgtgtccatgcagcatttgctcgatcttggtgggcaggaggtttccctgtgacctgtgagagtccgtgccgccgcggctggccaatcaggtggcgaaacgttgcgcgtctcgattgggcgccgtgatgccttcaccgaaagcaaagagcgtcgcacgtgcgcctgccccatgctagctatagcaaagcctatgtaggccatgtttggatagctcttgttagctgtagcttatgtcaaaaatctcttactactgtcagaagttttctcaaactgttttaattatcatatatattctgagaatgtataattatacaatcagaaaataactagaagcttgagttcctagatttttcggattctcacaagatggtttctgattagctgcttttaaaaatattaagctccctaaggatagtaggacactggctattgctatccattgaagcccatccgcttcgtagcctagtttttactgcatggattggaatccttgtgggctcgcttcctcacgggatgttctaaccagatgggtgtactccttccatactcataaaggaagtcgtttaggataatgtttaagtcaaaccttgggaatataaatcatgaataactcttaaattattgagtttgaaaatgtaaaaattatatgaatagatttgtcttgaaaaatactttcataaaagtatacatatatcacttttcaataaatatttttatagaaacaagaagtcaaagttgtgtattggagaccgtgtcaatgtactaaacgacttcctttgtgagtatggagggagtatgtatagtttgtaggcaaattttgctacaggacatcgcgacttcgtggttttagctgtaggacactgcacgaagtcacttttggggaaagacactctcaaaatatggttatttgccaggggacactgcaaccaataaaatattcatttctggttcaataggagagctaaacagtgtaaaaggtcaaaaatgccctcgggcccacttgtcatattcttcccccaccccaaacctgggtaccgagctcgaagtcgccctataataagcggatcaactaccgccgcgtg

SEQ ID NO: 18443 - DNA, 3004 bp, Oryza sativa
  unsure (1)..(3004): unsure at all n locations
atcgctagtatcgagtaatggggttgttgcgggagtntacgcttaaccctattgttctatgtgaatgagttaataatcaatatagttttccccnnnnccgcggttgttgatcgcgtccatatagccgaancgagctgtacccctcgccgccatcgccgccggacagcgctaacccgcgaccccgagcagcctccgccaccgttcatcgccatcccgccgccccaagctgcgtccgccaccggcgccgtccaacaccctcctcggcgccgcccgctgccggcacatcacgcgacgccctcgtcggcgctacccgtccctgcgcgccgctgcccacgcccgtcgccatcccgcccccccaagctgtgaccgcccccggcgccgtctaatgccctcctcggcgccacccaccgccgccgcatcacgcgacgcccttgtcggcgccgcctgtccccgcgcgccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgcctccgtcttccgcgtgtgcctgcatgccgccgtccatcgcccacgcccatccccatgcgccgccgtcttccgcgtgtgcccgcacgccgccgcccatcgcccacgcgccaccacccacgcccgtccccacgcgccgctgcaacgcctcagtagcgacctcactcttaaaggaggaagagagaggaagagaaaaggagatgagggcaatttggtcatgccatgtaaaaagtaggccccttctcgcttagtcagcacaaaaatattaatttaatgaatgcagtgtcccctgataaataaccacattttgagagtgtctttccccaaaagtgacttcgtgcgatgtcctacagctaaaaccacaaagtcgctatgtcctgtagcaaaatttgcctagtttgtatcatgtactagtttcatgtatatattaatttattttttaaaattgtggtacaacatctttaacacacaccgataatatgaaagccagcgattgatcagtggtctcgttgaaatcctattgataacgcaacgccacggacttcaaaaaattttggcatagacatgttaattctttgacttgatccttccgtttagtgtttcttatgattcaatttttatacgtagtaaatgttttttaggattcaaattctatacacaatatatgtatttctagagtatcctatcaatcatctgtcgattaaatttctctctgtcataaatcaccctccctcctcgaaccacacctcatttaattaggaacactatagtaactttttctcagatctaatcttcactaaacaacctagaaatgtttatagatgagaagttgagaacggagtgagcaattgtttatttaatttctaatagtccttctttagccaaatgttttagaacgctgtcatagcaagatatttgcggctcacaaatcatcactttatgagaccgttatttctaacttaaagtatatattgcctagtgctttgcctttttatattggagttgcaaagattccggagaaaagttgtctttttatcacggtggctgaataaattatatgttaacacggaagcctattttgtctttttttacggtcaactataatttttctgacttggacatcatctgttctttttcttgagagtagcattttcaccattttcaaagtagcataaaaccatcatgaccggctaccactaagctgcgcctgtctacttgtcaagctctacaaaaccggtcacagtttttttatgtatatctcttctttccagaaaacttgctctcactgacaagtgggacaagccactacaccctccttctgggcccacctgtaagtgacccattcgagaatatttacgcgagggatctggtacgcctaacgataataccccaacggctacagttcccattcgtgattccacaaaagacagccagattcggagattcccctcgggaccacgtgccgaggcggcccatccggcccggtccggacgcatccgcgccgtccaaccgaattcacccccgcatccggccgtccactcgccgacggctgagatgcgtcccccgcctcgcttgatccgtttcgtaggccgacactttgcccgccaaatggcacgccaccgtaattaaccccgaactccgggggccaaatatctacaaaaacaaagggtatgggcgtgaagcctagaggtaggggggctactcgtagcctccgttttaagtacaaagactccgaaccaaaactccacgcgatttgtttagatcaaacgggttcgtaaaaaaaaagttttattctcgggttcgttgggttttatctatataggcggcgagcgagaccatctcattcagttttattccgcgcgcctcctaaatcgcgcttaatccggcgcatcctgattcagagagtggtttggattcgttggattcgaggtgaacgaacagggcgtggaattttcgaggactctctcctctcgcagaatcccgcgcgcctcctgattcggagagcggtttggatttggattcgaggcgaggaattttcgaggactttggcagcggcggcgggggctggtgagcttctgctgcggcttggagtctgcccccaccattgcgtggggaggtggaggtggaggcggtggtggcggcgggggcggcggaggacgatccttccgcggcttcggtggcaggtgagttcgccgggttgggttcggatttcgtctggatttgtgggggactcagttatgggtggtggttgcttgcggtgnnnnnnnnnnnnnnnnnnnnnnnnnnnnnnnnnnnnnnnnnnnnnnnnnnnnnnnnnnnnnnnnnnngctcatcaaggcgcgg

SEQ ID NO: 18444 - DNA, 7875 bp, Oryza sativa
  unsure (1)..(7875): unsure at all n locations
cgcgccccttttgtttgactatctgctnnnnnnnnnnnnnnnnnnnnnnnnnnnnnnnttcctggctcgatttgtgcaggtttgatccaaattgagcgccctgaggatttggggcgtgtttatggaggattagatcgagaattttggttgtttctgtgagatggccgccgattccagcatgggattccatcaggggatcacggcctcgatgtacaaccatcacatgctctccttccaatctaacagcgacttgggcggtggcgccggcgctgcggccggtatggtgatggccccgaggagcatgaacgggactagtagcagcgctgggctgttcgtctctccgaacaccggtgtgctgggcaacgcatcggtggccggcccgtcgaggagctcgtcgggggatgcgttcagtagcacggtggcgcccaagtacaagttcgtcactggttcgccttcagattggaatgaccgtgagctgaacacactgaaggaagggcttgtgaggtagcaaatccctattccccttttgctttctgaattgctattgcctgtgctgtgctagtgtgacttgttgcttgtgcggttgtggctgatggaattttggttgtgcaacaagccgttttttctcccctcttatgtttaatggagcatcaatccggaacaggaaatctggagctggattcattcaattgaaccctgttaccttttgagttgagagcaatatcaatgaatgttctatagcacttttgtgattatttagcgtacttgtagaatcattgttcttaaccatagaacgtctttttcaccgggccagcgaaaccataaaacgtcttggtagccacacttgagtaccttacgactatatgtttgcactatagctgattaataaagtcactatccggtttgtcaatcttatctggggaccagaccatttcttttcagttcctcataatttcttcaatcttactggcagatatgctcgcgaaccgaatatcatgaagtacataaaaatagcagctatgctacccaacaggactgtcagggatgttgcattgcggtgttggtgggctacagttaagttactcttttcaaatgtcacattatctcttctgtttccttgttaacatatatgttgattctggtcatgtgcaaattgggtagaagaacttcttaacttcgctaaaaattaagtcagatgtacactgaagaccaaaattgacaccacctagcaccctcaccacattgctcttttgactttttgatagaggtgcttaagcgcttcatatatttaattttactttttataatcctttatttccttttgtgactgatgtgataatttgccatctgccaattacattctagatgtaggctgactttagtcccaaactttttcttcaaacttccaacttttccatcacatcaaaacttccctacacacacaaacttccaacttttccgtcatatcattccaatttcaatcaaactttcaattttggcgtgaactaaacacacccgtattgtaacttggagtatacagcttttaaagttctagcaaacgatcaattccaacaggcatatcaagtatacacagcatttaaggccataataatgacctgccctggctgaaatagacactttgtttgtttgttttattcttaatacaaagctgttcattgtggtttcagactggaaatagatactttgtttgtttactcccgttaataccaaaatgtacaaagcttttgtgcctcccgtaaaatttggaaatagccaccatgatgcatgtagttgatatttagctgttgctgcatgcattgttttctcttacattgctcctccaacaggttatttgtttactggcttgcattagtatagcagctcatgcactgtattctgctcacattcgtttactgttacagagtaaagatagaaggaagaaacctgatggattttatacagggaaaaagataagagacatgaaggtagttttctatttgtaacttgtttggtgtacctcatttcttttgcttgtatcagccatgttcttttgagtttaatttctcaacagccaatccaggacaagatggttgcatctgcctccatggctaattttcacctggcacctgcaaacactgtgacccctttctcaatatcgatgcaacatacaaatcagcaatgtcaggttcctaaggaaggcaagaccacagcaataacattaacatctatatgtttgctttcttctgttcagctgttttagttcatctttattctgtactacaagtttgaggtttgacccacagtgtgttctaaaattgtgaaaactttaggtctgttagatagtgaggtaaacatcaaaacttaagacccatgttaaaaaaacaacttgagactcagtgtttccctctgtttaatttcatcatagaaacgtggttcacacacttacattgttgggctaacattaagtgtgtgtgtgtgtatatatatatatatatatatatatatatatatatatatatatatatatatatatatatatacatatacataccatatgagtagattttaatgctcttccaagaattcctaacaaactcaaattgcttgtgttcttgaggctgcttactacatttgtagtcagtagaagcatcctctggaagcaaacttcagatgcctttatgtggtgcgcatgctgtattaagattgtgtcacctatagatccccgtgcaaatacaagaaagatctaggacaaaacacaagcaagtagcagtgtttccaatttccatgctaagcaatcttttatatatgattatgaatccttggtaacatctttagaaactgtttttttcttgtgaaataccttggaaaatagcaattgttagctttactattatttcgtgatacaagcttactgatatcatcggatgctagaaatccacaactgcaaaagaatgggggttgctgtatttgatgatcatgtagttttgtccgtttataggtctatgatggaggaaaggttcatacatcccatagtaaaggaaaagggtgttgcgttgcaccctcctgtttatattctttgtgttggcctttcatcctttcattatctttcaccgtaaactttaggaacataatgtaataaaacaccttgggtttcattatcattttagatacctacaactatctcatgcaatgcaactgcatgcatcttatgatgtcttatttctcccaaaacactcatctggttccattatgtagaagttcctgtcgtggatagtgcaacacagcatctcctggaagaaaacaatcatttactcaaccaaatcgccacaaatatcgaaacattcaaggtttgtatgtccataaacttctcgcattttaattctaaagttgttgcttttgaagttaatgagtgcccttacgttagaaaaaaaagttaatgagtgccggtcaaggagcatatgatgcttgccaaacatcttaatttcattacaatagttggtttaaaagtcggtttatctattgaaaatgctgtcgtaatatgtgatcaactagtccttgccctgaaaatatatgcccctttaactgttatatttacggggcatcgtgtgaaaccaataatgtcatctgccatcaattactagatatggggaaacacttaatataagttggaacctgtcactctcaggctttatgaatattaaaaataaggcaggacaactggacaggtgtgggttaccatttgttttctttttaattttattatgcctgaatcctgagtttcttgcagacgggagagaacacggatctcttttttcggacaaacaacaacttcaaaaatattttaagcaggtaaagcgtcatttatgtgcccgccatgtatcttgttctttatatattgctttgaggacgatttttactcttcatgtccaaacactgccatgccatccattattatgttccaaattagataggagcccctagttaactataccatccattatcatgttccattatcattatcaaagcctgtaccatcttttatcattttgggattgcttcctgttaactggtgtttcttgttctaggcagtattcaatattcatgttcgtagaaacaaaatataatattttttccttttgtgctgcagaatgagcgagacgcctggtatcatgggccagatgccccaattgccagtgcaagtaaacgaagaccatctgagttcacttcttcagctggacagaatggtaagaggggacccgtaatcacaagagattcaaacatgtacgcagtatttttcagcacgttcatcaccatttacttcattttcttccctttgctcttaaagtagtcgatacataggatgttaacagcaggatcttgtaatctacatgccttaaccacaatgatcgacacccactgctaggttccttcgtatggcgtaacgcaaacctctcatatgaagcaagaaccgcgaagctagtataaacatacacgaaaacaaggacttgaaaaggaaaaaaaagagcagatggctggagctccgccgcccaagtttcgtgtaccatgaagaaggctaagttgccgcaccgagtgagcgagcgccaggaacagtcccggcgtttctttcttccagcgagattgttttccagtgatctgattgtctgcccgcctgcctacctgcccgagttgaaagctgttgaaagcaccggaaattgaggcctgcagctgcttgcgggggtatgcgcaacgggcgagcgagttgctgttgttgtacctggttgggtatccagcgaaatgaatacaccagacacttgattcgggagtgagtaacacgcacacaagtgactgtaaatatttggatggctggaggtgttcccctgtcctgttttgttctctctgattggtcgtcaatatatttttcggaagggtaccttgtatgtttttccactttggagagttaggagggcaccttatgtattattgcatagttggaagatcgtgttgataaaaccaacaaaaagatggctttaggttttgaatagaatgcccattgcatttatacttcgttctgtgatcgcccttattactccctcaggtcgttttgaacttcgtttatagtcaaacttcttaaaagtttgatcaagtttatagaaaattataatatttatggcaccaaaatctaacattcaatatattttaaaagtttttattgctaaattttaatataaacttaatcaaaactaaaaaaattgaattagaaaacgttcaaatgatttctatatgaaacggaggcagtatgagtaaccggccgcacgtactgcgctgacaactgcatccgtcctccgccaaccacatctgatcttctactctcttccccttttttttctccaataacagttagattaagattaagattttcgtggcacgcttttcaaactactaaacggtgcgtttcgtgtgaaaactttctatataaaagttgttctaaaatatcatattaatctatttttcaagtttgtaataattaaaaattaatcaatcatatgttaataccacctcgttttacgtaaaaaacttaatcttcatcttcatctatgttccaaaatactctagtagttcaaactttgttctaaagttccaagtaccatgggtaaaagtttacagtgatgaaatatctaaaatacatctcacctctaccggccaggacaattaataaaggcatttctacacttttccttcgcctccataaagaactcaagaaataattactattactatactatattttaagatggagggagaactaggatggacgccctatgggctagtttaggcaaaacacactaatcctgtgtgctagctcagggcacaattttgggaagttccatagtcaaacacgataaataatgtgtcagcaacatgttccaaattttcagcaggctattatgttgatagcaacatgttccaaactaacaggttattatgaacagaaaccaatgttgcgtgttgttgacatagtaaatactgcaactgtacaacaaaaattataatccattattaaaaagccgaaaatgacccctcatcgcacctcaaatagtactactgtacaatcatatacactccagaaaagaaaaatgcaagaacacccctttaatcaagatctgttactggacttgaaaaatgagccttgccccgtgcccgaaacacaaggaaaacatcctatctagcactaccagtgaaaaccactatcctgcaacatgcatatgctatgtagcaagcacaaaacattggaagtttggaacagaagctgtgtgctttctgagcaacgagcagtgcagcaaactataaaaccaccgtgagccatttaaaagccctccatgaacaaatacatatgcagttactttacaaaagatcaactggcaggatgatcaatacttgccttctccacggtaccttctgcaggtagttcttcaatagcaggtgtgctactggcaacaggactctctgcagctaattcttcaactgctggtaagttgttggcaataggactttctgcaggtagttcttcggcagatggtaagttagtagcaacagaactttccgcaggtaattcttcaaccgtgggtaagtctttcacgatagggctgccggcacctgagtttgcaaggtttgcaccggcgtggccaatgctgccatcggaatgagaaataggagtctccttaccaggagataccatttcatgctcatcatgctgccgtggtccattgagggcattacagtgcgggcagtaatatgtaatgaatgcaaagtcctctttccttgcaagacctgcaacagtgaatggtttattatatagaatctgtatgaaatattgggaagatagttatcactttcataccattatgcatatggcagttgccacatattaacgcatagcactgagttggatcttcccctacaagcagagcagctgctcgtgcgagccatcccccatcattaccagctggacctctgaagtggtcaacagtcctctgatttggagtggtgacaccttcattaccatcataggcatatgaaccgcctaatgactcagggccgtatgtccttccagtgctgttgctcaagtgtcctggttttctttgcctcggtccagtagtttgggcatcattacttttactcaatgttgcatccctattcgactcatctcccaagaagactctcaatccagaatcagcacccagtttagatgccaaaacagttgctgcagcagcttttgcagcaggatcaagatcatatctctgcatgaccaaaacgaagtttcagcaatagttagaagatgtaaacctttcaaaggggaagagtaaaaaaatagcacacttgggtggccataacatagagcaagtaggcaacaagcccacctgtataagttgttgagtagtgtagtaattcgttctctccttcaactcatcaatcttagcctgtctttcagcacggaggttttcaagagtatgttgatctctgttgtcaactgcaagatagaatcagtattgcagtttaggcataaaggatagggtgtattaattggagcagtttactagacgtaactcggttgttccacaaaaccattcggcaaatgacaaaaaaataaagtgtggaagtaacatggtcaactcaaaaacatctggagaatctggcaggaaacatggcagtctcatagtttttttttgtctccctgacttctagggataggaaaaatagctactccctttgtcccataatataagggattttggagggatgtgacatttcctaggactannnnnnnnnnnnnnnnnnnnnnnnnnnnnnnnaagngaatcgctactcaagttccat

SEQ ID NO: 18445 - DNA, 7534 bp, Oryza sativa
  unsure (1)..(7534): unsure at all n locations
acgcgctttgttgacnnnnnnnnnnnnnnnnnnnnnnnnnnnnnnnnnncccttatattatgggacgaagggagtagagcctaatgctgcattaacacctgaacacaacagaacatacacagcagtaagatacagcacaatgcagatgcaagtattccttacgcattttcgtgacgcttgtaatagttgagtaaatgagagcagctaaagcaggaatcaggaacatgggcagcacccgggttgctctcatctgccagctgaggtccggtgatcttgtagtcataatcgcatatccaacagccgcaatctgttccaaaaaggagaaataagcatttccttacacatacaaccctgtgaaaaaacacagttcgccctgatctaatctaacaacaggcatatgcctaatggtgtcactagaactagagcaatgcaatgcatcatacaatctctgacacgacatgaaaattgcagaataatacggcataatttatcttagcaggctgtatgtcatgataatcgatgcctaattagcttcccaaagctgtatcacatcaggattttcatatggaactggattttatcaatcctcgattttatcgacccaacctacaagcgatcgattcgtctggacgaacatgacatttatatttgctacaataaaggaagcagagcggaatgggattagccggatggggaacggcgggggagttgggaactagggatacctcgagcgcggcggcgatggcgaggacgttgtgggcggactggcgggaggcgcgggcgcggcggcggaggcgggagcgcacggcctcctcctccttggagagcgcctggagcagcttctcgacgtcctcgcgccgcccgaatatccccttccacacccgcgacacgagcccgcgctgcctcctcttctgcgtcgacggcgtctccggcggcgcgggggtccgcggcgacgccgcggaggccgcggccgaggcggcgtaggcgtcgccttctgccatggcagctcccgcgatcgggggcaggggaatccgatcggatcggagaagaagaaaacgctaagctgccctgcggatttcgtacgtgtttcttcgtggcgaattttcggaaacaaggaaggaaggatcgcttcgtgccgcgtttttggggaggaaaggcgagcggaaaggcgtcgtggtgaggtggtcggcgggcgtgcggacgtgttgcctttgcctctctctctccccccgtttttattctctttctcctcaccatctgcaaatgcaaatgttacgcgttcgtgtgtgttaccctatggctccacgacgacctggcccccggcagcctagttttgaattgcaatgggcggccagctcgtcggagttgacggccgcggtgccgcctacgacgttcgaatacggtgatggcgcctgaatttgcttactgcaaaagggttagcttagcttgtaagcaaaaatgttagcttggcttggaaccattcaacatgagagcagtttagggtgtgttattttcggatcaggatcctctgcaatcaactgcatcacgcctttgtgagatatagatcagatctggacccacatgtcatgcagcggatcttaatcctcacctcctctttaccgacttctatggttctaaagataaaacaatatagccctcatatgtattctatggagtacataccccgttagagagttgacataatacattagaaaacaacacaatagatttttcgacatttacaacaaatttctataagttgctttaaagtttaaaattttatattaatactttatcaagtttttgctaataattaattagtcatatgctaatccaccacttcattgcgttaaggattagttcctaacccacaataacaaaacacagcacaacttaatttcctcagcttgaggagcaatttccatccagcattcagtcgaaagtaaaccggattaccggaatcatcagctacagttgcttctattgcgatagaggtactagttcgctcgtcatggaatgaaagctacagaaactaataaacccaaaaaaaaaaagacttgtggcattcaatttacattttacaacaccattagatggccatgaactgcactcatccaacttatagttctcgctatctatgaggctaagatacagctatgagaaagatgggaacaacaggcacaacatagcacacaacatatgtgccaaccgcatatgcctccattatgtacctgaggattctactactagattggtgtcacagaatcacatgacaccttcaaagcttgaaacacgtgctgctgtagtcgccacgtttagatacgaacccccattatgctctggtttcatgagaagaactgctcaaggcttggagagttaaatacattacccgcaagttgtcctccttctattgaggaaacaaagagttggcaccgaatgaaccgctggtagcaaagaaacgaagataaacatgtagaacatgactatcagaaggcacctggtccaagaaaaaagaaatgaagatgcaagagtacatacagatagttgggaaattatatcgaggcttgtgtcaatgtgaaaatctgcctctaactgtcgaacaaatgaagttcgcccaacttcagagctgcagaagagtacctgcaatacccacctttttcactcaattatagatgtaggtgacagaagtaaataaattatttaacacctagatatttcagggttctgaatatacaggagaaatacttcttttctcagccagaacttggactgaaactcagctgggtatgcagaactgatatgagtgccagacaaagtcagctccatatgcagaactgatatgcaagcgccaatagcatttccatgcacatgtatcaattagtatcagttgcctctaccaaaagttcaatcatgtgaaacgtttactgtaactgctaacatctgtatcctcctatgaatttggtgaaaacaggccattcatgttctaccatccataaataaaatgagaataattactcaatgcagcattgaaatgacgtggggaatggagggaacatgagaggaacaaaaaaacaaacgcagtacaataactaaaagtaacgcaaacatttcaccttttctttcatcaagccaccagtcttgaaaagtccagcactctccagggccaatagagcattctcctactcaaaatcaaattccagaactattaatacggtatatatcaatatttccctcgataattctcataaaaaatctcacatgataaaactgcaaagaaatgaaaggatgcactatgaaattcatacctcactcttatcatcaagtacagtttccatcagatacaaatcacagtatttggctatttcgagtagtagttccaccactgaaggtctaacagtggcatgtgtctgcatcaagaagagtgcagatgattttagcatttcagcaattattggaggggcacataaccattggaagaggcattgctaaacaaacctgaagctcctgaggagttatctcctcaaagacaacaccaagcagttggcaagtcacctggataaaaaaaaaattatgaacttctgcaaattttaagaaaccaaatatgtatttcatttatttcaagtctgccagtatttatgattacaatttacagtgtcaagttaaatcactaaagcatttgctctttgtaactaagagtattatgtcagatcactatagccagaaagcacctaacagtttgatcttcgctctctagtggtaaacttatatcacaataaaattgtcctcattttttaattccttataccatttgctatggtcatcctcaaacaaagagaaactgacttgtttaggagtatatgtaagcctacaggcttaaatttcaaataaggtctgctctagatccttaaaatcaatcatggaaacacaggataaaattatgtttagggaattatttggtacagacaaagcatttaaaaaaacaaaataacccatcaaatcaccattcttcgtagctagagcagtttgagtgaacaattgaccccggggttacagtagaggctctacaagtttctttgtatcccggcaatttacaaatatttcaaagaaaataaaataataagcctcagatatttcaggtcagtgctttcttaataccacccagctgcagggaccgaccaccttctgaacatgccactaggctgaacttttctgcatgcatgcgataaccttagactcaacagccttaccttttgtcccgtcatagtacaggtagtaatgcatcataagttaatgcggctttctgtagtaattagtgatcaataggtggaaccagtgcattttaagccattgtcttctcattgatccaagattttacacgtgtggttgtacatttatggaagctaaattccaaaagttctcaaatataatttatctcaacattagacaatcaggcatgccaaacccaagcaatgagctgccacataggcaaattaaacatttatttcttaaacgcgtaattgatatcacatcatcgaagtttcatcaacccgctgatgacaaggcgcaaggagaaaccatacctttctacacccgcccagtcgcttcaccacgatttgccgtgtcgtcagctgccatacacacaaaccccaatccaatcaagggttgaaaaacccacaaacaaatagaacctagaataaatattatccaaaaatcatcacaccaatcagaggatcagaccaaccttcccaggattggcaggctcggccgcatcgcgagcggcggaatcgggggcagcagggccgacgagcggccgcttcggtccgggggggcggcgcggcctggccggcgacgaccgcaggaacttccacgcgaacacgacagcgatggcgaacccggcgacggccccgagggatccggcgctctggtgggggcacacacacgatacgagacgagacggggaagcccatctagggttagggttcgcgcgacgcgcgtgtaaaaccgaaactacgacgcgatgtttaccttgtggtggaagaggaggccgacgaggtcggtgaggcggcggttgagggcgcgggagacgcggcgcaccagcgagacggtgtcctggtcggcggcgaggcccggcattgcgcggggtgggggtggggtgccgtacggcttggcttgacttgcttctgccgcgtggttgggcgaggtgggggaggtggtcgtcgggggggtgggtgaggaggtggtggaggattggggaatcgccggattgggaggtggagacgaggggaggaggaggaggaggagaccgcgaaattgcgggggcgacgagaggaagcgagccggggcgtgatgagactgatgtgcttatcttcttggcacaggaagccacgaaaggactaatccaagaatttcttttttgtttatttggccttggccgtatttagatccaaacttcagtcctttttcatcatatcaacatatcatgcacacacaactttttagtcacatcatctctaattttaactaaaatccaaactttacgctgaactaaacacagcctagatccaaagtttttcttcaaactttcaactttttcatcacatcaaaactttcctacacacataaacttccaactttccatcacatcgttccaattccatttttgatatgaactaaacacactcgttccatgatgtttctttaataaatgttactttaaaagaaactattttcttcgttaatattatagcatcctatactacgtgtctacgtagaacacatcatactacaatctgaacggccgagtattagtttttttatattttgtgtcgggatagtattatttttttttctttggaaattcagaataaataaatacggtattgttttcatgatcaataagtgccgattcagatttttttttagtttgataaatattagctgtgtgctctgaagttgcatcaatgatgtagactttccggtttaactctgccctcttttagttgctggccaaaaacaaatctacattttagtgctcgtcagatcgaaactacgacgtatttgctgtacaaaaccagcttcagctgctttgaataaagtaagctgattgcttgacaatacctccaactcaagtgtggagttagcgtagaccacctggtagagtgtatgcaaataacatgaccattacaagctaagcacccaggctgaactgaaccaaccaacgaattgacctgtttttcattttaaaccagagctaccgatgggtttctgaacctgaatactcgctatgggtgactgaaatgagtgaaaacaaaacaatttatatttgttcatcagaaaagaaaatcattcccaaacaaaaaaaatccaactagaagaatgaaaacagtaacgtactacattaactgcgtaggcatatccgtcgaaacatgaaagtgaaactcagattgtaatacaatttcatttttttagataatgtgtaatcaattttctatttcacaaacatgataaacatccgattttaaactcaccaatcagtagaggactagaggaactgaactgaaacctttattaataccataccagcaggctcaatagtgtgactaataaacaagatgaacaagaacgtcttcagttttgcagtctctaaaatgaaactgggtcaagcatgtacgacagaacgatattgttgttagcagaggttactgctagttgcatcagtatagcacattcctctctgatcgtttgttcaattatttgataagataagccctaagaaaattaaccaaagcaaccaaatttaatatataagtaacatttttatatttgatttattaaagaactaaaagacacgtccaagtctagaaaccataggtttattttaaggatgaaataaatagtgctgaaaaataagctatgataaaaacaatcatcataatttatttaaaattgaattccgttgagcgagcaattgttgggaggcttgaaccatggtttaccaaaccattaagggtggtatatcatgattttaaaaactaaaatgtttaccacacgtgacaaccacgataaccctgtggttttgtaaatactgctcagccattagcaaagcgttcaagagggagagaggagcgtacactggttcgttgcatgcgagcgtgatcacgaatgccaccggactggtcgcgcctcggactggaggaggcgctcgccgcggcggcgctgctgctccgatcgtgctcccctcgccgcgctgtcctccgccgcgcgcgcgcggtccacgcgctcctcgtggtctcctccacgccctcgtcgcccgcgctgaccaccttcctcgccaaccagctgctctccctctacgcgcgcctctccgtcgtccccgacgccctcgcgctcctccgctccaacgccgcgcccctacgtcgacttctacaacaccgtcctctccgccctttcccgcgccccgagccacgcgcccgagggtttnncgctcttccgccgctgcacgcgtnggccttncgcccacggacctaggctctgg

SEQ ID NO: 18446 - DNA, 26364 bp, Oryza sativa
  unsure (1)..(26364): unsure at all n locations
ttcgcccggcgntgaccactttcttggccaaccaagttgctctccctttacgccggcttntcggcggtcncgaggccctggcgctcctccgttcacggccgcgcccctcggtcgtctcctacaacaccgtcctctccgcgctctcccgcgccccgcgccacgcgcccgagggtctccgcctcttccgccgcctgcacgcgtcgggcctccgccccaccgcacctagcctatgcgccctcctgcgcaccgccggcgaactgcgcgaccgtcgcgcgggggccgccgcgcactcgcaggccgcgacgctcggcttcctcgcgagcgacatcgtgcccactgcgctgctgcagatgtactcccagtgcggcgcgccgagggacgccaaccaggtgttcgacgaaatggcgacgcgggatggggtggcgtggaactgcgtgatgcactgcaatgtgcggtatggctaccttgaccgcgctctaggtcagttttgccggatggtgaggggtggattgccacccaccgagagcacgctctcgtcagtgctgagtggttgtggacgagctggggattgcctccgagggcgtgtgctccatggatgggtggtgaagttggaggagcttgatcctgacatgccactacagaacgcgctgctcgacatgtactcaagctgtggtgatctggatactgcactgcgcgtgtttgagagaattgagacgccggacttggtgtcatggaatactctgattgctgggttttctggagttggggatgggtgcagcgctgtgcatgcctttgtgcagctgaaggctgtacagttcgatgaacgagttgtccctgatgagtacacgcttgcagctgtggtgtctgcttctgctactttgcctgcaatgtttggtgggaagccgcttcatgccgaagtgatcaaagctggactggagaacagcgtgtttgtagggaacacactgctcaacatgtattttacaaacgatgatccccattctgcacggattttgtttgattccattacccaggaggatgtaatcatgtggactgagatggttgcaggccactcctcattgggtgagggagaattggccttaaggtactttgttagcatgcttcaggaaggttacaaggtcgacagcttctctttgagcagtgctttaaactccacgaccgagcttgcaggccttaaacaaggagagatgctccatgctcaagtggtaaaaagtggttatgaaggcaatatttgtgcctccggaagcctagttgacatgtatgcaaaaaatggtgctctcccaggggcttatttggtgtttcgtaacatacaaagaccagatttgaagtgctggaattctataattggaggatacggtaaccatgggaattctgaaatggcatttaagttatttggtgagatgattcgggatgggctgcaacctgaccatgtaacttacatctccatcctctctgcatgtagccactgcggactagttgagaaaggaaaattctattggttctgtatgatgactgatggtattgtgcctgggttcaagcactacactagcatggtcagtttgttgggtagggcaggtttgttggatgaagcagttgatttaatgatgaaatcccctttcgccaagaaatgccctgaactatggagaattctgctaagctcctgtataacatttagaaatttatccattggtgttcatgctgctgaacaggcgctagagcaggacccagatgatatttcaacacacatattgctttcaaacctttacgcctctttaggtaaatgggactttgttgctgaaattaggaaaagaatgagagggctaatggctgataaggagcctgggctgagctgggtcgagatgaaaaatgtggttcatgtcttctctgcagacgatgaatgccactctcatatagatgattgccacagcgaattgcttagacttaaaggaaacatggaattattggatacttgtgaaaatgagttcatgtcaagtggctaagttgcatgaacagattagaggatttcatttgcttcctttggtcctatgacttatggcaacaaaatagacttatacaagattttgagcataagaaaggtattatctgtgaagggacaacctatcgatttaatggttccaactttcaaattagcgctcccggcagcattggaggcaggaaagagacactaaaggtatcaagctccatcaaacaagatatagatgtgcaaataacccaaaaaagggacagaattctgggtcagtgctctagtgtctttctccgttacatcaatgcaactgcttgctccttttttgtgtatatatgtgatcagcagcagcatttcttgctatggatatgttttgagtaaatttcagaaaaccctctgttttatggtcacagttacagaaaaccacaggtattatgacatgcggcacctaaccatataggtataacagttctaaagtttgacaaaaccctacccttatgcattttgagcacagattacttacaattctaaatcatagtgtgtacatgaaaattttaatttttaagttcttgactaaggttgataattaaaatttttactaattcaaaagaattgttcaagatatgcaaaattaggcctagttctatttttcaacttcaaacttcaactttctcgttttccgttagcacgcttttcaaaccgttaaatggtgcgttttttaaaaaagtttttatacataagttgtttaaaaaagcaaataaattcatttttgaaatttataatacttaatacttaattaatcatgtgctaatgagatttctcgttttgcgtcaaaaatctatctgccaaacggatgatcaaacggggccttaatcaagatttcaataaatgtggggttttatgaaatatttagaccataatacatgtggttgtgtgccacacatcataatatatgtggttttctgcaactttgatcataaaatgtgagattttctgagttagctaaatttccatgttgccctttttaatggtctcaataattttgttgttgcttgttgagtactatctgatattgtttctgacaagagcttcctcagtatatgggttacacatttttcagtcttgatatttgcttctatgggacattatgtcaaagttatctcggtaaatgttcagttttaactaacggcataaggaccccggacttcagagcaacctgtctcaatcaagccgttcataccatgcaaggtgcctgaaatctgaatcaatacttcctttgttggtgaagcatagcactttagagtttgatttattaattcattttcttttgtttcagaactttagacagctgatactccatcaatctgaagtttgaatatctcaagtttctctgattcggcaatcatccagatccatcattaatctcttaatatgcatagttaacttcgtctgctgctcatttttcaccatcaaattcctagccagtgcttcgtaaagatagtaagatggacagtgaagttcagggcatattgcttcttattaaaagcttgttttagtgtgatatggcaaatgaactaccctgaattctggtttcatgaatagattttacacaattatttttcttctagcctgcatatagtagttgtagcttcattaggcggttaaaagaaattttagaagcttgaactctgggtccttcacgtttatgatttgttcagatttagttattgcagtatatctctttttaaacttcgttagctaacgcctgtctaaattgcactgttcagtgtaccagttcagggttctgccgaaatcattctagggccgtgtttagttccaaaataattcttcaaacttcaacttttccatcatatcaaaactttcctacacacaaacttccaacttttctatcacatcattctaatttcaaccaaattttcaattttgatgtgaactaaacacatgcaagtcttacagtagcttctgggtgtattatagaaaactgtattgtttgatactagcacaatagctcaagtaaagtaacggctgtgcgaaagtgcgaaaccaaaaatccagtccacgctgcaaaacaggtcaatgccacctactagtacttatttttcccatgcaaccaccgtgattcaagaataggcagacaacccacgctgcgaccggcaaggttgtactagaatttaggctactcaacattcatcatgactactcgccgttgtttgtgcggtgccctgcaggaaatgagcctcctttcccatttctgcctctgcctccagcggaaggcgggaagctgctgccgttgcatccgcttcttacatgtgttcgtcttcgtgctccacatccatggcggccactcccagatgtgcgaccccgccgacctggcgtcgcttctggccttctccgatggcttggacaggatgggcgccgggctggtcggatggggtcccaacgacacctcctgctgctcgtggacgggcatttcatgcgatctcgggagggtggtggagctggatctctccaaccggagcctctcccggaactcttttcggggcgtggcggtggcgcagctcggccgcctgccgtgcctgcggcgcctcgacctcagcacgaacggcctcgttggcgcgttcccggcgagcggcttcccggcgatcgaggtggtgaacgtctcctccaacggattcaccgggccgcaccccgcgttccccggtgcgccgaacctgacggttcttgatatcaccggcaacgccttctccggcggcatcaacgtcaccgcgctctgcgcttcgccggtcaaggtcctgcggttctcggcgaatgccttctctggtgatgtgccggccggctttggtcagtgcaagctgctcaacgacctcttccttgatggcaatggccttactgggagcctccccaaggacttgtacacgattccagagttgaggtggctaagcttacaggaaaatcagctctctggcagcctcgataaggccctcggtaacctctccaagcttaccctgattgacttgtcatataacatgttcaatggcaatatccctgatgtgtttgggaaattgaggagcttggagtccttaaacttggcttccaaccaattgaatggcacattgcctctatccctgtcgagctgcccgatgcttagagtggtcagcctgaggaacaattcgctgtccggtgagattaccattgactgcagattgctcacgaggctgaacaactttgatgctgggaccaacacgctgcgtggtgctataccgcctcgccttgcctcgtgcactgagttgaggacgctgaaccttgcaaggaacaagcttcagggggagctaccggagagcttcaagaatttgacatcactgtcatacctttctcttacggggaatggttttaccaacttgtcatcagcattgcaagtcttgcagcacctgcccaacttaactagcttggtgctcaccaataacttccgtggtggtgaaaccatgccaatggacggcatcgaagggttcaagagaatgcaggttcttgtcctggcgaactgtgcactcttgggcacggttccaccttggctgcagagcttgaagagcctcagtgtgctggatatttcatggaacaatttgcatggggagatcccgccatggttaggcaacctcgacagtcttttctacatcgatctgtccaacaactcattcagtggggagcttcctgcaacctttacacagatgaagagtttaatttcaagtaatggctcaagtgggcaggcgtcaacaggagacctcccattatccttcgtcaagaagaattcgacttccactggtaaaggcttgcagtacaaccaactcagtagcttcccgtcatcactgatcctctcaaataacaagcttgttgggtcaatattgccatcctttggccgtctagtgaagcttcatgtgctggacttgggctttaacaatttttctgggccaattcctgatgagttatcaaatatgtcgagcttggaagtactggatttagctcacaatgatctcagtgggagcataccatcatctctaacgaagctgaactttctgtccaagtttgatgtttcgtacaacaatttgtctggagatgtcccggcaggaggccaattctccacgttcacagaagaggagttcgcgggcaatcctgcgctgtgtcgtagtcagagccagtcatgctacaagcgggcggtcacgactgaaatgagttctgagacacgttttacttttgggctttttttgaccgtggaagctggatttgcctttggactgttaaccgtctggaacgtactgttctttgcaagttcttggagggccgcgtattttcagatggttgataatttctttgataggttttatgtgataacaatggtgaacttgaacagactcagaaggaaatgggaacataaagatcatccttaaaacaaagtcagacggggttctccactagttctaactaggctcttcaatcgaattatgtactctgtatattgtatttctccagcttttggtgtcttgattgttttcaactcaggtgtcatttagcagtgctgctttcacatcgtattgtagacatgatttccatttggtacagatgtgccagtgttgatagctgcgtggtggatacttaagcttcaagttgttctctctctctgtaataactgtagctgaacaaagccgttttgttaatagagatgggagagctcttcttctcttttatatgactagtataatgtcggtgcgctgtaacggaattgaaattatgatgttcagttttttttgtctatgcgttttgtaggttcattttcatgttgaaatactggttttttggtggggtggtctactactctactcttggggatgctcttttagtaggaggacgacgactccgttggctctccgcaggcttgggccgtaaccttcaggcctcgttttgggcagttcttttctcggcctatctacgcctatgggccaatgagggccctattcaaacgaagtctgaaatggcctaataattctttgcttggttgggctgggacctggggagtctaggagtggactacttgaagccaggtgagtgaacggtaagcccgtgagaacgaaacacatgctcaagtatggttgcagctctggacggagaaggcacatgcgaatgcgattatacaggagtcaaaacctcatcaacttgcaggattattctgtccaatctttatttaatcatcacgacaggccagctgtagattagtgctgctaagtgctaactaaccgatcagcttgtactctagctcagcttcacatgaaaatatacacagactgcatgcaaatcaggcgaggtacgcacgcgacagataaacaatcagagaaacacatgcatataaatagccgcaagttgggacttcggctgcaacaatccaacgcagctgtttttatactagtatttctgtgtgccatcacagtagacaacaacctttgctttctgctccgccgaatttttccagttcacatgaacatactacttcgactgcagcagcatcgatacactgcacaagaaatttcctgcgtctataagcggtgcatgcatgatcagaaattcagaattcagagatgcagagaagaccaaaatggagcaggcccgtgagtgggagactggagagtacgagtaatgggcgtagctcaatcagccggaaatttaggttaggtcccactataatgaaccgactcattgagacaaaaacagaataatagaatggattattatactagtacagaacaattattcacatcggaagcaattatgcaatgcattttgtgatcttaagttcttaagttatgttgatttcggcgatttcagtgacccatctcacagctgagacagtgagcagcaaggtgattactgtagataacaggcagcttcatatctcgatcggttggctggctggttggctccagatcgacggcgatctcattaaagaaagtaatggtcacgcgttgctccaaactccatggctggcacgtacaggtgcacgaaaactgcaaacacacctacctgctacagtacgtacgcggtggacacacaagtgcagtacagacgatcgacgtgagctgagctctcccaagtccccaactataatcttttttataccgacaaattaaagcgtcggattagcggcgagtttgaacgtggtagccgcatgtagtagtagaatccaggcaaggacaacgccatctgatgggaggacccggaggagttggtgacgcgcacgcggctggagtcggacagccggagccggtggccattttttgctcggttggcgccgcgagcgcgcaaggcggatgcgtatgcgcggcgcgcgggaggagacgggacgggatgtggtggtaggggtaggtggatgaggtcggttggtggggcgcaaacggctcggccatctcgtgcccgtggaagactgcagtgtgcaaccagtagggggtcgatagctacttaggccatccctaacctagaaaccatctgttagatttcatacttgtagaaactatctatcaaatggatggtgtcttcaaattaaattctcatccaatcatctatattctctctccttttatgcatctatcatcttgtttttattcttggttcctgtgtatagatgttttcttgtatgagaaatggtttcttcatctttttacatctctcctcattaactcttttgccacatcacatttttgcttatgtggcaatgtattaaatgctatggacactagatgatatagagggttggggatagccttaaccggaggcgactacgatccgaacatccgacaaaagacaaaacatcggacgacgtttttaccatctgtaatgtaaagaaatgttgttttattgttaggcaaaacatgttttgacaaaaaaaatgttaatatattgtatcacccagtcgaaaacatttcatcgttccataaaaaaatgtttcaatcaaatgcaacactaaaaaacaatgacgttaacacaaaaaatcaaataatgtaacgtctaaggaaaaatgactgctccattaagaactcatcgtaccatttacagaacaaaagagactgtgtttgtaatattgtaaacattatgtgtaacatcgaagaccatggtgtgatgtgcaacatcctcgcatatctagttgctcccatcggcctcacctttatctacatcagtgtcgctttttcaccttcttcttggtgacggtgagggacatgttagctataagaagtctcctacgcgaaaccatctctactgccttcctttgtctctccatggtagcctcattagggaaaatgagggatggtagaggatatagagggctagaaaagtagaaggatagagaggagccttgggaggagggggcgatagcggtggcttgatgacgaggggaaagcagatgttgactagacataagcttcattgcagtaagaatgagttcatcatggaggagagttagtgaaatatatggatgagtaatttacagatttttttactctcgtattggacgaccggttcgaagcatttttcgtaactaaccttattaatactcaactcatttgaacttattttcctaattgttgagttgtgatccaaattcatttgcacttaataaaggccagcttctgccgtagtggagcggaggtccgtcgccgggaggcccttttagggttccaccatatatatacctcttgtaaaccaccgtgcggcgttgtaaccttacctcagatataatgaagatattttgctggctggtgcccgtggttttttctctcctgttttgggagggttttctacgttaaatctcgtgtctttgatgattgatctattgttttttatcgtttgttcgcctatcgttttctaacactaataagccaacttggctcggctcgtgagcttgatcgataacaaagctatatttcattcactaaccaccaaagaattcaataaatacatataatttgaatataattaaatatcacatgctacctatatatacgatgatcttttgtactaaggctgactgacttgggaagctcaccaactaaaacctcagtatacataactcgactcgagtccgagttgaaatgagccaagtttgatgcgagcctttgtttttctcccccacaccctactgtgcaatgcaagtgcaaccgacgatcgctgtagttgtacgtgccagagggatctaaagcaaagatccatgcatgatacacgtacgacatggccgcttttctcgcgcacctttaccgtgcacccccagcaaacaccggtcacatccattccatgattctagcgctttagattgaatagaggtcaatggggtcatcctaacgtactccctccctcccaaaaagagacaaacactaatttatttgcccaacgtttgaccgttcgtcttatttgaaaaaaatatgaaaaaaattaaaaaaacaagtcacgcataaaatattaattatattttatcatctaacaacaatgaaaatacgaattataaactcagggtttgactttttttttgggacggatggagtagtatgaactgtcaaatccatgatcccccgttgttgggtaattccactgtagcctgtgacccggaccgacgcaaatttactccacaacaacggaggcgaccgagcgcgacgcggccgtgagccgtgacgagcttgttcccccacacggccacggctgccgctccccgtgacgacaacgagtgtagcggccgcgagagcgagagcgagaccgtggcgcggccgcgtcgtggcgctctcggcttgcagacgagacgacgtggggcgcgcagcgcaggtggtggacggacgcagccgcggaccatggactacgctgccgcggccacagcccacaggagaaagccgagcgctcctcgtctgaccgttcgtcaccgtctcggttaccgcgcacgcttggccccacctgtcaggcacacaccagttaccgatggctggacgctgtccatggcagtatgtaccaccggccgaggcaactggggtttctggctctgtggaccaggttcacgcctcttttggcttcaactgtggtgaggtacaggacaggtgggtcccggatcccccaaagcgcaacgacgcctcgtgaactaaacccacggaaaccaaaccagattaccagaaccgcttcttcttcttttgcttcctccggtatcattccagttttgctacctcctcacttcactcctctcatctcatcacatctcatctcaatcttttgcgccattccatcggagctagcacccagcaactcacgagcaagcaaatcaggtaataaagcagcatcctcattctctctctctctctctctcttgtgctttgttgtttgattgcatcttcttttgggggcggagaatcatacgcattccacgggccctttgattccagggctcggatccggctgttgtgcatggccaagctgggggcttgtgttcgtcgtgtgtgattgggctgcttgggttgtttgctgcaaaatctgtcactcgttttgtttgggttcttggcaatgtagctgctggttttctatgactggtctcaagttccgagtttaatgcaatgcgggagggatttgtgaaattacagcaatttcttaagctttttttccttcttggtaggggtacatgccgtggttaacattcttgttagctgcaggctgcggctgatcggtgaggcgagcactaagagtatttttgacgtgtttaccggaatgtatttccgctattgctccgaaatggttggggttttcagtgttatctgtgagaaaagattagtcttttcttttatattttctaaaaaaaaggatcagtattttattgctcgcgtgaactgcatttgcatcagttctgctttttatttaaaaaatcgttgttagtcctgctctgccaaactaaagttttagttgctttgtacagagtattggtccaaattgcattgagcattttcagcacaaattgatactgataaactgctgcgacctacttctgcaggtttagatagcaaggaggccgcagagaagtggagaggactcacgaatcacgatccatttctatcttgagggaattggggatagcaaaagtcagtgaaaaggtactttttagttctgacccatttcttacatcgtcacttttattaagtgtgtgcttcagattcctagtggtaggaatgacccaacaaagaccatttccaactaggttatgcactgctttagttttagcattatgtgtggtgtagcttgagagcatgtgggccaattgggatgcatttgctgttgttaattttacctatccgtttgtcttatctgctttgcaacattgcatacatatggggatcttgcacggttggaaaagacttcacaatcttggcacggccctctcagatcctacttattggctgcaatattcgtatgaaatgctagcttgatgcttgttcttgtgtttcttactcctacctatctgttttttcccctttagtttgcatcagttagtcagtttcattcatttcatttgtcatttgcttgttttcctgtctgtagttggcgtgttgcacgtttcacattcgctgtggggtaagcttttcttatggaagaaggtttactgcaggttagtagcgctattgtatctgtgcatttttctttttggaagtatggctactttacttaatcgtattgcttagacattgaaaggttggattagcttgaggagattgtataagaaactaatgatagtgcgatactgaattgtgcgtgtactgcatcatgattgctgcagtaagataggtgcagcctttataattagttggtttggtctcaaagcttacaaatgaaagcttgtaagaaatcattatgttccgtacaattgttctggtgctttaataatgttgttttgttgtgctttgccaaatgatggtttgcttaccgttactaatagagagtatggagacgtcctactagtggttggtaaagcatgttagcacacttttccatttggtgctgtataagatgatagtacaataatataatcatattggcagatggggcatgttattagtactttgagatcttatggctactaaacgtgattttgcacatggcattgaagtgagagatttcttgcagggccagatgacaagcatggacaaggcagcaaatgtggtattggatattgaagggctgcctcagcaacctgataaatgctgcactggaagtccaaaaatgactgtatgttcaatgactcacataagaccaaaaagaaaaggatagtggttatctcactctcccacccttccattttttatgtgcagagagccctatctcgcaagggctcaaatcgcatggaaaggaggagcggtgaagagcaggaacaagatgacttggtgaagaaacttattattaagggtaacaagctactgttcttctctgaattctttttttcttaaaaaagttgtagtctctgtaattctaaatttttcattttgcatacttaaaaccaaacagcttatattttgtttggatcaactcaaaccataatctttgtgaagttccatttgatcttagccatcatcacattgtgtccgtgagctgtatgtagatgagaaaaaggtcaaaagcggctagctttcttttgtgtgattgcttgtatttccatccagcggattttttctatcatgttcctacgatatgtggcctgcagatcgaggagccttgtttctccaattccaactttacatttagctaaataagtattggcttggtattctcggactttagtagcttgtacttctgtttacatccaagcctaataatcttaattttagcatcatttttataagtaaggatatttgttttccttttttattgtactacactcatctggtatgccacagcatcaacactgacagctgtttttttttttgcccttttgttggatatttatctccacagttgtgccatctcagttggagcagcttaagatgccctggtgcagaacaaagccttggtcactccacaatcacaatgtgctgcctgtgcacctattctaactgactctggggaagaaaagaacaagaagtttaatcgacttacttcggttcacccccggaaaatcctactgttctttgcaactctgtaagtcacttgcctttctgaaattgtaatatgtctatgctgttgaagcaactggtctgagacactgagtttggtttccaattggtaccatgccccccacaagtggtccatgttctggtgtgtgcttctctgtactgttcaactgcacttgaatagtgtggcgtggttttcttgtcagtcattatcatagtaatctgctacacaatttcctgaacatactgtactctatcccttgcttgcccatttgtctaggtttgaggccctagtcagtatgcacgttcacacattaactgtattgcatgctccaagagattatttgtgtattcatagcagaaacactgattgatggtacgcatttatgccattgatggtacaaatatcatttgcttgtgtttttagctgcttgttttctaagccacatcttccttctcttttacaaacctattatacccattttgatttctcttccttgtttctcgtcgcaggtcgagcgtgggcacaatgatactgatatacttcacgctcgcaatcaacggtggcaaagcggaggcgtagtcgtcaccggagcgaaacacgacaacggtttcagaagtgcatttcatagctggaattttcgcttctcgttatcagattttggtttgtttgggaggagagaactggaggaggaagcaacagtagcagcagcaatgatgcagccaggctctcatgcctgacacacaatgctgggagtgttgctcgatcagtgctccattgtcacctttgcctgacctgatctccctgaattcttttgatctgtacatgtaaattgctgtgaggcctttgttgagaggtagagagagagagaaagagagatccatggattgttgttggtgtaaatgagctggggcgaagctatccatttctgccatgcgagtcccagcttagctgtaaaagatctgaagcgaataattatgcctttgtggagttgcagtgcatctggggttcggttcttgaatgctcgttttctgctagtggcactggcaccgccaacgactcccatttacgatatgcgcgcaggctctgcattttctctgcactctgcattacacacgtgctatttgtcagtcagctatagcataaacctgtggaatactctgtatattgcaaattcaaggtaattagtttacatttatatttgcgtagtttcagccagatactgttttttttttctcctctgaactacccctccgtttcaggatataagactttctagcattgtccacatccatatatatatatatatatatatatatatatatatatatatatatatatatatatatatatatatatattaatgaatctagacatacatgtgtgcctgaattcattaacatctatatgaatatgggcaatgctagaaagtcttataatatgaaagagaaagtagtatataattttgttcatatcaataggatgcatcaaacacattttaggttggtttcgtgaactgagcggctcagacggaattgaaagttttagagttggcataggaaattgtattttttttcctgggatttttaatgtggatgcgctcagcatggtttgataaacaaggactacaatgttttatagtaactctaaaattaagttttaaaatttaaattctggctgcagctcataagctcaagagcgaactatggagctttgggattagggagttggcacagcctatttttcactttcatttgtcatttgctcgttttcactgctttcatgcaccattcttcccttggttttcaggattagcatgaacttattttatgttactagccaaacaatacctatgagttacaacaggttattcaaaatagctaaaataatatttcattcttattggaaaaaaaatattagcttctacttgagaaacaagattcttcatcttaaaaaataaaaagaaaatcaatggctccatctgctttaacaaaatgcccttttcatacttcttaccgtaaaaaatcgtcggtggtgtttccttttcacaaaccgaaatcgcaatgtaggccgaaattatctcgaggccgaggcccaacaaaagtttgtgtccgtggccgtggccgtggcctgcttcatccgggcggcgtgcggcgcgtgcagttgcgggcctcgcgagcgagcgagcgagcgatctccatccccaacctcaacaatccccttcccttcccccatcgcgcgatgctggtggagtgtggcgtcgcgacctagccctagccctagcgccaccgccaccgccaccgccaccgcctgctcgctcgctcgattccccggctccccgtcgctacctcgctacctcgccgcgccgccacagccgccggcgccgtctctcaccgggatcgggacaacaagcgccgcgccgttcagtcaggcgacgggggcgtgcgtctccgctctctggggggcctcgacgtcgcctcgccggtgtttcggaagaccgtcggcctggttggtatctctgattgcttgattactgctagggaatggatgggtggatgtcgtcgacggggtgggtttagctttagcggattagcgcgtatcacatcccctgattccagtcgagtagacaggataatagcaggtggagggtttgaattttttagttatataaaaggataccttacgttggtgctgtttgatggattggtagaggtggtgctattcttcccttcatcagaatgtcaagcggcttgcttcgtgtgtagattactactagtatttttagggtttgggtgcctgctaatgtcaccgaataggtttcgttagcttcttattaatgtttttaatgcactttgtcgcgatatggatagcgagaactgctatttgtgccgttttgagatggtgtgtgtaatttactatgtcgttatgggatgtttttttttttgtctattcctttggctcacgtgtccctcctgctgcaatactcatttttgtttgttggatgatcagttgtttgaaccgcttaccttttttataggcgcatataaaagtgatttggtggtcctggagtattcatttggtcatgtattctatattttggaaacttaagttttaatggattaatctagtggaggatgtagtcaagaattttcttttgttggttcctaagagatttcttggctcgcaagttgcaacgcgaattgggctctcatgtattttactattttagaaagcttttaattatcacagatatagtagccgaacagattggatatagctgtgtattcgagacatctgtttgttatcttatacagggcatgctccgccactgaagtcaaaatgtagggagatctgttaagttgtataccatattaggcttagtttattcttttatctttctccatttgttctgctaggaactgagctatcccatggcatcaccacaagaatccaattccttgtgcttgaagcgcaagcttgttgatgactgcctgtcaaaagagtgcaagtctcgtcgcatcaaaactgagaagggaccatcatctgattcatctgccaagcgctgcaaatgctgttgcactcgacctaaccttgccagtgattgtgtcaattacctaaaaagtggagtgcccagccgtgttatgttttacaaacagggttcttggcacaattttcctgagcagataatgaagtctctcattgaagaatttagaagcaataaatctagtgttgttgctgtgatggacgatgagcctgttcttgttgatttcttgtcgatgaccctggtcaacctaaaatctagaaagcagcggtctgtggcatggtttgatgacactgggaagtgcttttatccttctctattctttgatgaggaagctgatgaagtggctaaagtaggcggtgattttgagggcgccacacagggaataatgttggataaggttgcaaattctccaccagaagtggtgaagcaagttgtccttgaatctagtcctccagttccacagaagcctgccactgcagacatattacgcaaaaagatcgcatctgtggaacgaggcagtgaaggctttctttttgcgcaggaccttttcctctctggcatgggtccatttgcaacgccaaataatatactgcacatccaccgctactctccgaatgatatcactgcacagtgtagacttcaagcttttgaaaaacaaatgatgtccaccaaggaagaacgtggtgatgcaaatgtaaggtatggatggctgggatctaggaagaatgacatagttaggatcctaattaatggttttggtaacaatggaaaacctgctgagaaggcaggcttgagtgctggtgtttatctttcaccagaagaccgagcattttccaggtactttttataaacttaaaaaaatgtattgaccattccattttaattgtttatgtatttacattatatcttgcttgacagtgttggtctttgtgatgttgacgaaaaaggagtgcaatatatgttgctctgccggttgattttggggaacatggaggctgtcatgcctggatcacaagattcttttccaagcagtgacatatatgattctggtgttgatgattgctcaaatccaaagtgctacgtcatgtggccatctcatcttagcacccatattcgtttagaatatcttgttagtttcaggctttcctcgaaagttcgaagtaagatgataaataatagttaaaggtttttatcatgttttgttgatataggtggagtgatatattttttggttcacttgttttcagattatttacttggtttgaagggtttatggtttcacccatcaccaaaggaagttgcggtggatatttctactcttgtacctgtgaggcaacctagttttcttcgtttcttcttttccattgacactctggttttccagctagatgtgcatgtactgctaacagtggtagaatagaagtctgatctgagagcaatccaatttcactacagattgttcctcccttctttaaatgacaaatgatcttggctttgttgtacatttttatgcagataatgagtggaaatgctgagggaccaacttccccttggatatccttcagagttctttttgccatgattcaagaaaatatatcatcggtagcaagggaattgctcttccatcattatgaagagctgaaggtactaactaaccaacaagttacactgtgtttatttattagcattggctgtgtggttggttggtgtgatgggtactaaaatgttttaattgtttatttgacaggaaaacaaaataactcgtgaggagatggtaaagcaaatgataatattagttggagagaagttgcttttggaaaccttgaagaggcttcattactgtgtaagtcggctgtcccctgctgttatccttcgaaacaatttctggtgacatatgcttgttttctcagttcacatccatactaaggatacttttaatgctcatatacttttaatacattatggacaagtttgcatacgacaacaggcacaattttaggaagtttttgttcaggtgttgcaatttttataagatggtttattatcacattgtttatcaaatcacacatatttgtcaaataaagaaatatctgctaaattttttaaacgagtaataagaaaattggtaggggctaggaaactagcaaggccttgaaaaaaatatagggaactctcaaagcagccaaacatgcctaaaacaggcacaggccttttgaattcatgtttggataaattatttggaaattttcctcacttgtttcaggcatcctcttatttttactgtaccagtttatctgtactcatatttcacatagctgttgctgcatctgtactggtgtgattaactgcacctttcttctgatgccattgtgtccttggcttctgttgcagccatcattatggtataaatctgctggcaaaatagcatcttctgatcctgcgaggacagctgcagaagacaggtctttggatcaaactgggaattgttcattaattgttagtgttgcgcatggtgattctcatgccccaaatgcagtagctgaaaacagcaccagtctttgcaccaaaggatgtgatactcctgcaacaggcatgatttccaagggctatgattctctggcaccaaaaggtgtgccggaaacttctacttctgtcggccccgtacatggggcttctccaagtgtggaacccaaagtgagggattctcctatacaaaccgttttatcaggaaacattgctactgattgtgccaaaaggcaagatccattggtatcaagagtggcacctgtagctcataatggccttttaaggatgccatctggaaaatcagcatctctcgcagcgcaagtttgcaattctgttagaccaagcacaggaccttcaggtcgtgcttctacagaaccaaataatgcctctaaaagttgtgggatttttgctccgggtatcaggccaaagggtggtgaatctcttgttcctagtttggcattaggaaattccaaatatgcaggtgtagaaggtctcaattctgcaccaagagcgacacctccgggtattaggccaaagggcggtgaatctcttgttcatggtttggcattgggaaattccaaatgtgcaggagcagaaggtatcaattctgcaccaagagtgactccactgggtatcaggccaaagggcggtgaatctattgctcctagtttggcattgggaaattccaaatgtgcaggtgcagaaggtatcaattttgcaccaagagtgactcctccgggtatcaggccaaagggcggtgaatctattgctcctagtttggcactggggaattccaaatgtgcaggtgcagaaggtctcaattctgcaccaagagtgacacctcccggtatcaggccaaagggcggtgaatcttttgttcctagtttggcattgggaaattccaaatgtgcaggtgcagaaggtctcaattctgcaccaagagtgacacctaaagacaaggagtttctttcattgagtatttcatcacaacaaagcccagttcttaattcaggtaaaggccatgatgggacatcaggtgccgcacgtccagtacatgcaccaggtttaccctcttccaactgcagatcatctgtggcacttcaagggttattcttgtgtacaaaatgtagataatcaatgctttcattaacgtgcagggcatggaaatcctaaagctttggccactgaggcccgtggttctctatctctgagtattgcaccgaatgtccatgaccctccagcatcaagtaaggagcctaaggacgatgcatctccaatagcaggcatggtctcagaaagccagcactctcaagcacctaatgcagtcaccaaggggtataatgctcccacacccagtacggtgcttggaaactcttgccatggaacaacattgttggtaacatcacttgtttttttgctaactctcatgcttccttggtgactgcagtacctaaggagtcaaaaggccagcatttacagagtggagtgcacagtcaatcgtctgggccagacgatgctagcagcagcaatgtcgctcgggcagctgataccatcgtcgccctatcaactcttcgagagaagggcaggtagatgttgcagccccttgtgctgatcgctctttgctttttgctgggccgttctctagtgctgtacatgtgatgtgaatgttatacaccgtcctgcccaaaaagcgtttaccgtcgtaccatggtccatgggtcggtccgtttaacttataggtggtgtaaaccggttggatggattcgtttgttgtaggttacctgtcaccttgtcgacttgaacgtgaatcgttgcacatccctggcagtaaactttgtcatggctggtatcttcggtgtccgtatgggttgtgttgcctcggtgtccgtatgggttgtgttgcttcggtgtccatatgggttgtgttgccggttttccagttagctatacatacctgcctagttcccatgtcaaatttaatctttcgtttactctagtgtacatttagtgttcctggaatatatgggtagtgctagatagtagttttgagatgccaatatgcaagcttggttggcatagattgatagataggcttgtgttgggctgtttttgcctgggatccagtctattctctatgtagactatgggcaggatttccatctaaatttcggcccaagtactatttttcacagttttagcggagggcattctctatagtctatacatacccatccagaatttaatcatataaaagcctagtagtttgagaaatgattcgattgagcaaaaggctagtcgagcctagcaacaaatggaatggacaaaaggcttgagcatttagcatgtagccattatataccatctcgtgctgcttgccacgtcggatcatgatggcttgcactggaaaggccagtctagcctttaggccatttgagtgccaagcagcacacacacatggcactttgatgagtctttcctcctttcgctgcctggcaatcgtggcactttgaggtgatgtctcccttgcttaattagtaggcacactgacctgcctgtcaaagaatgatatgattactcgatcgtagtagactttttttgttaactaggatgcctgcaccattaacctccactaatcggggtgtaaagattcatcagacatctgagtcccagttcagatagcattaacctccactgatgatgctagtggtgtcgcctcatgtcagtgtatgtcaccctgcaatttggtcttccctggataaaagctttgtggaagatgaatggataaaataagcataaaaaaatgaaacaagaggagcaccagatgaaaactcaaaactatactgtcagtctgtcatgattgatcagcattgattaaagatttttttctggaaaatgtctatcataataaccaacagaaatactttgtgatgaattgagcagtcacaatgtgcactatagattcttttgtgataagccccaaaaaagaaaaaaaaaggagaacgatgctatcaggagaaccatgtcgtggtctgcactccaacaaagtagaaatgctgtgttctttcagaaagaagtagaaatgctgtgcaagtggaggaacagaatcacatactccattttctccccggcatttctagtccaaagtcaaaacaagaacaagaacctttggatggtccaactaaaactttcttggaaacgtacggttgattttgatcgatggcccagcacccagaatctgaacttctgaagcttgaaagaacacgcataattttcagctggaattggtttgcatcattatttcaaaccttgaacagctgcaactgtaaaacattgaccagcggcttaattacagtttgaacatatagcaaatcactaaacagtaaaaaaaaagaaacacttgcctgtggcaaattaaagaaaattagcaacgaatcaaggaacccacgtgaagtgaaagtgaaatgcaggcatgaataaatgcacggcactagaagtggaaatggcacaatttggaatcaacacacaagtggtaacctatgcttgcattagcagtggtggtcgcctgggcatgcacgtcaaaattaatccctggcgattaagcgatcctaatgatgatcattgacgcgaaaacagtcgccatggccggccggtttctcgtgttcatcgaacaggatcatcactggtactgtgctactaggcaccacaccaaggcaggcatgcatgcttagctttgcgaaaaagttgaaaggctgacacttaaccaccaccaccacctgcagctaatagctagtacgccaaatgcagaggcccatctcattcatgctcctagctatatatatccatccagttctttttttttcatggacccatatctaaaatcactctggtttccttcttttcccttgtgagattcggtctcgaatcaacaaattaggagggtagattcgtcatatattccgcgcaatattaggcttcctttggaatggagaaattttagagattccttttatgaaaattgaagtaattcgtgtaaaaatcctgaaatttttgtatatgttctgaaggagccctgctgctagctaggcccttaactgtgcaatttgtgaaatatgtttcttcccaaacatgctttaaattgagagatgaacctaatgtaatacatgattccaccttgaatttgataagttcaaaaaatggacggctttaatttttcacctaagtaatatatttagtttctaaatttcatgcgatttaaattagaggtagttaaatgcagttaaatttgcacggagttggtttaaaaaatatcactccatgtccattgataaaaaaaaaacttgtgttaagaaatgacctatggtgaacaacatcatatatgagacagggagctcaaagcacgagttagagcggattctgcatgtcgagaggctaggcttcgtgacctttttttttttaactgaatttggtcgaggtctttcttactacccatcaaaaaacataaaaacctggaactggataggactgtcgagtggtctactccttcttgttttcttttttctttaaagaaatacatccctttaaaaaaacaaatatgttttattataataatagaagcttcacttatctcagtcaagtatacatcgaggtgatccaattacaccgagagcactcccaaactcggcatcactaaaatgcacacagccaaacacacactcaaacgctaaaagagagatcatagagagtattaaggaccatcaatcataaattgcataaacattattctttctccaaacctataattaacaaatttcttagataatgttttgacagaagagagcttaggtacggacatataggtgagcggctcaacgcgtttcaagccttcaacgtacagccggtccaacgtacgattctcatatataccttccttgaaataaactcagaccttattaatcaaattttcttctttccctctcaacatcaagttcaaaatccagctaaatttgcaatactaaaacctgtacttgttcgacaatgactggtattttaatgaacgattaagcagcagctgtctgatcgatctggtgatctcatcattttttccccctaattaagactcgctggagaccacaacatcgttagatcgccgactacgactgctgccactgaccagctgccaagtgcatatgcagatcagacaaacaagttttggtcaaaattttcgcgtaagcttccgtttgtccgagagattattctcctaatcttgatgcgtacgtacgtggctacgttagctccagcggcagtgtggctggcgatcgaaatgacgagcaaattaaccatccatcgcatgcagcgtgcgacgactgtccacgtgcgccgccggcatgtgttgactgaacttgctgccgtcttgcagatctaaacttaaattcatctcgctttcagatgtaaacgtttcaatgtagcgtttacttcaagctcttcttgcttctagattatttataacctgttcgtaataggagaatgcaaatggcagcatgctttttctgagcttctaaatggtatgttatttttttaaaggggcaattgcaaatttaccactactttaaatcattattgcaagactgtcactagaaaattgcaaaaatgccactagaactatcattcgagtggcatccttgtaatattgaaaaaaccggtggcaaatttgcaaattccccttttttaaaagaacttttaatatatgttcttttatacttatatgttttaaatccacctttcagtttcataacagttaatttatttatttatattctcgaataattatcacatatcattcatgtattggccgttccagtccattcattaaaaaaataaatattattagaaagcaagttgaaccgctttaaataatttagggtgtaaaataagctgaaaaaaaatgcttaggggttaagtgttcaacagaaatagtttggaagtaaaatgaacctttttttcaaaaagagaaaaaaagacgctttcaactnnnnnnnnnnnnnnnnnnnnnnnnnnnnnnnnnnnnnnnnnnnnnnnnnnnnnnnnnnnnnnagactgangtgcaatcacgcgg

SEQ ID NO: 18447 - DNA, 4650 bp, Oryza sativa
  unsure (1)..(4650): unsure at all n locations
gcgtgctttgagtgtcttattcactatgggcgaattcgagctcggtaccccgaatataggactcgagaggaggaatccgaggacgaatatgggagtcagagaacaaatataggccccgagatccacccctccaccgaggcgagctgcgagcggtggcgcggaaagaaaccgacgaggtggcgtgcgcgcgcgcaacgcgcgcgtcgaactgaacatacgtagcatacgcgcccgcgacgcgcgacgcgcgccggctgctcgctcgcctcgcctcggcgcgcggcgcggcggccgcggcgcacgagcgagcgtttcgttcgcacgcggaaaacgccctccacgcgtcggcacgcgcacgccacgccacggcgtctcgcgccatgcgtacgtccaactgttcaccacagcgaaggcgtttaagcccatgcgccaagtagacgagcgtgcttgaccaaagtaggaatgcgttttttccccttttttttttctccaaaggaaaaaaaaatgattatcaacgaactgttgccacaaagatggttgagaaaatccaacaaccggtagagtaacaaccaagtctgtctccgtgactgacagagtgatcacctagcagcatcggttaggtctacagttcgtttgttgcacggacagctagctagccaaatgcagatgataatttgtcctccgcttatcgtccacaacaacatcgacaaacacacaacctgaataggctgttgctgtttttgtttccacgttacaacaagttgaatagtggagtagcatatgttttcaggacaatttttcgcgtactgtaccagaatctacaactttgatactcctatctagcgttgttacctggagtaccagctggagtaaaatctttgcatcgccagcaaggtaattggtaggcctaaccagcgtttacattaccgttggtaaccgcccttaccgcgaggtacggtaatagaaatatcatggtaacctccttaaatttaaataaatttaaaaaataatttaaatttttgataaattttacacggttttatacggttaccgcgcggtaaccgtgcttaatcccggtttcggtggtttggaaaaccctgagcctaacactgcctagcttggaccttcccgctttactttccttttgccatttcattccttctcatcttttcaatttcacgacccgtcttttaatcttttttttttcgctggacacagctctgactttgcctttggatgctttactcttggatgtcccaagcagctgaactagccagccattcacctaaaattctgcacattcataaagacgagcattacctacacgcagacaaaattcagcggatggaaaagagaattcagtgatgcatgcaaaggtccatatcaaaaccaaaagaggagcagcagtacgtaccaggggtactagaagtgtacccctccataaaaaaaaaaccaatactagcagcgaacctagacacatatgtgttcagattcattactaggattggattctttttaggatagagtagtaggagtattctgcaaatgaccatagcgtttaacgtagtactagtatctcatcaattcgtcaatgtaggattaatctggcagccattaactaagacagcgtgaaacaggttagattgtgtttagtttcacaccaaaattggaagtatgaagagattagaacgatgtgactctaaagttgaaaatttgtgtgtaggaaagttcgatgtgacggaaaagttgaaagtttatatgtagaaaattttgatatgacggaaaagttggaagtttgaaaaaaaagttggaatctaaacatggccttattcgtcatagtgataaattaaatattttaaaaatatacttagtatatggaatattccctccatcataaaatataaaaagttttggttggattggacacatactagcactacgaatttggacatattacttgtcgagattcatagtatcaggatatatctcatccaacaaaaacttttagtaatattttggaacggaaggagtagcttagaacatgtagtccaaacatacagcattaggaaaaaattatccagtgaagaaaatgaaaagaactagcacaattgtcaatccaaaaaaaaaaatacgattcccccaaaagaagaaaaactgatcggaagtgtggcaaaatttagcatcaaaccaggtctaaaaccacagtaaattttgtgcatacatgtagtgaacattttcagcaactacataaaaaattgcatattttccaacaacaatggtggtcttctttaaaacacaggaatttgtatcatgacattttcttaaaaaaaaaagatggacattatactccactgttcttggttctcccagcgtaagcaaaagctcatattaatactgagcaagtgaacagttactaccacttagttcatcgcttcatagtaaattcatttttctcccatttatccaaaaataagtttatttttaaatagttattacattggagtctatgaaaacagagaataattacattgaaaatagataaataaagaatagttacaatataatttgataaagagtgtgttgagttcacgtcaaaattagaaatttgattgaaattggaacgatgtgacggaaaagttgaaagtttgtgtttgtaagaaagttttgatgtaatggaaaaattgaaagtttgaagaaataattgggaactaaaccaggccaaaatacatatattgtagtctttttattactatgtattaatatgtgtgaaatgatcggggaaaaataatcctctactgtctccacagttctaccaccaccagcagcagcatcggatccatccatccacgcattgatgttgcagcgcagacccgtcgttactcgtagcttagtggtaacagtaacccgtccaccaattgctccacccgttgcagtcgccatcgacttgactctgacctgcccctttctctttctcttattcttcaagagtgtgtttaggtacttccaaagttactagtttggattaaaattgatacgatgtgactaaaaagttatgtatgatagattaacgtgatggaaaaagttggaagtttggatctaaacacggcccaagagagggtgtttagatcaaggtgtaaagtttaacgtgtcatataaggtattatataaggtgttatatggggagttcatacactacaaagaaaaccaattacataattcgtcagtaaaccatgagataaatttattaaacataattaatccatcattagtaaaattgtcaaaacatgaaacaagtagacttaaaatattcgtctcgtaaattagtcgcattctgtacaactagttattttttaacctatatttaatattttatacgggtgttgacatgaagcaagtagacttaaaatattcgtctcataaattagtcgtattttatacaactagttattttttaacctatatttaatattttatactggtgttgaaacgtttcgatgtaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacaccccctcagtctatctctcttcaaagtccaagcagcccacgaagtacccggcatttattttcctcacccattttctccactaaaatacgcgccgcttattaaatttcccccgcctttgctttgcgtcaccatatcaaatgcgcaactagcactggtgcggcctaccagtgagcgagtctgcgagtgagagaaaagaggacacgagaaagctttagagagagagagagaggaaattgattttttttaagtttgcgatgaatgaataaacaaatctggtgaagaggttgggaggaagaagaacggctgctgatgagagccgcattggagtcaaaaccaaccgtctctttctctcctctgactttcccccactctcctcctcttcttcttcttcctcctgtgatgccatcctcctctttcggcgcctcacaatcttgcgatccagctcatgtggcggacggaatgagagggaatttcccgttcttgcgctcctggatttcttgcccagaggaggagtcttgactcttgcgagcgtgttcgttcttggtgattagattcatgctgcctcgttgcaaggtggtgtgagttgttttcctggattcttgaagttgttcatgccctgcaggaannnnnnnnnnnnnnnnnnnnnnnnnnnnnnnnnnnnnnnnnnnnnnnnnnnnnnnnnnnnnnnnnnnnnnnnnnnnnnnnnnncaccgcg

SEQ ID NO: 18448 - DNA, 1069 bp, Oryza sativa
  unsure (1)..(1069): unsure at all n locations
agggggtgccggttttgtcccagggccattgcggcccgctcgaaaagcctaacggtgcgacccccccggcctggcggcgcttctggccttttccaatggcgtgacccgaaggcccccgggatgttcgggtgggccccggcaccccgccttctgctcgtggacgggggtttcctgtgttctcgggagggtggtggcgctggatctctccaaccggagcctctcccggacctcgcttcgcggcggcgagacggtggccgggtcggcccggcttccgagcctgaggcgcctcgacctcagcgcgaacggcctccccggcgcgttcccggcggcgggcttcccggcgatcgaggtggtgaacgtctcctccaacgggttccccggcccgcaccccggcgttccccggcgcgccgaacctggcggtttttgatatcaccggcaacgccttctccgaaggcatcaacgtcaccgcgctctgagcttcgccggtcaaggtcctgcggttctcggcgaatgccttctctggtaatgtcccggccggctttggtcagtgcaagctgctcaacgacctcttccttgatggcaatggccttactgggagcctccccaaagatctgtacatcatgccagcgctaagaaaactaagtttacagtagaataagctctccggcagcttagatgacgcacctcggtaacctcactgagattacgcagattgacttgtcatataacatgttcaatggcaatatccctgatgtgtttggcaaattgagcagcttgcagtccttaaacttggcttccaaccaattgaatggcacattgcctctatccctgtcgacctgcccgatgcttagagtggtcagcgtgaggaacaactcgctgtccggtgagattaccattgactgaagattgctcacaaggctgagcatcttcaaggctagagctgtctcctgggtgggagtgataccccctcgccattccacgcannnnnnnnnnnnnnnnnnnnnnnnnnnnnnnnnnnnnnnnnnnnnnnnnnnnnnnnnnnnnnnnnnnnnnnnnnatcatcaaccgt

SEQ ID NO: 18449 - DNA, 740 bp, Oryza sativa
  unsure (1)..(740): unsure at all n locations
ccgcgccagtggcgaccctnnnnnnnnnnnnnnnnnnnnnnnnnnnnnnnnnnnnnnnnnnnnnnnnnnnnnnnnnnnnnnnntttaaataaaaagcagaactgatgcaaatgcagttcacgcgagcaataaaatactgatccttttttttagaaaatataaaagaaaagactaatcttttctcacagataacactgaaaaccccaaccatttcggagcaatagcggaaatacattccggtaaacacgtcaaaaatactcttagtgctcgcctcaccgatcagccgcagcctgcagctaacaagaatgttaaccacggcatgtaccgcctaccaagaaggaaaaaaagcttaagaaattgctgtaatttcacaaatccctcccgcattgcattaaactcggaacttgagaccagtcatagaaaaccagcagctacattgccaagaacccaaacaaaacgagtgacagattttgcagcaaacaacccaagcagcccaatcacacacgacgaacacaagcccccagcttggccatgcacaacagccggatccgagccctggaatcaaagggcccgtggaatgcgtatgattctccgccccccaaagaagatgcaatcaaacaacaaagcacaagagagagagagagagagagaatgaggatgcttgcttattacctgatttgctgctcgtgagttgctgggtgctagctcccatggaatggccgcaaagattgagatgagan

SEQ ID NO: 18450 - DNA, 825 bp, Oryza sativa
  unsure (1)..(825): unsure at all n locations
ccgcgcagtaagctcnnnnnnnnnnnnnnnnnnnnnnnnnnnnnnnnnnnnnnnnnnnnnnnnnnnnnnnnnnnnnnnnnnnnctattgtcatatgcagttactagtactaattaatttccctacactactagatgaaatttgttagtcgctgtcaaaatggaagctgtgtctgctgctgctaagctgagtggaaatttggaggaaaagaaaggaaaaatccagcaggagggtgacaccgcggcgtacgggtagctgtcctgggggtgctggctgccagttgcgtcaacggcagatgcgatcaatgtcgatgcagagatgcaagttgcagcatgttggcgtgtcatgccgaaagaagaaacgggcccgcgtttaattagccaaattgtcacaatgcacccggcttcttcgccgtactatagtgacctcaaacgcatacaagaacaagttccatttcccatcttgctctctccaagttaatagtagtagccttctgtgtagtcaaaatttaaaatctgaaactttgattttaggattttttttttcttatcatagtctatttatcaaccataatttggtagccgctaattatacatgtataagttaatgttttacatatgaattattttcagctgcttccgttatttatctttacacgggtgaggcttatcacccgtagcttaaaccaatagtggccggtaaaaatttcccaacagggatgggaaaattatattattttttttaaaaaaaaaagattattaagaaaaaagggaagaattgtccaggccacacttagctggcctaggggtggaaacaattgttaggg

SEQ ID NO: 18451 - DNA, 834 bp, Oryza sativa
  unsure (1)..(834): unsure at all n locations
ccgtgaggtagatcgcatgtctnnnnnnnnnnnnnnnnnnnnnnnnnnnnnnnnnnnnnnnnnnnnnnnnnnnnnnnnnnnnnnacttcaaaaaaaataacatgagggatatatatgtggagtcaaatttgttagacaaatcttaactaaaagattcggatttttcctttcgtcaccaatttgtcgtccgtacgctttttcgtccgtacgcgcagtttacacagatccgatttttcgtccgtacgcgcttttgtgtgtgatcattgcccagtaggccacatctgtccacaggcccacaagcaagcccgggtccaagcgacaagcccataaagcctaacccacaagtccaggtgcaccacaagcccacaaggccacaaaccgcaagtcctccgttttccttttcttctgttatttctaccgctattttttagcgctcacactaacacgattttacagatttctctcgcaggggaaaaatacacatacacgaatacaatcacaggcaagacatacatatagaaataatagaaacacacaagaaaatacaaaaatacaaatcacgaggctcttcctcgggggtcaagccacttccacgttatcattaaactgaaccctgaatgcagttacaattccattaggtttatatataactcaagaaattctaatgcagttacaattccattaggtttatatataactcaagaatttctaatgcagttctactccattacggtaacacattgaggtaannnnnnnnnnnnnnnnnnnnnnnnnnnnnnnnnnnnnnnnnnnnnnnnnnnnnnnnnnntntaagtgggtgtcatctaaggccgc

SEQ ID NO: 18452 - DNA, 2703 bp, Oryza sativa
  unsure (1)..(2703): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgctatgctaagttaaagagaattactagtttttttaggtatcaatagcataactcttgctattattcttgaaagggaagagctaatactaacgtagacaaagtgaaaaccaagttcagacatctttcatgcaaaatgtaccgatctaaaagtctaaacactgctccttttgggatcagggcatggtataattccccagttcctcctcacttcatccaaatcttcatgaaaatgcttctcatagtacacagacataagatctgtgcacttaagacctgcttttgaagcccatgggaaataatgctgaaaaaacagtgtcctttgtttctcattgaacctcgcagagcccccaacgactgaaagcatgcacattggaaggaacatctgttcaaactcaatgaccttaagggcagtctctccaatcaggttcgtaggaaggccgaacagcacatgccaaaagtcatggacttcacgggcgcgggtcgcaacatacgcaagctcatctgtatccatgaaacggacaggtgggcggtcatccggtgagaagttccttgatcccatgaactgagcatatgctgcaccaaatgtgttctgaggcatgtcccaggcatgagaaacttgtgtggatataactcgaggacgctccaggagaacatcctgtaggaatagtatcttagttaagtcaattgcgaaagaagtccacagtgttgagtacacattttcagctggcatgtgttgctattgcatggcagtgatgtaacaagaaggaaaaaatcatcaaagtatagcaattgcaggtttaaatttattgaatgggtaagtctagactgcagccaaacaaggaagatattttggagagttaaatgcataaataacaaatgaacaacaaaaaaaatggacagcttatgaaaagacctacactattccatttttcagtataacattgctccctgaaacaaccaagtaaaaaggataatgctacttcacacaaaaaaatctacttcgtagtattggtgtataatcatcatatgctccttagcatttgttggcagagaaattgttactgtttcagaagctgagtatatatgtatactatttacagaatatgctagtaataaaggctatatataaagagatggtcaagcacaacaaatggatgcatcgacataacgtcctgcacttttaggggatatagggtagcatgagtttaccctgccttcagcactgttcctcatccgctgaagcacacgctgaaatgctggcttcccagtagtctccccaagagcagctatcagatcagctcttctagggtcaagcaaggccccaaatgcagaaccgaatgcaacagcagcctgttgccaccccttcagattaacacgcgccccctgcatgactctacaaaccaaaaagaaatcagaaagaacaatgaaccattaagccacttgcattcttgttcaatactttgtatggtaaaaatcattatacgacattcaccagtaatctaatgatccaatgatcctatcgcatgcaaatcgatggtgataggtacattagcaaaggggaacaaatcgtgcgaataaatgtatagatatattggcgtggaaagatgcttttatcaggcatttcatcgaacagctagagagcatcactcctaacaggctaacaccagcgagtcaacacagaaagatgtgcaagaatcgcctaaatcgattagcaccgatagttgcaacatactagcaggcgacaaacaaatcaagcagatcaacaaactagcaggtgacagaaaaatcaagaaaatttgggaacactgtcgaggcttcgttgcgacctagagttgaaggggatctgcacacgcgtacctcgccgtcgagcgctccccctcgacgcttggtcgcgcctctgaacgtgagggagatcagagatgggtcgtcgctgcctccgagctgatccgcgtcacgtggtcctagccgtcgccgtcgccgccgccgccgacgacgactcaccgagctgggttcgccgccgctcccttccgcgatagccacaggtccgaaactctgaatggctaggtattgggcctagttgcagtataatgggccgagccttcatgggccgcacatcctccctaaccgtatttaggcccactaaagttgggctcgctagagacaggctttcgtaaggcccaccaaaaacatgggtcggtattgagatcagaatatccggtttggctcgtggacccggaaaatgtccgcggaaatttgcaaagaaaccctttaaaaaacgtattattactttactccacctccgtgtcccccccgcatataaaaagttagccgcggcgattggcggagaagcttgaaaccggctttttctgtttctttagcctcccgagccaccccccgagtcccacgaagggagaggtn

SEQ ID NO: 18453 - DNA, 11270 bp, Oryza sativa
  unsure (1)..(11270): unsure at all n locations
ggggcacaaactagggcgcctccgtctcggcgggggccgcgcggtgtttggccaggtggggcaccgcggcgcgggccgcgcagttcatggagcactggctcgcggcctcggaatcaacgcggcggcgggggctccccgcgctcgcggcgcgtaaaaggcggagccggccctccagaagggtggcgcggccgaagcggaagccctcgtgattgaggtctctgcagagtatttcacccaattcttaccaagcaaagtgtgcttgccaatttgttttttcttttctcttgaaaatggcgtcaaggaagctgcatctcccgtgctacaggtactatcatgtagtgttcctgttccaatttctaacttgttgcttgcttgtatgcactgcaggctatcgagatgaatgctggtggcggtctccacttggcgtacagaagcaggtcctttctgtagctttgattatgagaacgagtgtttgggattgggagtatgtgtgatagcttaatttttcacaatttatgtttttctcttaggaaatgctgccttcgttgcactattgggaagtgagaatgagagtttgcgttaactgaaatgaatgcttgatgctaagtgcaggtctagggctagattgtcaatggggaatatcactggtgcgcttgctgatgccgaggaagcaacaaagattgctccgaaatttcctcaggtaaacacctgccctgtaaattgaatttatcatcttcttgttactactcgtccacagccaagccatactgttgattgctacaatacaaatattttttttccttatcacattggtgtttcttaacttgtttgctgcggactgttgtgtatgccacaaacatttgcaaatgcatacagattacctacctggctacctagtagtttatgcagagaggaaaggttgctacaatgatcaataaaaccaaacagtatggctgggcatgattgccaaactaaatagtagtgaacagtgattgcagaatttagatcattggatggcatgacagtgaaatgcttaattttcaattcaacggggcacaagtgccctcagccttcatatggaccaatggggcacaaagcgcctccccgctgccgttacttcatgtggctcgtggctcatcgtcgttgctggactgcagatcgacggaggccccgaggattgccccacccggcgaggtgtgtgctttgtgaccaacaagaagaaacaatagaccacatcctgatttcctgcccggaatccgcgcaattctggtggattgtaatgaataccattgggcgtccggacctcttccccgcctctcagaattccttcatctcttggtggtcggcatccaggaagggagtggcaaagcaactccgccgtggtttcgatacagtggtggtcctaggcgcttggtccatatggaaagaaaggaacaatagggtcttcaaccagaagcagcgatcgtgggaggaggttgctagggcagcagcagaggaggccgccctctggagactagcaggtcttctcccatagtagatcatggctgtcgtggtcgcaaaattgatgtcacgagattatagcttagcctccttttcttacctttctttttcggtttctatttcagttgctttgtaaagatgtcacaatttctccccaatcttaataaaaaagatgcgcagctcttttgcgcattctcaaaaaaaagatgacgggcgatagcaagtatagttctattgatttatatgtctctgacatatagcttacgttcgcacatggtgttcaatgaaattcacttgtataatgtagatggagcctccccctgcctaacagaaagtctgaaacaccataacgttctattctatgcactgataaaatggagtttcttagagagccagtctttaaattcactatctgtttttttttttccatgggcctatttgtcatggctgtgctgctctatgcaggctcacttgtcacgaggcgatgctctgtttgcaatggaagagtaccgagctgcagaggatgcttatgctgatgccctggaccttgatccatccattcgccggaccaagtcgttcagggttagtgttttctgtgtctgtatcacacgcacggcaattgtaacactgtgaactctccattttgacacactcaaccccccctgtttcaggctcgtgtacaaaagctacgggagaaggttgccaatgctgatgtttcatcatcatcatagtccatccaaataggaggaagtttcacacggcaagaaatgtatatctgacgggcggatgggaaaattctgaatagtgaatagtttagtgaaacaatggaaatattcctgtctagttagttttactcattctatatggaggccgggaaaatgctcttccatcatctttaaagaaaagtccttaatcattcttagcagtgtacagtgtgtattaggtcctgtgtggagagtttaagattctgagaatctgttggttgataaccagcttccgaaaatccgagttttcatcttctggtttctagatcattttattgattttataacttcatattcttataatctgagtgacagtctacattatttgaagagctggagattatgcgagaagctacggctgctaaaaactttcccaaatagaccctcaaactgtcatacataataactatgcatacgactcccgtacaagtgtacaaccacaagttcataactagctctgaaaaatctggactcacatgaaggtaatccaagctacgtgattagtctgatgatgaggtaagacgtacgctagtcgctagtcgtatgtatgagttactcgtacgtataacacttctcaccagtatatattgtattgtctctttttcgctatcatatgtcattgatttttcgttgaagacgtcgtccaatttccaacggtgcgcgtgaggcaaactagaacgggccgcacgctgcacgtgggccggagtcccgttccggcctactaattcggccccgcactaaggcccaaccatcgtatagcttccgccagaagcttttcacacgcaaaacacactccctccatctctcgccgccggccgccgcgcgatttggggagcagctccccgccggaggctgccgcttctcgccgcgagtctctccagccgcgaggtgcgggtgagctctactggagtttggggacatctccggggcggagccggagccggagaaggaggctctcgatcgggcagcagcgcgtaatgtacggattccccccctcccctttcaccccgagttttctctatctatgcgtgtatgctcgtgcttagcttgcgtacggatgcgcgtgcggttttttctagggtaacgaattcgacaactcgtgagctttcggtaaccgctcagacttttgggtttggtacattgacatggagattggaagatggcatttcgtgtcccatttgttaaggctctgattccattggtttgtagcgcgcctcaactctcaagctcagtgttgctggtcttgtacgcctcaagttcatctgtgtggtttggcgtgcatctgtttactgttttgtatgtattggttgatgaattcatcgtttcgaaaaccacatgatatatagttcagcgtttatgtatccttttcaaggattttacaggagttgagcacgtagcagtgtctagttatatcaggaggattcaccagaatagagatttctgtagtcctcaaacatttctttcgaatcccgtatgttattttaaatctacctgagactgctaatgtttgattttctttatggtgttctatacggagtttcatttcagaaatagatatcaaacacccctgatactcttagcgcagtaaaatattcttccatacgaatgatgatgtactctaccagcatatgggcggttgttcctgttaggctctctcagagctcttccaggattccatcatgattttgttcttgactattttattcactaatgcatgcaccatttcaattttccttgtaaacccattagcttcccgaaaatattgttattttctttgtacctcccttaaatatgaacaggaaatcatcattttggtgagctatacagcttgaatccccttaatgcgaaaggtatgaaatatctaatggagaacattgatgaaaactcactcattcttcttctgattattatttatactattcaatgttatcttcttcctttttttttgttcatggacaaattatacacttaaccacagcttttaagcttacacatactctcttagattttattcataattgaataaactgcttaataattcccagagggtgatatctcaaaaaagggatgatatgatgtttcaccagttcccgaatgaatcagaaacttgcatattatcatatcctgccagttacatttgagtttcacccgaaggactgcattctgtatatattgtagactgatttcctgttcaaggtttattttataatgattggagcaaacccatcaaccaagacggatagggtcaagtttctgttactttactttttttttttgaacgactcgcacgagacagtgcgaagttctattgatagagcaggaaaaaattacaagattacaaccctagagggtcgtaaacaggaaaaaggaaaaaataccaccacccacacaccgacatcgccaacacacaagcccaggagaaggctagcatcggaccggccgccgctaagcgtgaccggctgccactagaccaacaaagggacaaccgagattgccccctaggggatgccaaaacgacgtcttcaagaagagaagcgacagaaaaactgccaccgccgtccgtcgaaactcaaaggagccaagactgagctttcgtccggcaatcacccttgaggggtaagatccacagctgacacaccgatgctccaccaccacacaagctctaccgacatgtgggacccctgcaccggcgtccctcgccggccagccttcgtgcgccgaagaccgcgctacacccaccagcagctcctcctaacacctaagtcgcctccttcaccgccggccgcgcctctcgcgccaagccggcctctaactccgccgcccgcgcctctcgcactagccggcctccactgccatcggctgcgcctctttgcgccaagccggtctccgacctttccaccagacgatgctgcgccggccaaatgcagccgtctcccacgccctcggctagccgtccaaggccgccatgcctctggtgaccgctgtcgcgaccaccagccaccgtctccgcgagccaccgccactgctagcggccacttcactgttgccctccgccacgccgccgccaagtcctccgccggcgtcgtcggccgacgtcgccgccgccaactgccgcaaccacccgtcgccgccgttgccaactgccgtcaccagctgtcgcaagtcgaccggcgtcgccgaccaccacagccgaccaccctctagatccggtcgagaggcgcggatctggggaggcaccgccgtcatcgccgccgagcaccgcgccgtcgccgcacagggaccaatgccgctgtcttcgcgccgtgccggcctcaagccgcgtctctcacgcgggtcccgctgccaacggtgcgcccacacagccgccggtctctttcttccccgcctccacacccggctgcacactgtcgtcggtatgctggccggtcgccgcctcgacggaggggatccggcctcccacgccggagaggacagatccggactggggggcgccggatccagcgaggaggttgccagattcggtgacgtcgcgcgccgccggacccgccctgtccctgctgccagctccacccccgtcctgtcgccaccgtcgccagcgcctcctccgccccgtcggccgccgccagcgccgcctcgtccgccccgtcgccgccgccgcctcgtccgccccgtcgccgccaccttctctgccccgccgccgtcgcctccccagccccggatctggccgcctccgccgccacgggcgccgggatgccccgccgacgccgtccttgcgcccggccggctttccggtgggccactcaggcagcgacgaggcgaaagggagggggaaggcgcagcggcggccggcgcgtgtgggggcactcgcatcacccctggggctggaacgacacgagcctatgtggggaactttcgccccagtgatcaacgattctgttactttacactatcatgacccattcatttgcatgataggtcacagaatgacgggtgctgcagtcacccaaagactttatggattgatggttctgtttcaccgtaacggttgtcagttgaaactgagcctgagtgaagcgaatatttgtatcaggattcagggagatcctaccatcttatttcttttgaagatgctaactgcatatcacaatttcaacaatgaggtaatttagttagctaaatattctatggaggattttttttttttttggaaaagttgttgaacatattacatatctacctctttcttttcgtctgtgtattccagagttctagatgaactcgtttgaaagctaacaactaatgggaaaatgacagggcttgatggcttgagtagaaatttcagtggatggcaatgctccacacttctacatgtcaaaaatcaaaacatttccttctgttattggatgtaattaactaccttgctgacatgttcatcatttcatccctttgggttcctaacaaacagatgccatgcaaggtaagcatacgtttcatgcattaacctcacaaatgcttaaattgtcgatatcattaatcacaactttcctctcaatcagtactgatatgctaagagaaataactcaatctgtggtttatgtaccctttttcaatatcttttgaaatccatttacattttacggtctgcgtacattcttcttctgaagttagtgacaaagagtgaaagaggtgcccattggagaggtactacctctgttatcaaaaggatgacatcctagagaacacattcaaatctcgatatgataatcattaaaaattaaaaaaaaaggttaagatgtgaaaatgacattgatagatttgtcatgaaaaacacattcacatggttatatttttaataagttttatacatatataactagaaaaagtaatgatgagagtatgagacatatacattggagattgtgtcaatgtccaaaacgacaagtaaaaaagaacataggtagtaatattttagcatgtgtttgattgtgctttattaaatagactcctttcttgtgttgtgtacttctctctcttacatatgttgcttgtgtacctgtaaagtgggacttgaatatggttttagcctttggtagttattttgtatagcggcagctttttttaatctcaagtgtgcactccaataatcaaagaaggtgcttttgagtgttacaaaaattttaatgggtgccttgtccgttgaactaaagaaaacatatcatgatattcagaccatggttcagaacttagtttcctcagcttatttactgtatatttgctagcagttgcaagctcatcctatggaactcgagtttggtagcatctgattgagctggaagaggcattcactttttttgtgttgactggttttgtggaagcacaaacttactgctatttcctcattgagtagctttgctgttttccacctacagtaagtattttctttttattgtccttgtcgtttttaagctcaggtattgaccgacagctcacattttcctaccttctgtttgctattattttgatattgacagaacaatggttggtttgtaagttgagaaatgtgtgccagttaatcagacatttctctgaattctgaacatacacaatggaaagaggcaacaagtaaaatgactaaaataatgtatgattgggccatcacttatgaactaacacatttattagatttagtagccaagcatttcccaataacagtcatcactgtttttattttccaagacttaatttatgttagatacattacatttggcatgctacttccttttatctttcttttttttttggtaaaccatggtgttttctcccttttttttgtcaaggaagataagtttgttcttatcttatgtctgagtttcaaccaccatggactccatgtgtgccctacctaatcaaaacagatcgtttgctcccctattttgcgggaagttcaggtatttttgtcgcctgagtgggttcacatatgacccacaacgctgaagtctgaatttgcaattccggtcttcagagctgaccgggccaatccggcaacagctttccaccttgctgaaattccacaccagattagcgatagggaagatgctttctttcgtgccacaacagattactcttaaagtttgatattgtggggccaccacctggattggtttgagcacatgcaagatgataagaacattcctagcatactctacctaattaaaaaaattgaaaaaacaggaaatattagctgtgttgattgtgatgtttagctgatttgcttcctgtgtgatacagtgtgtggaaggagaactcttttagtttatatggatagctttgttgatctggtactccttcattgtgtgccaacattgatctggcaaataaataaataccatatcctgtcctagacattctattgcctatgacgcactaatgcaaggttttctgaaaatgctcatatcatttatcacactaaatcccccgtgtttttcagtcatatgttacagttgtagacaggacttatgagttgccacatagtcatggctcatgagatcattttaagcacatcaaagcatcaaagtggaacgagaaccaaatgtgtgtgctgatctgcaggttcttttttcatacttctaaagttctaattttgattttatcttcttctttcactctgagtaatacattgttttttctcctcaagtatcaaggcatatgttacatgcaaaatgcctcttttttttctatttgctatatactccggtgttaaataggcatttatttattttcatatttaggtccagaaacgttgaattcacaattttcctagcttgccagtttgctagtttatactttatgtatgccaatctttagagtttccctagtttgccagattgctatagtttatactttatgtatgccaaactttaggaatttccctagcttgccagattgctatagtttatactttatacaagccaaactttggaattttcactagcttgctagatcgctatagtttatactttatgtatgccaaactttagatgtacctatcccacttgtacatcattcttttcaagatcaacggggccaagtcggccatctgaacctacaatacacgtcaattcaaaagggtctgcgtcaacggctccttaatttcaggtttataaagtttttcaaattaccattatcgctcattatccatatgttgtgtgcagatcaagttttcagcaggtcaaagtcgatggcccgaacctggttttcaaaaaacagccaatgggcgaagaataaaacgggcgcccacgtttctctcctaccgtttcggatgcgtggagccaaagcgaagctagggtggtggcaactgtagcactggaccccgtctcatggtaaatttttcttcgccatcacctgttgctgttgctgttgccacccccaacgagtctatcaggacacaggagaggtatcaggaggtatggcctttgctacttctgctaatctgatgatgtcggtattgcattgcatatgatacagaagtgaagtgtgctgtttgtagcgttgcgtcatgcagaatgggggcgtaacagaacatgggaacatacccattacacgtgtgcgcgacaccctcaaagacggggtggttcgttgcacgggtaaaatatctgtatcttccctgcaagtgatgtacggtttgttgtgtggcatccacggtaagtaaagtaaaatggctcggcaaaaatcagaaaatgacgtggtatgggcacagacacacaccccaaagaaaaatcacgataaaatgggcgtgctgttcacgctggactcgtcataacctaggctaggctactttgtgattcgatcagcttttgggtgtgtgtttagttcacgacaaaactaaaggtttgattgaaattgtaacgatgtgacggaaaagttgaaagtttgtacgtgtagacaagttatgatgtgatagaaaagttgaaagtttgaagaaaaagttaggaactaaaccacatttgcctggcattggaatcgatttgatcaaatgtcataaagatgatttttgtaactgtttcctatgaaattttcgttacgactttaatcgcagaagcacattctagtagaacttgcatatcggaggagattttttttttctttgatcaatatgtacccagagaaaatattatggccccatccttacctattagcccgtacattttcttgtttataagcctagctgatcgagtcggcacatatgccatctgacagtaacttactagtccagtgtgaactgcagaagagtgcaagccttgcacttgtagttgtacgatgatgtaggatgcgatgtcaccagtggaaacgcgcggccctgcacggagcttgagtgcctggagattgtaagatcaaatgtcataaagatgaaagctctattagtgggggtaataagccagtgatcccagtctagttattaatgcccttaatggtacgataaggaaaaaaaatatctttaaggtttagccaaacgttccagtatgttctgctcgtatatctttagcccgcaaggtaggagaagaaattattacgtgtatgtgttcattccagtctgccaagtacctacggtgtgctgttgtgcaattacaagatcgctaaaacaagaagggaaaaaaaagaatcgatcccaatgttcagaaagaaaacgtcatgccaaggtaaaaagtagatgacgccacgcgcatactcgaagtaaaagtatatatatgtggtggattgcgcatacttgaagtaaaagtatatatatgtggtggattaccgataatctcgattaagtccagtattaaaatggacaagtagagagctaaccctaattagattctgaattttctttttcccctctcgatcgataccaaaaggagagacgagagggacacatnnnnnnnnnnnnnnnnnnnnnnnnnnnnnnnnnnnnnnnnnnnnnnnnnnnnnnnnnnnnnnnnnnnnnnnnnnnnncaacaatcgcgg

SEQ ID NO: 18454 - DNA, 1740 bp, Oryza sativa
  unsure (1)..(1740): unsure at all n locations
cggtatttgctgtatcgtttaatatggttagggttttttcgcgtagtgcggtaattgctttcgttcgaatgtgcataagcgctangtattttctgctntnnnncnnancnnnccgcggctttgttgaatcgctnnnnnnnnnnnnnnnnnnnnnnnnnnnnnnncgccttccccctggtctccggcgaattcccgtggaccgaggccttcaacgccgtgttcatccagctcgccgccctcgccaccaaacccagcgaggtggacgccgtcgacgaggccgtcggcaagctcaaatccgtgctcgacaacggcgacggcgacctcgacgaggcggcgctgcgggcggcggtgcaggaggtggagaggcggacggaggagctgacggcgccgttggaccggctgtccgacgccgtcaacggcgtgttccgggcggcgctgtgcctccgcaacgcggagctcgggagcatcatggtgggacccgccgaaaagacgccgtgtaaatagccgtttccaccgtgtgtcgtccgtagccatactggtatgtcactgtataaatacaagtataattctggaagtagtacagttctacaggtacagggcaacatggggtggtgtctcagccaaatgcagtggtttggtgctttttctaccagctgttactactatctgtgtgtcaaggttgccacatatgagaacacagtgcaattcgcacccttttgcagatgtggaatccagtaaaaacttgggaaaaccgtggcaactgttcacctacctatgtaattttgcggcttcatacatactgtatgtataccatgaggaactttgtgaagaaaatctctcttaccgacttcaccagttgaaacagacacattaatgaaacaatcagcttattatggctcagattttttttttttggcgagcgaaatgaaacaaaacattaatgcacgaataattaagtattatctttgttgtaaaatataataacatttgattatctaggtagacaaacccttgtatagagccggatgtgttaatgtattactccttccgtcccataatataagagattttaaggtttagcttgcactgtttgacttctcgtcttatttaaaaaaatttagaattattttttgtcacttactttattatctaaagtattttaagcacaactttttgttttttatatttgcacaaattttttgaataagacaagtggtcaaaagatgtaaaaaaaactcaaaatctcttatattataggatggagggagtacaaacttgaaattttagattcatttatttttctaaaaaaaacttttatataaaaagtattttgtataaatcgcatcatttaatactttagaagatgtggttacgatgaatgggggaatcatagctagggagtagcttagccgagccgtacaaacaaccagcgtgagagaacgagcaacctggcaccaacggcgatcgaaccgcggccgcacgtacggcgaaaatgtcagcggcgcggcccgcatgggccaccacggcgtgggcgcgagccgcgaggttggcttgccgagaggcgcaaggaggcgctggccttggcgacgacgatgacgacgaggacgccgtggcgcactcaaccgcgcaggcgatcgaggtcaagcaccaccctgccacgcccacgcgcgcgcacgcacagtacagtagtcgcgcacacatcgcccatgtgtgcggtggtcggagccgtcacgcaggcag

SEQ ID NO: 18455 - DNA, 10294 bp, Oryza sativa
  unsure (1)..(10294): unsure at all n locations
gtggtgggggccccacccaaagatatttcgggggggacatatgcgcggggggcacaggttttttctcgccccaacagaaaaaaaatgtctcccccgcaggggcggctgaaaatgagggcgcccccctctttttggggagtccccccccgcccacaaaaaagggggcgttagagaaactttgccgctcccatgggggggccccatgttgtccccgtggtctccccactgtgcccctcttgggtgggatagggggtggggtttcccaaccggaatttcgggtctttcctcgttttctcgaacgtattggggctacagtatctttttacacgcatccggtgccagcgaggagggctcggtgcatctcacaccgttggatccgatacgatcgtactgcctgccaggctgccactggccagtgcatcgtctacatacaacggctgtgtacgggctccatctcaaaatacaacaatataagattagatgagacatttcctagtcctatagctcgtccatatttatggtactaagaattatctcatctgattttatattcttatattttaggatggagggagtagtagttcttcagaatgtgtttgttttagctttctccagaagccgggtaatcaatatttagcctgttataaaaaagaaaactagttcttgttcgctttgctctgcgttctgcactgggccgttggctagtagggccgcaacttccactacaacaattaggcccaggatacgcccatcagctcagagcctgagaagtgagaaccaagttagcagttggcagttgattggcacgtcggtcaaacgaggcaaccaatcgccgagtcatactagacatgcaagaatgcaagattgcagctacgccaatgcggcccacgtagtcgcaatctccactattccctccctggctgaagactccaaaaccgccgccgcctcctcctcctgggacctgggctcctggcttgccgctcgaccatccgcgctctttacctgctattaattcgctctccgccctctgcattgcaccatctcgcgatcggtaatgacgacgacgaaccacctcgtctcccccgcgctgctgctgcttctcgccctcctcggcgcatcggtccggcgtgccggcgccaccaccttcgaggtcggtggggaacacggctgggccgtgccgccggccaaagacgccggcgtgtacaacgactgggcgtccaagaaccgcttcctcgtcggcgacagcgtccgtaagatcactcgatcgatcgatcaatctccatttcgaataattctgtcggcaatgaacagggaaagtgatttcatctctagaggggatattcatcgtttcgtgcatgccacctaaatagtcatcgaaaaatttaaaaaattttgacaaaatatattaatatgaaatatattacatcataaacatttaagtttaaattcaacttctaccggttgtaataaaaataacaagtacgcgacattgatttgcatttgatgcagatttcaagtacgcgaaggactcggtgatggtagtgacggaagacgactacaacaagtgcaaggcggagcacccgatcttcttctccaacaacggcgacacggaggtggggctggaccggcagggcctcttctacttcatcagcggcgtcgccggccactgcgagcgtgggcagaggatggtcatcaaggtcatcggccacgacgcgcctccgccggccagcccgccgccgccgccgtcgaacgctccccctacaccgcctcaccccagcggcgccgcctccgcgctaggcgccggcggactcgccgtcgcggccatgctgctgccggtcttcgtgtacggtgtctgatggtcaccgtagctgcatgcacctgcgtgcatgcccgatcgaattgatatcgtcttgtagattgtcaggtctttgcgagtgttatgcttagtgatttttgacgtgctcgttcattgcaatctcgtgtaattcttacttagattttttttttgtatttggaattgactttggataatttatttgtgactttgctgaatgttgcatcccaaaccttcagtttgcactcgcatttttctcccgtggaaaaccgcgcctctcgttgattaaactataaactataaaccatctttagcggaccatcctttgtattgaactctttgcgatattataaaaataataatttggaaaattacaattattcgattgaactatcactttgctataacttcgacgtggtattttacaaaaccaaaacaacaaatggtttttatcaaagaaatataactctatctactatgtgaatgatatataggtctgacttcaaaaaaaataacatgagggatatatatgtggagtcaaatttgttagacaaatcttaactaaaagattcggatttttcctttcgtcaccaatttgtcgtccgtacgctttttcgtccgtacgcgcagtttacacagatccgatttttcgtccgtacgcgcttttgtgtgtgatcattgcccagtaggccacatctgtccacaggcccacaagcaagcccgggtccaagcgacaagcccataaagcctaacccacaagtccaggtgcaccacaagcccacaaggccacaaaccgcaagtcctccgttttccttttcttctgttatttctaccgctattttttagcgctcacactaacacgattttacagatttctctcgcaggggaaaaatacacatacacgaatacaatcacaggcaagacatacatatagaaataatagaaacacacaagaaaatacaaaaatacaaatcacgaggctcttcctcgggggtcaagccacttccacgttatcattaaactgaaccctgaatgcagttacaattccattaggtttatatataactcaagaaattctaatgcagttacaattccattaggtttatatataactcaagaatttctaatgcagttctactccattacggtaacacattgaggtaacaaaattaatatgagatcatatcatagtagcatgaaattaatgatttgatttaatctgcaatttttgaaccaccgtgtcatattgattggaaaattcacagtaacaccttgaggtaataaaattcacagtacttgaatgtttgcaaatatcaatatgaacagtatcatttatcatttagaggttgagtttcctactttagctgttaagcttcaagactaaattcaaactactgaaaactaaccaattcaattaagattggtaatttcatgacaaaaaccttaccaatttccgaccagcggcggtgaaaacatgaacccagtttctcctccactcccgaagttggaaaatagatttctacaggaattgacatagaaaaatgagtagtttagatacttctggtaatccatagagccagacatgataatttttagctgattaaccttcaaggctaaattcagagaatatgaaaagtaaccaattcaataaataatcaaacacaaatccataacaatagctgcccagtatcatgagaacatccctcaacacgggaatcgaatgcatgatctattgtataaccctgacagcaaaatcatagtagaattcttagtcaatttgaacacttgccttagtgctcattataactaatataatcgacaccatacaattatcatacgaatataatctgaattaattggatttttctgaattgttgagcaccaaaccggttttgttgggcgtcctaagattttggagatcaagctagcagcaatggtctcatttatcaagatgatcaactggtaattaataatggcatttgtagtcacaagatgtatcattgcattttaagggggcaaaaaaaaaaggaaaacaagcagttcagtccaggaattaagctgcctgacaaattttctcacttacagactagcatatgtatatgtatgtttagaatttcagaatggaaataattccattcttttgttcactatagtatttatcgactagattcttgcactaggaagctacatgataacataatcataaaaacacaatttgccctcctacttaagaaatactactaaaattttagtagtaaattctggaacattgctatcgtccacgagccccaccgagaagaacgcatcaagattcgaccaatatagagtaacaggacaagtttttaatgaatacacttctccacctagacatatgctcttggttgatccactcaaaccaaacaaatcaaataaactatttgtccaatctaattattctgacaaagaaaaacatagcaaagctcatatcagcttaaaaaaactcaccggttcagacacctcgactgcagcattcgagacaacctccgatgacatcaccactccatcctaaccaccatctctgcctcgaatccactcaacaatccgctcctcccctacaacatagagcagatggacagtgtgttacctaactaacatgttcccaacctcggactgatcaacatgttccagaatttactattttcacatacgcttgagtataatgattacaaaacatattattttgtcaaaacatgtgtgacctaatcaaggatgctgaaatactacacatttttcccaaattcaattcttcaagcaatatatgtctaaaagattaaaatatctgtataacagcttaatcaatcctgaagatgttggtctcacaaacaaagaacacaaattccgaaagaagaaaagtgaacatgaactactccacagacatgatatgctcaaattaatttttagaatcactgactttgtaacaagatatgaccttgtgtggcaactaatgaggtatattcagtataaaaacttcagatccatatagtttaaatgagttcaataatggttgaccaataattctagatgcgaaaaatggataaaaagtttgcatgtgaaaatagcagaacagctcctacaaagtctaagtaatcatacacaggtacacacaaacaggatcatcaaagagtttgtagtcctataatcctatattaaggacaaaactaaccccaatctatggcagccataggacttaagcacttagataaactgaatcagatatgctttacaggagaaaaaaatttactatgtttagatatctgataagtttacaccaatacccccaacaagcaaaaaaaaaaaacacccatccatatccctcggacccccacatgcacatacacagacaaaatcatgtctaaccgtgtaatcaaaaagctaggaaaatgttaatcaaccgagaacgcacctgaaatcatgaagaaacgcccactatcttcagtgccaccactcggctgcgctctcctcggtccaccttcgtctgcaagcttgaaccctcctctccggccggccggacagctagcggggagtccgttgagtgatggtgatggaacgagtggggatcgggggagctcaagagcaatgtacatcttcttggcgctatcggcggctttggtgatggagaccatgaaacgcatacggtctcatcatggacatcggcacctcttgaaaccaattgccgtcgtcaccctaggggaggccgccgggtccgccctcccgtcgtcgctggcggcagatccgtgcgagaggggggcggagagacgacgagaatcgtgtgagaggggaagagatcgccggatccgcacctcccatcaccacccacgaaggatccgcgcgacagtggggaggagagacgacaggatccaagcgaggaggagtgaagccgcccacgggatccgtgcaggaggggaaggggtcgccggatccgcccctcccgtcgccgacgatggcggatctgcgcgagaaggaggcagagaaactatgggatccaggcgaggaggggtgaatccgtctcaatacggaaatgcactatcgaagaagctaaatgcaatagcaggtggtggcatggtggatctggttggcaacgacggctttgagcaggagtggctgctggcgatatatgaggaggtggagaaagacacaggaaaacagggagaaatagagagaacgagagagagagagagtggtgtgtaagtgtaacagctctcattttctctgacctcctcgagctatctagaaagtgagagctggcagctggtcaggttggtggtgtgcaacagctcatcacctcctcactattttacttttctaatattaacataaaaaacatcaattcttaacttcaatatttactaagacaaaaatcataaattataaaaaatgatataaaggtttcagaaaagaaaataaaatgcaaaaaagtagcatcgatattcacaattctaatgtgtcgtcggtttaactccacacatttttttcatgtctcaacacgtactatatattctcatagttaaagcacatagattaccagaaaattccatttattttttattaaacttacctacttaaaaaatatcaatatttatgttcatcacataaatttccatccgtcgccttctgcgcaaacacaattgtaatgttcttccaaacgttcttccatcgctacaaccatccgaaccacatgtcagaggcatcatccacatccctgttgacagaaaacacgaggcctgggagatctgcttaactccagtacaggtccaaagctcgcattcgggtgtgctagcgtgccagttgatttgatcctgtaatcaacaagaaatagaagcaaagaaaccgcagttaaatctataaatgatagtcaatcggctaggtgccgatgacatatcaattatctttgagccgatgtcatatatgcatcgatcggcagtcattaataaataagaagggactaaatctactcgatcaactgcagatattaacaatatataatctttatatcgatatatacttaaattaagtgattgggatagatcggtcgctatgccgagacagtataaatcacttagatcgaaatatatattaataatgagactatatacgttcatagtataaccgatcagatagatctagcatgtatcggctaatactctgataccaccttatattaagatatcaaagcaagtagaatatactaaacaacagcctaacatacttaaatgcagcaagatcttaacgtaaagggcagatttaacatgtcaatcaagcatataggataaaaagtagttaaatcaagtaagatcggctgaaactccgatgctaccctaatcagcaaccgagaagtagtagagattgagattctaatcacgactcataagatcaaacttaactgatgcagctataagtatgaaaagaaggacaatatctagacaatcaagccgtcggatgtgtcatagagtggtagatatcctatataatctaagtcagcatcggtatttaacttaatcggctgccttctattgacggatgttagccgattgtaggttagatatcaatattgccagggattatgtaggatatatgataactcggcgaattacataaacaagattagagtgtcataaagatggaatcactaatcccgagaacgcaagccgtcataacaagttttacctcttgttgaagatcgaaaccgatgcagctcaactcgaaagcaataactcgtcgaaataaaactaaagcaaaaagggtggcgatgcgccaagattgtattgaacgtgtgttcttttagttacatagggctcggggtctatttatacccgagaattataagatatgtccataccggacacgactattatctctaacaaactctaagatatcataagtctttgcggcagacttttgccctaagcatatctctaaggaaattacgtaaaacatcctaattaatagatacaattgccttctcaggactctatccatgtgcggcaatcatcttgaagcatatatgttgtacaccaagtcgtattgccggaatcggctgtatcacctaacccagtctgattcagatttagtcgattttagtcgtagccgatctggactccagccgattcttactctgttcccgcaacaatccttatttccgactccgcttcgatcccatcttcacctccgacgctgatactaccaaattcggttgctaacaatcccgcacatgtagggaaaattaattgtctagaaacaaacacgacttcttagtcatcgaacatatctctgattcttatgattatggttgggtgctttaataaatcgttaaaatcctacttcaatcactctgcattacacagtgcgacgcacggggatttacataaggcttccgggttttttcgtcaatctttttttcaccctttttctcatccgctttttattcatcgccttttttcgtccgtcttatttttttgccttttcctttttttttccatccatcgtttttttgcctttatccttcctctcgatgcagagagtcgacgtgatccatgcgggaggggaagaggtcgtcgaatccactcctcacgtcgcacaccgatagcgaatccgtgcgatagggaggcggagagatgacgggatcagtgtgggatgagaagagttcgccgaatctgcccctcccgtaaccgctgacggcggatccgcgtgagatagaggcagagaggcgataggattcaggcgctggtggtggatcagtgtgcgcatcaacaatggcttggagtcagtgctcaatttgtttggcgacaactacggctctgttctgatgctagatacaatgagtgattttttttgtttattattttttattgttgacatcaaaatcaccggaagtttcactttaatatttatttgagataaaaaatatcaattgtaaaaaaatgtgtgctatcattcacatgtcacataccggtctcaacgcgggtccatatatgatagtgaaacaagacgcatgcttacaacgtgagagttgacataagcgagaaagcaggcgtaacctctacaaggctattagtaaatatccaaaagtattttttatccatcttgattattattggtattatgaaaattttctattttaaatacatttttttgttaatcacaatttttttgtccattgcctcttgcatgaaaatgaccatggcattcacactattaactcatcaggtacatcgttcatattatacacatacacgtggaataattgtcaaaaaaaactctgcgattattattgacatactatattgcttaaaaaatcgttcagttaaacttcaattgccgcgacattatccagtgcaacgcacggacattttactagtaaagttaaaacaacgagctaaacttgcaacgaactaatagcttcaacaaataggtttctgagatttttctttttttaaaaaaactccaccaaccatggcaggcctatcaagaaattccaagtcgacgtacggtgacgtgctagtattatacatatagaatggatttggcgtggaagaaaaacacgagattttcttagtgctgtgtttacatttcctccttgtctttgatgcggaaaccattacctcgtttttttttctaagtattaggctacattcggtacaccatttttctttttttaataatttttcacgcgcacaatttccgaactgcatgacaatatattttttttgcaaaaaaaattatatagacaaatttatttaaaaacgattaattatttttattttttaaactaataattaatgaattatgcgttacctcatttttttttgcaggatggagaaattcctaactcatcctatgaacgtgcatgcgtaggttcccatcctccactaactcgttttcccacgtgtacacttccggaactattgaacgatgatttttttttctaaaaacgaaaaacttatataaaatttacttaaaaatcgtattatttcattttttaattttttttaatacttaattaatcatatgctaatgagctactttattttccatgcaaagcgaaaacgttcccaaccaacaagaccgaacacaacttttagtgggattgaaatcatctgcagtcaaatgtatggtgtctttgtcattgacatgctgacctagggatcatcagactcatatgcaatgttctaaatctcctgctaagcttcttagcggttgagctctccagtatctaagagcagctatagctggctataactgcagctaagacatttagcagtttttgaaaatattagaaaaaaactcaattttttcatagaatttgaactaaaaaaagacatatcacttacttgattgcacatagaggaggattggtgaaggggatggggagtannnnnnnnnnnnnnnnnnnnnnnnnnnnnnnnnnnnnnncattcaaaatcg

SEQ ID NO: 18456 - DNA, 1256 bp, Oryza sativa
  unsure (1)..(1256): unsure at all n locations
ccacatagagaaggattggtgaaggggatggggagaattggtgnccgttcgttgtggggaagaggcagccgccgtcgccgagagaagtagcagccaccgcgggaggagcagtcgccatcgctgggagaagtagcagtcgtcaccgctgcttgagggagaagccgccgccatcgggagacgaagcagccaccgccgctgcttgagggaggatccgtcgccgccgggagacgaagcacctgccaccactgcttgggggaggagccgttgccgtcgagagaagcagcagccaccgccgatgcttgggggaggagccgccgtcaccgggagaagcagcagcagccgccgccaccgccgctacttgggggaggcaccccgctgccgccaccttaggagccgctgctgtcgccgcaagatgccaccgtttcgatcgtgtctcacaacgcatgagtgggagaggataggagtcgactatttagggtttgttgttgggttgaactttatgggccatgcaagtcgaaagcccgttttcagtttttgctttctaaatttgtttagccacagctaagtgccgctatatacgggtaatttagcggctatctctgactaagtgcagctattagtggttgataaatcatagcgttaaaattgaagtatcctagctgttttcctctcaatccgctatctccggctatagctgccggagatttagaatactgctcatacgtcagtaacaaagtcacacgacttcaactgtagaagtgtagaggaacctgatcccttttagtgtggtggttgagaggagagtattttgatgcaattgtatgggattagactctgggccaatcccccgaaactgatctgcggtccacccgcgcctctacgtcgtctttgttggaccgtagagaaaccgggccgggctagcgcctcggctcgcagacgccacgcgatgtctctcttcgtccggggagcaacgagccgcacgagaacagaacatacccccacacaacaacacgcacagccataccctcgccaaaatcacgcgccaaggacggcggcgtgggcgcgccaatcgctccaattctcccgcgcgcgcgccactgccacatcgggcacagcgctaccccgctctccgcctcctcctcctatacacatcgtctgcctccccgccccgctgctcgtcgagcaaaacgtctnnnnnnnnnnnnnnnnnnnnnnnnnnnnnnnnnnnnnnnnntctacgcaattcgatgtccgcg

SEQ ID NO: 18457 - DNA, 719 bp, Oryza sativa
  unsure (1)..(719): unsure at all n locations
accacaggagccggagatcaggatcccattctttaaaggggctttcaaggggcttgggggggcctttggcggttgctccggcttgtgggggggggcccctttttcttctgaagccttttgcggggaaagagggccgcccggctgacacaacctagcattcncccgggggggggggggggggggtgggcccccggggacccccttttgggtccaaagtcccaaaaggttaggtttaccccggggcactccccaccacaattttaggtttcagtccggaggaacgcccgccccttagggtttgggtgctgcgggttttagcgtcggggggccccgcgaagctggagagctgcttcgtcgaggagacgtggttggaggcgctttccgggggagctgcacaaaccttcggcgctcgagctctgccgcttcgtcgcccacgagaggttgcatagcccggtgcccgtctaccccccgccgcatctagtcttccacgcgcttcacgccaccccgttcgaccgtgttaaggccgtcatcatcgggcaggtatggcatcctcccccattttctctcgtcactccataagccaatccattggcgtggatttctgtgctaaaagaaggtatccttttcaaatatacatagcagcgtaaacttgtggccatttgaccttgggtacctannnnnnnnnnnnnnnnnnnnnnnnnnnnnnnnnnnnnnnnnnn

SEQ ID NO: 18458 - DNA, 744 bp, Oryza sativa
  unsure (1)..(744): unsure at all n locations
cgcggacttgaatgcagtgcgtaccaggaagatgtaaccatttaaggatgggcagagtaggttgatccatggtggccatcggtctctcgtggtccactcacatgttgcatcatggcactgctatgcaaagttcagttccatcttcccccgtgtacttggatggacaaatgctatttattcgccgaaagcttgcaagccatcaacagatcaactccctctagccccctggccggcaagaggcgtcttcgacgtctagctccgtacgtacgtctccgatctttcagccggtgagctactaaaatcatttatgatctgcgtggttggttggcagtattgttgagactgcaacatcgacagagcgatctatcataagctcagcttaggctgtgtnncttncnncccccttttttatcgtcaaaaccactttctccattggttcagtgtgtttccccctctaaaactcctaatatattggttcttttatcgctctttctcttttctccgttctttacttctctggtcttatttaattattacaattacacgccccccccgtagggtttattttttttaaattggcggccaaattttgtcttaaaatccggaataaggctggttaaacatttttattaaaagggccaaaatatttcataataccttaaaaagcccttatgttgggttataaattaagctcccccttactgccggtggtataaaaatatttttgtttcattaaaaggcgtg

SEQ ID NO: 18459 - DNA, 873 bp, Oryza sativa
  unsure (1)..(873): unsure at all n locations
gtgggnattgatagactgnnnnnnnnnnnnnnnnnnnnnnnnnnnnnnnnnnnnnnnnnnaggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatttcggctgggtgtgcgaagtgcattgcaattcaatgggcgcgt

SEQ ID NO: 18460 - DNA, 6716 bp, Oryza sativa
  unsure (1)..(6716): unsure at all n locations
cggcgggctttgaanaacctcttgctgcatgcccgcaggtcgactctagaggatccccctcgaccacacatgcgccgcgccagcccgctcctcttctccgctcatgtcacacgcgtcgtgccgtttgcgttgcacgacagggcttatttttggaatgttttttaaaagggcttcttgtaaaaatgttctgaagaaaaataggctgtgttctacccttcattttcccaacccacctctctcgttttccacgcacacgcttttcaaactgctaaatgtaatgatttatgtaaaaactttctatatgaaagttatttaaaaaaatcatataattcatttaaaaaaagttaatacttaattaatcatacaataatacgagcttcgttttgcgtgccccaacccctcctcccaaacccagccaaatctgcattgtgcgcatgttcattctctctgaattgcaaaacccatcccctgatcgttgtttatttgaaaatgagataaataacaaatggctaaatatgctttgagtaaaaaacgactacgtataaacatcatctctatcatggttcgtcacggatgagcaaaacgatgagctccgcaagctggaaggtgtcgtcgttctccacagagagcggcgacgtcacattgctcttgccgaacccgtcccggcactccttcaccgcgctcgccgatttctccagcgatgaaatcgcctcctggaacctgccgcccttcacggcggcgccgacggcggcctgaacttgcagtatcccgccgtacaccggctggcatgacttgaggcaccgcgtcgtggcgtcgccgccgccgccgctgctccggagcatggcgtctatctcggacttggtgctcgtcgcgttggccgtgaggaggtcgacggcgatcaccgcgaactccttgtagctgccgacgttgctgctccggttgtcggagctgagcgcgtcgatgcagaacgtgacgccgatgagcccgcttgccgccggcgatggtcttgcacgcaccgtacacggccgagttgatggccgcggcgagttgagacgcaacaattaggagaacagccaagaggaagagagcgctgacgccattgttggaggaggccattgtggaaacctctgcaagtctgtaagataatgttgaaacaggatggttttcttgacgccattgcgtgtcaattatataagcacaaaattttgcatggcatttaatgacctgatcgatcgtctcgaatcaatgattatatcgtggatttgtagaatcgattattgattttccgttaatttctctccccattaaatgatgcatcgtcctttattgccatgagggaatttatggtttttttaattagatgaaaaaaaagagattccttttcagagtttatggtctatgaaaaagatgctgttcaaagttttgccccgtatatatgccatcatatggatgttttcatgatgttcctcgttttataaaaaataaatacacgaatagtcatgaacatttttagaacaattatttgatggtgggcccaaccaagtttagtacacaagtatagagtatcccatatttaggacaataacagtagcccctgacctctattcaaatgtataaatcgatcacattagaatccaccgaggagccgagctgtcggaatagatttactttcagtagcacagaaggaatttatccgtacaaatatcatgatggagaaaagcagtacaaaaaacacattgccatcagctgctataagaacttgaatatatagatgaaagtatggttatactatttctgcagccaaaataaaaccttaatgacatcaacacaaaatacaatggaattgtggaacaaaaatatgcggtaactttaaaacagccatctactcctggtgacaaacagccatctacatctggagtatgtagcaacagacgagtatgaccacgagtttactttgtctgcaaagcacagataagtgacacctggtgagcaatgccatcaggtgaacacagcagtcagcagctgacttcatttagatgttaacagtttagtggtaataaaataagagctcatttgattcctgcatcctgattgaagattcaagtttttgtccatgttctatcgtcactgtcccttggtgagacaatggaaggttaataatctggaatagatgcaaaggtgtatcctggtgcccctctcgaggaatagtaagcaactcgagtctcataaaaacctacaaaacaatgtcagaacaatataatccatctcgctaaatggatacaatagtagagctgtctactatctacaacaataacaaaggacataattttacactgatgcacacttaaatagatttcatatccaaagagtatgaccattctgtttccagtatggcactccctccattccacattataaggtgttttgggtttgtcctaagtcaaacttcttcaaatttgaccaagtttatagaaaaatgtagcaatatttccatcaaactacactaaaataaatacttttgaaggaagtcatggcaaatgatcaataaataattgggggaaaaatttcattgagaagatgaaaaaaattccatgataacgttacgtgaaaatgtaaggtaaaccagtgtacattaacataccaggaaggaaggcaaggatgcccaggaacaagagaccatatgcctgagagttatccccctccatgtgacctgtgaatataaaatatgacaggaagagaagagaacatcctaggaggaggaggaatagtgccagggcaattgatttccacgggatttttctgagggattttggggtgtaagtgaaccgaaggtctacatcatcagtaaggttgctgtcatccctgtcctctgtaggaagaggagcataccccccaacattgcgtctagacgccatagtgcagtgcctgcatttgaaacacatactgtaaaatacaggtagaaaatggcatggtaatacacagtaagatctaagagttcaactgacaaagaaaaattaaaatacactgttgctgttaatgataatccaaaattacaaggtttgaaaaaaaaggtgcaccaaacagtaacagagatgatatgacaaacaaaactaaggttgtggttgtcgtcgcatgtgccatgccaagggccttaatggactgcatgtgacatggacatcacaaatttcatgtgaatcattctcagagaagaactattagtttttatagaatgattagaaaaatataagataaaattttctgtaatgcgatacataatttgaaatgaactcaaagaacagaatcaaagacaagaacaagatggcataccagacagatttgagtttctctaggttgttgcacatataaaataaaaccttatgcatcaagatgcatattaaagctttgatcatctacaatcatctgcacgaactaaggctaaaatgagcactctattctacaggataacaacctgaaaatatggactaaacaagacacatctaataattttaacatggtgattattaatcgttccttttccttaataatttcaacatggtaagtatgtaaggttctaaaagtaattcaaaattggtactccaaaagattgatactttcaagttgctgcaagatagccaaaaatctcacagacaactctagtgttgtagtcattccaatcagcagaatctatgggcattttaacacccttcaaagacacattttgagccatgcctgtcatccactcactcacaccaatcctttttcaataccaacatacatcataggttgaaaattgagatgattgattctgaacagagtctacaagttgacatttatatgtacagaaaagaacaacatccacacagccatagtgaaccatacagaaaagaacaacataactaatagcagtgatacaaagggactagtttctcgagagcaaatgtgaaacatacaggcagttggaacggaaggtgtcatgaaaacatttctgatgtgatgtgcatctcatgtaaactataactacagatcgataatacaagtatccaatctaagttagtactaaattttgctgaccaaatctttcaagaaatctaagggtgtgtttggttgctcgtatccctctagcctggctcatctccctcatccaggctaagctgagcctggtttaggggatacacatgcaggcatttggttgcttggatgagatgaacctggatatgatgagatgttgtttggttggttgcagcaaggggcggatggaatggtagcatgcaggagatgttgtttggttggatagatacatattgtgtgtaaaatacctattcttgtgggtggtgaggttacccccataaagtttgtgaaacaagattttttccaagtccctaatctatttatgtgtgataagtttaatccgtcgtagaggttatagattaaattatgttactctgggtgtgtgcacacctactaatattcctaagctcatttttgtcttagagaatcgatgtactgtgcatgtatgttttactgatgtcattttttaaaaccaatgagcagcactgatgataattttttttttaacaaatgtaacgaaatggcctggatgaacacgcaagagtgattattctagcaaaaatcaactacataattttattgacgacactggtacatttgacaattcaaaacaaacatacaaatatacgtgctcatggcaagttttttacaagtaaccaatttgataaacaaatctgtaaccgcatacaaaactaaaccatctgtttcagctatgttctgcctgcaagcttttgtacagattgcttcaaactcatcaaccttagtatatctacacttgatctcacaagtttttccattatcacattttcctgaaacatagtaaaagtaaacaggataacctgtacctttgaaacagtacaggatcagagttgcagagatcaggtcgcaagaacatcaacacttaatagtagtattatctttaccaaaagagcaagtgcagagtgtatcggtttcatataaaaacttgatcatgtcaaaatcaagtgtggttaccaaaaaaaaatgagtacatctgttgatatcaaaacatgaacaaggaacttgatagtatttgcctgacatcaataactcgaaaatgtagcaaatgtgcagaaatttgacatcattgagcctcatttccagcaggtaaataaatgcagaacaatggcctcagatatatgaagaatgtgaattagctactatcattggtatctgttcttaccagtatctatcaaatgtagcaaaagaaaaggtataaggaaaaggaaaataagaccaaatgtaggaaaaaaaaccacaagaaaatgagaacaagtgtagagcaaaaatttattcacatgcatcacaaacagcagcatatatcatcattggccatctttcccagcctaacagcaagaaaaaagaacaagtgtagaaaaatctgttcatgtactcttataaattctgctcaattcaagtgtagaggtggcctcagttctgctaagatcatctgaagtataaaatactgagaaagatcacagaaagacagaaacttagaaagggcatgtttggtggcctgaccttatcgaataaggtcaagtgcaggcatatctgttcttatgcatcacaaataagcactattaatcaagtgtgtatctgtcagtatcaatttaaaagaacgcactatttcttgccttatcagtaacttctatttgtaggcaaagatacaatggcataacacaaatcaacaggaaataggaataagtgtaggaaaaatctattcataagcatcgcaaatcagcaacattagtcatcattggccatcttagaacaaaaaagcaagccactagacatttcattccatcgaaatcaactaagaaagatatcagcttttagtagatctagcatatttatgaaggggacacggtctaatccaaacaaatcggctgaaatcaaaggaagagaggagaagaaaactggaggaggtgagaaaaggaaggagatgcccaacctagcccttaccagagagctcaacggagagagtcgacgaaagagaggggcgtagcagagagccggcgaaaccaaacggcttgacggagagagcgaaccagtggaagagagcgatggcggctagcgaaagagagggaggatgatcaacggaagagaggatgctgacggacgaccggccctcccgccggcgaggacggcgcgacgagcagcgccctccactcgcgagtcggcgaaaccctagctttccactggtttggaacaaatgaggagggatggtggtgaccctatccatgggttctgcacgcgcgggtgcaagcggtgcacgcgtggatgcagcctcgcggcatgaggcgagccaggccgcaactcagcctggctccgcgggcctttttgcatccatcgaacctggctctgagccaagtgcaggcatctaaacgaacacaaccctgctgactaggtgtgagctaggtgcggtccggaaaaccaaacacatcctaagttgacaagtatattgagaatatggttgaagtatactgactaataatcaagtaataatagacatacagacggtgaaaatttaactggcaaccaagcaatgaatcccccaagaaataaannnnnnnnnnnnnnnnnnnnnnnnnnnnnnnnnnnnnnnnnnnnnnagctaatcaaaggcgcgc

SEQ ID NO: 18461 - DNA, 13616 bp, Oryza sativa
  unsure (1)..(13616): unsure at all n locations
cgcgtttattgttggattcgagctcggtacccagcgaaacttaaataagtttgatcaactttataaaaataactagcaatattcgtaatatttaattagtttcattaaactgataatacatctattttatgtactaaatattattatattttttataaacttgatcatttgacttagaaaaaaaattaaaacgaacaaaaatagtactccctccgttctaaaatataaacatttttagttgtgtgtccagatttatagacaaaagttgttatattttggaacggaggtagtagcttatttgtttactcttacttcaattctgacttattttaaagtagttgagatctggttattggattggacacaattcatgtgtgcttccccttaacttccacttcatatgacagtatgagactaacgtttatatccttcatatgcatcatatgcataagcatgtcattggcatatatttcacttctatttactcattgacatgtatggatataaatcaattgtcaagcttcaatataatgttggtttatatccttcatatccaaatgtggttattgttaatggatttgtcatcaatcaccaaaaagggggagattgtaagttcaagtgccttaatttggtttcggtgattaatgacaaatctaattatatgagacttatgtttttatgagcctttctttgactagtctcatttggatatggaagtaaaaatgatgagaggtatgtattaaacttcacatattctaacttggtctctcttgtggatccaaaatattgtgttagcttcctatttgatctttattgattatgtgcatatgcgttccttcatatccatatgtatgcacatcttgagggagagcttatcctatattttgtttattataagatttctatcttgatttgaaatcattttttatctcatcaccaaagagagaaaagattgaaagatcttggattaaacaatttgtgtaattgttactttagtgatagatgataaaccgatgtttatgggattaacctctcttttgcataagttgtctactaggttatttcccgataatgagatgtggaagacatgcattcttttttgatggaccttaatcatgactaggatgaaatgcatggagataaaacgatatgtaccacttcttatctcctactttttgataggttcatatatatgatttccatgttattgatatataagtgtgagactaatatttactcgaatgttatcttatttagtctcatttacattgagaacatggagatcatgaaggtatatgttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatattggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaagaatatgtcccactacgatgaggctaatgaatgacaccatgggttagtggtcaccaagtcaaggacatcgtcatgttggcaagaatgaagtcaagcttttgatgagaataaagtcttgacaaaggatggacaagacctcggcataaacatggttcaaccgaatggtcacaagtgttgatctcggctcaagcttgaccccaagatggatggcgcaaggcaaaggtataagtgtagctaagaatgttttcttaggtctttttcccggtcttgnngtgtttggtgtagactanngatttgctagataggcgccgtactatcaagaggggtctatgaagcgagcttgtggatgatcttgtgctatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggttggttgagctgaaaagtgacctgcggtctgaccgtgggccttaggccggtctgaccgggtctgttagccggtctgaccggcgtggtaaggccggtctaaccggctccactggtctgttgcactggtctggtttttggtggcgatacagagccgccagagccgcaaccggtcagaccgagccgacggcggtctgaccgagccgtggacggtctgaccggccactacactgcagttagaccggccaggttgagtgggctcaatgattgccctgtaacggctagttttctagccgttacaaagtagtccggtctgaccggcctcacaacggcggtctgaccggcagagcacaaagttggggatttcggttccaacggctagttttggtggttgggggtatatatacccactcctcagcagcaagggtaaggttttggcactccattgcattatcttgaacccttgcaagagctctcacacccttgtgcacttagtttatctagtgaggtgttagagagtgagttaagccaatccaagtgcgttgcttcattgttatagctagtgtggcacttgatcatactcggcaagcatcctagacttgttactcttggaggttgccgcctcctagacgtcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctctgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgctgcatttatatttgtgctatttacattcatagagacatatttgagcccatatcagttaggtttgcaaaacttaacttagttgcttagttaaccttgcacctcaccttgtctagcaacttaggttagttttgtttaagtgccattaagttttaaaaccgtctattcacccccctctagtcggcctgcttgatcctacacacgcctgcgtatgccgcctggcacatctggaggctcactgttgtggcatcgtcgggtttcatgccgccgccatcatccttgaggatgctgtctatcttggcattggcgctcgtcgcgttggatgtcaggaggtcgatggcgacgatggcgaggtcactgtagtggttggcgttgaggctccggctgtcggaaccgagcgcgtccatgcagaacgtgacactgatgacgccaccgttgctgccagcaacggtcttgcatgcgccggacatgaaagggtcagtgttgatggcgagttgaacttgagacgccgcgacgaggacaatggcgaagaggaagagggattgatgacgccatgggaggagaccattgtgaaacctcgatcgatctgcaagatgatgtcgaatagtttttttggatgaatacctttgtggccttgcgtgtgaactatatatggacatgttttgcatggtgttaaaaacgaatagatcgtgtctctagttaatgattagatagagtagatccgtagagtcaattattgattccccgtaaatctctgaccaaatatggctaaggcatgtataataacaattaatagcatgttctctaagttattaataatatgattttacttacataaaaaagagaagacagagaaatatatttgttacgtgtgacaacgacagatttttagtgttgtgttacgtgtgaaaaaaaaacattcgtgacgcctccgacccttctttccctcacatcgtcgcacattctcaatccaatggtttgattgtgtgaacccaacttggggagggggtttggagaattattctccgacctggtgtgacctcccactaagccgtcgcggcgcttgccgcgcctctgacactccatactaccaaacgcctccggcaagccgttgtgttgcgctcgggtagcaaacaccacgagactcatgacgcttactatgtatctcgagataaaatttgatacctttagatactaaggctgtgttcgctcattagggttaggaacccatctcctttacacggaaaacggaacggtccattaggacatgattaattaagtatttagtaattttttttcaaaaatggattaatttgatctttttaagcaactttcgtatataaactttttgcaaaaatcacactgtttagcagtttgaaaagcgtgcgcgtggaaaacgagagagaggggttgggaactagaagttccgaacacagcctaagtatctcgagatacctctagttattagtgtaaacttttctagttaaaatctaattcctctatatactaagtatctcgagataagaaaaaggtgtaaaatttaggtaccgagatatcttctcaaggatcgtaaaatttcacttgtttcagagatgtcggtccatgatgattacaagcatgcgtgatgtatatcatattttactataaagttaatgcttaataactactaaatctcaatatccaagtgtgtcacctcatcatccactttaaattttattatttattgcttttgtcaggtgtgatgtaatatgcattagtacatttgtttgtacatttttctttatcgcattatattgtttgttacaacaatgtgtgcatttctgtcattttgtaaaattcagcagattatgtatggaagggaacaaataatataatgtacttacaggtacacatatgtgattacttgcaaacggaaatcctctagctggtacatcaagagaacaaacaaaatgaagagagaaaaagtgagacatgggctaagccatcgttggatgcacttaatataggcaaatagagtatgcatacattaagaatgtcttgccatttctgagtgtataattaatgtttatgtggtcacgtacttgcatctttttcttcccctcttgtccttttgcagtgttcaataattgcatgccaccgaaattcatccatgtaaaaaaaaaattaaataactaggcacaattaataattcaagctagacatggtaaacagacaagaacttgattcgatttgtgcaagtacatatacggaaatactactactgtccaatttccgacttcatgagatttatgtctttgtggtcagtatcttcccctcttccctctcttgcttcttgccgtgtgtttgcgtgcttgccagtgaaattcattcgatgaagatattttatttacataaataggaccaataattcaatgcacgcatagtaaaaaaaaaaaaacttgcatgatttgctttgtgttaatttgtacatggaaattggaaatgctgtcctcttttgtcgatcctgttcagttgcttgtcgcaacaggacatgtctagcccgagaagcaactgaattgccgatcaagcggttgcccgttctgcctttccaaccgctcgatcaagatccaacggtgcacatactcagtagaggcgcttgcattattgcgtccgtggctcaggctacagatgtcacgttatgatgtagctcagctcacacttgtcttgttcatagcatgagcatcgcacgcctatttaaagatgctatagcttcgattccctcctgagctctaacactatcgaagcttcacaaattcagttgacgaattgtagctgttctctctcgtctccaagtgttggaggcaaaggaatccttcgatccataggttcaaatctctctctcctccactcttctgaccctgatcttgttgtgcggttgaaatgttcgacgaaatgcctgagagaaccactctgctttcccttctgctgttggttctctgcatgatagattcgtctctgtttcttcttttctaaggaaaattttgtggggtttcactgaaatttggatggtttactggtgactactgacgcttttttggagttccctttgtaagtgcttggttgtggatttatgtttctgtaactggcagtttcgattttcatgtaggtctgatccaatgatacctattgttttctcttcagtttcttgctgttaaacgattcaatctatattgttctcatccctttattgttactgcgcttactctatgatctatgggctgaattagtgtttatcggcaggcaggacgcaggacagagaatgggtttcgaagaaacatatttttctgccttctgttacttgcttcttttctctgtcagctggaaatgccaagctgcagaactggacatggctcagacagcagtactcgaagttgatgcttcatggaacctttctcgaaagatccctgacacgctatttggattgtttttcgaggtcaggctttgcttatttagcttctggttcagtacatccttctcgcatcactcccacgggcactagaactgatatcaggatcggctcaataacttaatgaaccttacctgggggatgcataaatgcatctagtattttcagtcgaatttaccgttgttcacacttcacactgcagcacgttgtactagctatgatgagatttaataaatcttcatgcccatcttctgcttggtttcagaaaataactcctattctgtacatgttttctcctgcgccggtgtattatagttccattttcttctgtggatggcggtgttgaaatttttatgcattacttgggaagaggagggattggggtggggtgtgtgaagatttcttttgttggcccttgttatattcattacatgttcgctgcaatttgaatattctagattatcctcgacagtcatgataactggatcggtgaacatcacaggaaattaaccatgccggagctggtgggatatgggcggagcttgtcagtaacagaggtaactgtcagcttgataatcatgcctcttggttcccttggaagctatgagaaatgaatggatgcacttgactaagttgcagatttgttacatggaaatagatatatcagtcctaaaaagcaatgagtcattgtactgcctacttgtcagagagagagagagagagagtagcattttaccagtggcatacagtgtagatttacttcataatagatgttcttaggttaataggtctaatagtcaatgaaggaaaataaattataaagtgaaccttttcatgtgatagacaactcctcttttacaaggacaatatagaactccatgtcaggatccagaaccatggtattatacttcttgtaaaagagattaagagcaaacttccctcctaaatgaaatgatatgcatcactcctccttattcatgagaaaaaaatatcaactctcgtcaagagtatttattatgtttatccttattcatattgataactgaaatcagtttgcctaacttctattggcttctagctagagaacagaataggctaaagctcagcactaaaacctagaaaatgaaacaaaagaatctgtgctttataaatttccattaacattgaagtattgccttcactgactaatgcaaaatttatacttcagggtttgaagctggagggccccacaccccttcaaatattgacccatggtctatcattggagatgaatcctctatatacgtcacgactgattgctcatcttgtttccgccaaaatattgttgctctaaggatggagattctctgtgataattgtccagccggcggtgtcggcatttacaacccaggattctggggcatggtatgagactctgtcaacgaaaaataactcacagtccaaataatcttttcttctaaatgacagtttacactgtacacactgtcacttacagaaaatacagcaaaattatcatttatcttccaaaaagtgaaactaacaaatagctaagctaaccctttttttttttggtttcagttcatgttgatctttttctgacgtagtgttggctttctatccaatggttgcatgttgcttacttggaaaatgaataactgttctagttttttcttcaaaccatttccacttttatcttctgtttgttttctgggattttaccttctgattatttgaagaatctgttcatttcaacttccagaatatagaagaaggaaaagcctataatctagtcatgtatatcagatcattagaatcagtcgaattgacagcttcgctcacatgctcagatggaatgcaaaatctggcatcagtttctatacagtatgtatctttgccatagaaataaataattgttaatgtcttctttgtttaagattgaaaggattgcatattgaaatgttgcagaggtattgatctgtcaaattggacaaagatagagttgcaattactagctgaaggaacatgcagaacttcaagacttgaattaacaagtatgaaaaagggaataatttggtttgatcaagtgtcactcatgccttcagacacatacaaggttcatcgcattttcatcttgctagtggctactgaccatcatagaagcatgctttgctctgggagcagccactgaatatatatatatatatatatatattttttgactgggcagccactgaatattcatgaagaaaatatagtaactagaatactcgaaaagataaagcaacgatgcactgctttgagatgcagatatgtgtactagcagaattataaagtattcataagtacataacaaacatgttggttcaatctcattgctaattaataagtcataataaaattttatattcattttgaaaaaaaactggaaataaaatctatccctcctttctttattggcagaccatgattattagtttacaacattttttaatgggaattttctagcaatatttgttaatgggcattttctgctatatgtacagggccatggctttcgcaaggaactactatacatgcttttggaattaaaaccacagttcctacgctttcctggtatttcttgttccctaaccaaaataaactattaggggctttgaacatatgccttggtttttcgcatatttacgatcactgtattatatccagttatttctcgttaaacttcaaccctatattcctttttaaaaaattcgaggtcatattctaactagaattaggaaaaaaaaactaatatccaggtaactaaaaataaatcaaacgtgcactttatgatgtctgccagaggaattaataaggacttgctatcataatataacagaaatacattgtattttactttgtgatgttaatctaaatcattgctgggataggaacaagcattaataatcaagactctagagtaaagcattaaaaagttgaattagtacaaaacagcatgttagacatatatacatataatttttagataacataacatatagataactgttcgtctgtttgtccctaacagttatagatttacctatatttgcatatgatttccataatatcctagatagtgataacttgtagtaactaacttctgaacaagtccatatatgtctcaatcaaaaactttatatgacacttttgataggggggtgctttgttgaaggcgattggttaagaaatgctttcaggtggagggaaactattggtccctgggaacagagacctgggcactttggagatgtttggaattattggaccgatgatggcctaggatattacgagtttctccaggtgtatgttagttaatgccatctgagtgtttttttttcatctcttctgctatcaacatatctaacgaaatatttctaccgaaattttcatggaaagctttctgaagacctgggtgctgcccctatttgggtgttcaatgttggtaatacattattcttatttatatttttcttgttttaccatatgttttcttatcgctagcatgcccattaactgcttacagtttttatcttgaaatttagggatcagccaccatgatgaagtcgataccaccataattgaaccttttgttaaggtacgttaaatgcccaagtaagaatagtcatccaaatataactgggtagagggttactacggttccatttttccttattgcagatgccatcattgcaaaacaaaatgttgttctatgcatatgccattgtttcaagtttttttttcttattataggatgtattggatagtcttgaatttgcaagggggagagcagaatcgacatggggttctgttagagctgcaatggggcatccagaacggttcccactgaagtatgttgctattggaaatgaagattgtgacaagggattttaccgaggtatatttttattaaccagagcttgtcatgctaatgatcccatttgttgtcaatgccatagttgttctcattagttttcaatagacacatctataggctaaaatgatgtgatggccaagtataattaacacaaaatctcttatcatttatgtctgcatatctaaaaccgcttattttccttcttcgttcccctttttctttgtttgtatgccatcattacttggagtcaactacagttatgaaaaaataatttcacccttacaaataagcataataaaaatataaacatttgtaataaataatagatgaaaatagaatgtatgtaacttttagccatttattgtaccagtttccgaggatacattttctttgcacatgaagttataattgctcataaccttcagagttactatagccttcactaatttcatgaaagtactagagagccatgacggttttcaatcctattgtacaggaaattacctcaagttttatgatgctatacgcaaggcctatccggatattcaaatgatttcaaactgtgatggatcatctaggccacttgatcatcctgctgatttatacgatttccatgtaatcttctttcatcagaaaatattctccattttcactttttaaatactgtttcatgatttcgacatacttctcattgtgttttcattaagatgcattctgacatttttttcaggtctataccagtgctgctaatctttttatcatgaagaataagtttgataggacatcacgcattgggtctaaggtattttttaatccttatttggatagtatgggtctctgggatttctggccatcatggtccatccaaaacatgacctttgtttttgtgatttattctggcaatagatatatccttaaaatactgatataaaggttggccttaaataggcctatcttcctaattttggtagaatatttttaggacattgtttcttccatattattctacctgaagttggtttcttcatttatttaagtttctttagaaattatattgaagtcataattttatacgtgcaaattcaatcaatggtgttgtagtgtcaactgtcacaacactctggaaggctttgtttctctgtaccattacagttctcttgcatctcgacatcctaggatattggatacacagaaagtagtcattaatgactatgctataatcttattccaggtatttgtcagtgagtatgctgtcaatgaacaaagggatgctggtaaaggaagccttcttgcttcactggctgaggctgctttccttactgggttagagaaaaataggtgatctccttcacttcatactttccttgaataatctctctctccatattcttgggctagctgaaatgctgaatcatgcatgcggctgtatttagatcatccatgacttttccaggataaatgtcaatattgtcatgaataattactagtttatgaccctgtttagataattaaatttgaattgaggggataaaagtttgtttttcagaaattacaagataacatgtacacatgttgtaaatactaatactgagcagcaaaaatactctccatcatgaataaattaaaagtttctgtcatgtttctttgcagtgatcttgttcagatggcaagctatgcaccgctcttcgtaaatgacaatgaccgcacgttagtacctttggctttgccttttttattttctaacattcttcttgttcacaagtgcttgagtttgactagctctgaatgtgatgatcagctggaacccagatgcaattgtattcaattcctggcaacagtatggcactcctagttattggatgcaaacatatttccgtgaatcaagtggttctgtgattcatccaattacgatcggttccagctactccgattcactggctgcatctgcaatcacctggaaagacacacatgatatctttctgagaataaaggtagttaaccattccatttttttcctaacttgcataccattgcagcaattcattagcgaattacctaaatgttttgaatgatttagttacaacaatataaagcgatataaaactgattgagccactgcatacttgcacatctgtttggattttagaagatatattcatcttcaaaagatcttctgcagatagtaaactttgggccaaatgctgttaacctcgcaatatcttcaagaggacttcaagctggcgtcaatacggcaaaatcaactgtgactgttctcacatccggcaatttgctggatgaaaattcatttgctgaaccaaacaaagtaagacaaccattggttggatcacaagttatttgtttcataactatgcactgaattagtgaatttagcagagggtaagtttaccattacaactttatagaatgcacacatatgcaagccgtatgtcgtaagcaaactctgtctttcagctttatttgtaagcttttaagaaattgtttatttagctgtctggaattattctctagtctttctcgataattttttcgcagacagggtcaatctcagtgtggcacacgatattctcaggtgttggcgagttcatctaacgtacaagtatcttgtgaacgatggatgcaggtcgtaccggttaaaagcgagctgccagatgcttcagaagagatggaagcagcgctctctccttattcattcacttcatttgacctcgctctagatcagtacagcaagctcgtggcagagatgtgaagcaatgatgcacacttataccagagaatagaacacaggatgattacgtgaggtgtggtacctgaatttcagaaagctaacagagtgtatatactgcattctggcatttgctaatcacacttcgtgtgaccctgttgtttatgacgctgtaagagtagtttaaggttgtcacattatcgaacctagcggtaannnnnnnnnnnnnnnnnnnnnnnnnnnnnnnnnnnnnnnnnnatantactatntcaaggcgcg

SEQ ID NO: 18462 - DNA, 6789 bp, Oryza sativa
  unsure (1)..(6789): unsure at all n locations
cgcgtgattgataataccatcctcagtnnnnnnnnnnnnnnnnnnnnnnnnnnnnnnnnnnnctgttttttctcaacataattagctatttatttccctctatggccatatctccttctcaaataaacaaagataaagggaggttgaaatggatttgcaatttagagaaaattagcatgcacgcaagtggagtatcttaaacatgttttttttattttacatgctgctaatggtatttatgtattccctaatttatcttctctaatgtttccacaattagaagacatatggatcctacaggcctactcctagtatgcctagaataggagacatagtaggcctatgcctagaataggagacatagtaatttacttttgactactgtctcggttccttttcgcgctcgatttttcagcatatccggatctatcgtgcttgacactgtatttctgattttttttaccgtgattgattagtaagtttaattaaactttttaacagaaggtttaattttaaattgaaaattttgagtaaattttaattcaaatttaaaaacttttaactcatgaaaactgtaaagtcaaattttaagaaacttcacgaattttgaaaactttcaagtcaaatattgaaagctattaactcgaatttttaaaaaattttaactcaaatttgaaaaattttaactcgagtttgaaaactttcaactcgaatattaaaaactttcaactcaaattttgaaaactttcaactcaaattttgaaaactttcaaaccaaatttaaaactttcaattaaaaattttcaactcaaattttaaaaactttcagctacaaatttaaaattttaactaaattatttatgtatttctttaacataatggtataagcactgtcatcagagatgagcactacagtgagaaagtttattaacgaataggagcaaactcaaggtcattgatatgctttagaagagagtcgaggtgctccaaagtgaaacaacagcaagattatatagtccaaaatgaagacattggtttaagggtggtccaaagcgaaacatcctaataaaaggtggtctaaagtgaaattactcaacaacaaattaaactctaaatagtttacgtatattcatagttaaatttgtttgtttttgttacaacttatggaagccaaattataacttgtagtttgtggagtgatatattacatgttaaaccatattgtcaaattttttttgaaacatttttataaccatttagttgacatgcaataaacgagtggatgtctacacgggtgattacaatccctctctgttctgccaggcttgctgattctgtcagcaaaattaaaaaagaggtggttcatactaaaatcaaatttgttgtacatactaaagttcaaataaagccctcactataaaaaaaaaagaagttgcataaatattaagacattacatcattcccagtcccaatataccaccctgcaacttgtgttctaaaacatagccagatcaaatgaggtcaatgagaatggaaggagtaagaactgcatctcttgcccagcattgggtaactcccttgtaactggcacaacctgcaacaatctagtatgttagacaaactcgcgatgcctgataatttcttgtgttccactgaaattaattcactgcatacaactcctttagaaagatgatgaaataattccagacacgaccaaataaacaggttccgtaaaagcttacgaagaaaactaaaaggaagaacagagaagatagatctacaaagggtatatgcttatgtaccacacaccactactttgagtactacaaataggagacatacagctcccacagttttacttcaaaaataagggcatatgtcctaacagactataatgttgtaatggaaaagctgtcctctgctaaatttcagtgcataattatgaaacaaatagtgatcaaataacgactatcttaccttgtttggttcactaaatgaattctcatccagtaagttgctggatgtgagaacagtcacagttgattttgccgcatttacaccagcttgaagtccacttgaagatattgtaaggttcacagcacttggcccaaagtttactatctgcagatagaatcagtatgttctaatatatatgagcatattactccagcagtagaacaaataagacagatgttacgcaagtaaccggtgcttcaatcaattttatattgttgaaactacattattctaaacactaaggcgcttgtcgatcaatgatttcaagcaatggtatacaagtttggagaaactggaatggttggtttacctttaccctcagaaagatatcctcattgtcctgccaggtgattgcagatgctgccagtaaatcaaagtagctggagctgatagtgactggatgaatcacagaaccacttgattcacggaaatatgtttgcatccaataactaggagttccatactgttgccaggagttgaagacaattgcatctgggttccagctggtttttagatttacacattaattgtcaaagagagaacagatgctagaatcctaaacaaagtaaagtactaaaccatgaatactaacgtgcgatcattttcattcacgaagagtggtgcatagcttgccatctgaatgacatcgctgcaaagaagcaagcaaagtccaattcagtgtaaatatttgtttttttaataaagcttcctcttccccgcaaaaagaaatatttacaaattagaaatttatacatactagttttcctataatttctgaaatagttattttccttctgtggtgaagtagaagaatgagataataattgtagagacaaattaaccatttgtctaggaatcccttcaaagatcttttatgttcatgcataatctggagacaacattatatgcatgattttatatttcctctgtgtaaacgagagggattggcgaaataagatgaataattattgtattaagcttcaagggctgtttatatagcatgcatggcttggaggttaagaaactatcttcgagataagaaaaggggattagggataagtcagtatcgggatgacaaatactaaacttccaaatacagagatatgccaaattgccaatatactctaatgctctaaacccaagataaaggagagagtatcctgagaggaactaaagggatcacctgtttttctttaaaccagtgaggaaagcagcttctgccaacgatgcaaggaggcttccattgccagcatcaccccctttgtcattattaacagcatactcgcttacaaatacctggagtgaaacaatagcataatcaatggttattttgactgtctgagaaaacagtaagacataattttaaaacagggagaatgatacaaccaaattagcttcggttagtattttacatggaagtcatacagatcagcaggatgatcaagtggcctagacgagccatcacagttcgaaattatttgaatgtcaggataagcctctcgtatagcattgtagaacttggggtaattttctgttcagcataattatatggttatatgatatcacaggaaaattaggatattggtgatagcagtagagcattgaagtgtactgaaacaacattaattataattgatagtcaatttagctttgttcacatgcaactagtaaagtgtgtctgtttcaaaacataacaacaggctagacaattaacctattttcatttgtttttcctagaatacttccattatagtactcagagtcaaaagagttgcaggtaaatgaaatagcgcttttgttgcagatcaatagagaacagaataatgaattttggtaattatcacagcattgacatgaaggaccataaacatactattttgttttagtcaaaatttaccttggtatgtcggcttgaatatttcacaatcttcattcccgagtgcaacatacttcagtgggaatggttcagggtgtcccatcgcggctctaacagagccccatgttgattctttactccctcttgcaaactcaagactgtctattgcatcctgtagcaagaaaatcaaagtatttcgaaataataaacatgggatgacaataaatgcaatgccttatgtaatattcacaagttataactgttttctgttacatcatgagaagccaatcttcatctcaaccatacttcaaaaaattgtagggtatcgaaaacatacctttacaaaaggtgtaagcatagttccattaactacatcactgtgactcatccctaaatcacaagataaaaactccgagcagttcattggtatgcgaggagaaaagattaaaaaaaaagtaaaacaagacaaagtagatgcagaatatttaccaatgttgagcacccgactggagcagcacccaagtcttcagcaagatttatgaagacatgaacagttcgaagtaaacaaatgatcagatatgatgagaccaagagagaactcatttgacattaatcaatccatacctggagaaagtcataatacccaaggccatcatcggtccagtagtgccaaacatctccatagtgcccaggtctctcttcccatggaccaatagtttccttccacctgaacgcattttttaaccaattgccttcaacaaagcaaccccctgccaaatgtaatgccagcgattaaattacagggcaaccaaaattgattaccagttggaaaacaatcataataccaggaaaccgtagaaaccgtggttttaagtccaaaagcatgtacatgagttcctggcgaaaaccatggccctgcatacatggaagaaaaatgcctatcaacaactcctgtgaactaatagtaagcatggctagattaaggaacaataagttgatctcacatctctacaggactaccgattacagataagttaattttttttttttgtcagatagaaatgagaacaactgaccatttttatgatgacttttttcgaatattcttgaaaaatgtcaaatagcatacatgatttgaagagggtgcccattgaacctggcatgcttatactagtgactaaatctttggggtcagtacatgaatattattctccattcttcataagatgatagcagattccggatcaagctatgatgacaatagcaataagaagataaaaggcaatgcaccttgtatgtttctgaaggcatgagtgacacctgatcaagccatatcactccccttctcctagttgtcagttcaagtcttgaagttctgcatgtcccatgagctagtaactgcagctctatctttgtccaatttaacaaatcagtttctctgaaaaatttgatgtacaatcctatgagttagctagcgaacaagagagagagagagagagagagagagagagcgagaaattgagaaagctttttcttaatctcagtgctaaggaaaaaaaatatataccgaacaaaatttgatgccagattttgcgatccatttgagcatgtgagtgaagccgtcaactccaccgattctaatgatctgatatgcatgactagattatatgtcttcctttcttctacattctgaaaattgaaatgatcataatcacattaaaatatcagaaggtaaaagtgaaaatggtttgacgaaaagctataacactgattacactttccaagcaagtgatgcacggcaataagatagaaaaccagcattatgcgatcaatgcaaattgaaagcaaacaaaaaataggttagcttagttatctgttagcttcagtattttgataagaataataactttgctataattaccttcggtggcagcaccgtatactttaaactatcatcagaaaaaagattctttcgattacaagatctattttgcatattcatatgggaatgagctgctatatgctgagagagaacttataccatgccccagaatcctggattgtatattccaacaccaccagctggacaatcgtcacagacaacctctatccttacagcaaccggattttgactgaaacaggatgagcgatcagttgtgacgtgcacagaggattcatctccaatgatggaccatgggtcaatgtttgatgtgttggctccagcttcaaaacctaaagcaagaaattagacaaaagttcagttaaagttaaacttcaaatattattatttatttatttatttattgagggggaaaatgttttcttattcaacattgctatacatgaggtgattgatttctccccaaatattcttggcagtaagatcacaattcacaaatccaaccatccatgttgcttcttcaacctccagccttctcgcacacagacacacaccacccccaaccaaaacgaggtcgccggtgaatctcgagcatccctgcgccgatgagcctcctcctcctcctcctccttttggctttcctccccggcgcgacagagggcgaatggattagggtattgtgttggggtggggccgtggagtggatctggcggggtagggggtttgtgaagggaggagcagttcatcggggctgcgtattcaggaaggggaggctttgggcggtagggccagccggtggggtggcacccccggtccggtgggtgagaagacgccggatccgcccgcgagacacgctggagatggtgcaggtgcaggagaaggtccggggaggaagcagccaggagggaatcgttctcaacagatgaaaacaaggaagaccgcagagagagaaacaaaacacagaggggtacgagtggatgataggcaatcagtttct
